United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 5

SEQ ID NO: 242 - DNA, 2077574 bp, Homo sapiens
actgttcttaggtattcttatatccccaatactcctggtgtataactttcattaaagatttattttctccctctacaattcaatggcctttaggatattcacaaatttatgcaaacatcccacaatcacagaacatttttcattaccccaaaaagaaatcctgtaccccttagtcatcattccccaattgccccatacctcccaggcctaggtaaccagtaaccgactttcagtctctgtgcatttgcttattatggacatttcatacctaggaagtcacatgatatgtggccatttgtgtctaccttcttttgcttagcatgtattcaaggttatccatatcatacttcgtttgttgtttttgctgagtattccattgtatggatataccacgttttgttgatctgttcatcagttgctggacatttgggctagttccactttttgtctattatgaataatgctactatttatgtgtaagtttttgtatggaaatgttttcaattctcttggatatatacctagcaatggaactattagatcatatagtaactttatgtttaaccttttgaggaattgccagactgtttaccaaagcattgcaacattttaaaaaaaattgaggtgaaatccatataacataaaattacccgttttaaagtgtgcaattaagtgacatttagtgcattcccagtgttgtacagccattacctttctacagtttcaaaacttcatcatcccggaagtacactctgtacccattaagcagtcactccccattctcccctctgccattccctaatccagtaatctgctttccatctctatgaatttgcctatttcagatatttcataaaataagaaccatataataggcaaccttttgtctcgcttttttcatgtagcacaattgtttttgaggtttatccaagttgtaacacctatgagcacttcatttttttatggctgagtaatattccattgtatgtatattccaatgtatataccacaatttgtttatttactcatttgttggtcaatatttgggttgtttccacctttaagctctaatgaataatgcttctataaatatttgtgtacaaatttctgtgtgaatattatgttttcatttctcttggttatatacctagtaatgaaattaataggtcacattgtataggttggtgcaaaagtaattgtggttttctccattactttttatttttttgagacagagtcttgctctgtcacccaggctggagcgcagtggcgcgatctcgactcactgcaagctccgcctcccgggttcaagccattcttctgcctcagcctcccgagtagctgggactacaggtgcccgccacaagtccagctaattttttgtatttttagtagaaacggggtttcaccttgttagccaggatggtctccatctcttgacctcgtgatctgcccacctcagccccccaaagtgctgggattacaggcgtgagccaccgcgcccggcctctccattacttttaatgccaacaccgcaattatttttgcaccaacctaataaatctatatttcacgttttaaggaactgccacactgttttccacagtgactataccattttatattccaaccagcaatgtgtgaaggttcttgtttctccacatccttccaaaatttgttaatttactgttttttttttttttttttttgttgttgttgttgttttgtttggtttctttttgagacagagtcttgttctgttgcccaggctggagtgcagtggtgcgatctcggctcactgtaacctctgcctccggggttcaagcgattctcctgcctcagcctcctgagtagctgggactacagatgtgagccactatacccagctaatttttgtatttttagtagagacagggtttcaccatgttggttggccaggatggtctggatctcttgacctcgtgatccacctgcctcagcctcccaaagtgctgggattacaggtgtgagccactgcgcccggccgataatttcctgttttttgattataaccatcctagtgggtgtgatgtgataactcattgtgctttttgcttttatttccctaatgaccaatgatgttgaatatctttcatgtgcttggtcatttgttcatcttctttgggaaaatttctatccaatttctttgcccatttttaaattgggttgtcattttgttgatgagttgtaaggttctttgtatactctgaatactgaattctcatcagatatatgagtcacaaaaattttctctcattctgtgggttgtcgtttcagtttcttgaagatatcctccaaaacagaagagtttttagttttgatatccagtttggtttttccttttttgcttgtgcttttggtggcatatctaggaaatcactgcttaatccaaagttaggaagatttatgcctatgttttcttctaagagttttaaatctttagctatatgtgtaggtctctgatccattttgaattaatttgtgtatatgaggtatgaggtgggggtacaaattcattcttatgaatttttatttatttttggtttaattttaaagagatgaggtaggttctcgctatgttgaccaggctggtcttaaagtcctggccttaagtgatccttctgcctaggcctcccaaagcgctgggattacagatacgaaccattgtgcctagcctttaaaaactgttttatttatttttttcaaattcatttttttcatgtggttatccagttgtcccagcaccatttgttggagagattatctcctcctgcacctcccacactgagttttcatggcatctttgccaaaaatcagttgatgataagtgtgatagtttacttgtaaaactctcaattccattccagtaacctatatgtctatcttcacatcaggaccatactgtcttgattactgtagctttgtagtaagttttgaaattgggaagtgtgagtcctccaactccattcttctttttcaggaacatttttttccatatgaattttaagaccagtttgccaatttttgaaaagaagtcagctgggattttgataaagattgtgttgaagcccagatgcggtgtgattcattcctgtaatcccagcactttggcaggcttaggcgggtgaatcacctgaggtcaggagttaaagaccagcctggccaacatgataaaaccccgtctctactaaaaatacaaaaaattagccaggcgtggtggcagacgactgtaattcagttacttgggaggctgaggcaggagaacggcttgaacccaggcagcggaggttgcagtgagccgagatcacgtcattgcactccagcctgggcaacaagagcgaaactccatctcaaaataaataaataaacaaataaataaagattgtgttgaatatgtagatcaatttggagagtattgccatcttaccaatattaagttctccaattcatgaacatgggaagtcttttcatgtagtgaagtcttctttaacttctttaaacaatttttgtggtcatcagaatatgagtttcacactttttttgtaaaatttattcttaagtagttcatttttgatactattataaagtttctttcataatttcatttttggtttgctcactgctactgtatagaaatagaactttttttttgtatttatcctgcatttgttatggagctcatttattagttctaatagtttcgtagttgattccatacgattttctgtatacaagatcatgtcttctgtgaatacagatcattttacttctttctttccaagcttgatatcttctacttttgtttcttgtgtaattgccatagctagaacttccagtacaatgttgaacagaaatggcaaaagtggacatccttgtcttattcctgatgttagggatgaagcagtcagtctttcaccattaaatatagtagctttgggttttcaatatcttctatcaggttgataaagtttccttccattcttagtttgtcacacatttttatcacaaagcctgttgaattttgtcaaatgcttttactagattagaatgatcatgtgatctttgtcttttattctgttgatgtgattgttacattgatttatgggtggtaaaccaatcttacatttctgggtaaaatccaaatatttctttttttttccttttctctgacagggaattgaacctgggctgtggcagtgagagtgctgaattctaaccactagacaagcagggaccaaatacatatttcttaaattgaatttatcatgagcacattatatgaggattgggtaaaaagtaactaaaaaaatggccaaagaaacaagatggaaaataacttccattttcagatagtaactatttaggaaacattgaaactttggaagtgaaattgttattgtgtaaatattttaaaaaagcatgtttatacatctttcacactctttgagtcttatatttttcctttaaagtcttggaactagacctttatgatattctaaatttaataacacttaacaacttgccctaaatatccctactttataacaattactgtagtggtttcctcatagatttgttttttccccatcccccacacccttcccaagtacacacccttcccaagtattatcccaagtgagactatcattatcatctattattcttattggacattttaaagtacctgtacaaaaatggcattagttagggatatagtaaagttacttctagtcttttaattggcttctgcccttggcgctgtttgagcaaagagaagagaccctcatagagaactctaaggacaaaaaaacttacttttaattgtgaccccaagaattatcaatatctctattaacagagacaagggcttcatcttctcttaagcagcttctcttcactgtaacacaggcagaaactaggtgattggcccaagagctcctcttctcagggactgtggtgggggcaggagtcagttgctaagcaaccatttccttactcttgggccaatgggctgccagagtgttcctttcaagccggaatgaaggcagctgctggagaatgtaggctgtggaaaggatccactgctattcctctggctgaagataaggggtaggctagaaattaggggtggctctctaacatgaaaggaagggaccagaagtccgactcgtacgtgtccacacgttcaactgtgttcaggggtgctggaagttcttatttttatgttgcctctagaggtacaaactacacttatgtaaaaacacaattaaggtacatgaactgatctgacatcatcctgtaagctggtatctctaggctatggcggaaaagaaacaatgggccaagtctgctttgttcccaatctggatgaaaatctttatcctcttttccagttagaaactgctgaggatttactggaacaaaggcaaacaaagactgtttaacaatgtctttacatacctcagataatacagacatctcacaagtggtaccttcaaagctacgagaaatcaaaatgaatatttagggaaaacatataaatattaaaaatatccaaggcacagagctagttgagaaattatgcctacaaaaaatatccaacttttacagtctgtccaggtcattactttagaaatagacattttattgttttgaatttacagttttattccttttattagtttcccattgctgtgataacaaattaccacaaacgtaatgggttaaaacaacaggaatttattctctcatagttctagagaccagaattccaaaaccattcttacagggctaaaatcaaagacaaggctagctcctcctggaggctccagggaagaatccattcttggcctggaatttttcagcttctaagtggctgccagcattccttgatttgtgaccacatcatttcagtctctgctcagtcatcacttgccttctgtagtttaatctccctttgtgcccctcttataaagatacttgtgattacatttagggcccaccaacatgatccagaacaatctctctctctctcaagatccttaatgttggctgggcgtggcagctcacacttgtaatcccagcactttgggagcctaaggcagttggattacttgaggccaggagttcgagaccaggctgaccaccatggcgaaaccccgtgtctactaaaaatacaaaaattagctggacgtggtggtatgcgcctgtagtttcaggtactcaggaggctgaggcatgagaagtgcttgaatcctggggccaggggcctgaggggtggaggttgcagtgagcagagattgtgccactgcaatgcagcctgagcgacagagtgagactccatctcaaaacaacaacaacaaacccaaacttctttataggaaaatcaatgagcaatgaaggcatataaggggaagcggcaaacaaaggtcaggtagggtcagagtcagggaaggctttgctagggagtgatgttcaagctgaaatatgaagaacgagagtgagtcagctaaacaaatcatgtcccaggtgttgcaatgaacatgttaagaggctatgtgggctgggtgccgtggttcatgcctgtaatcccagtactttgggaggctgaggcaggtgggtcatctgaggtcaggagttcaagaccagcctggccaacatggtgaaatcccgtctctactaaaaatacaaaaattagccgggcatggtggtagatgcctgtcatctcagctactcgggaggctgaggcaggagaattgcttgaacctgggaggcagaggttgcagtgagccaagatcgcgccattgcattccagcctgggcaacaagggtgaaactccgtctcaaaaaagaaaaaggctatatggtgttccagaacatgaaatgatgctctgtgggctggaatcagagactggggaatgggggtggtatggagcatagtataaaataaggctgggttagtaggtgatagtcactccattcttaataatttaattgttataaaaagactgtattagcctgtatgcaacaaaataatatagactgggtgactttacacagcagaaattaattttctcagttctgatggctagaaatctgagaccaggttctggtgagggtcttcttcctgcttgcaagatggctaccttcttgctgtgtcctcatatagcagggaaagggggtgggaggagaggatgaaagagatctccctcttcttataaggcctcagtcctattaacctcactcacccttatgacctcatttaaacttaattacttcgtaaagacctaatctccacatttagtcacattggagattagggcttcaacatatgaattttgggtgcacgtaagtcagtccatagtaaagaccaccagaaagtcattgaatgacttacagaagtgagaagacgtgatcacttctgacaaggtatcactagatgcagtctagacaatggacagaagaggggcaacagtgggcatgaaggccacttaggaagtctttgcaatagtccagctaaattcagactaagtttactgcaatgctgttggaaagtagtgattccagacttatacagaccgctcaataaaattgcgtaggtatagcaaccgatttgatatgagagtgaagttataagaggtaccagggatggtgcttaggtttccagatttttcaactaaacgggtaatggagccattcgaagagatggggaaaactgggagaaggagcatgagttcagtttggtacacggcacatttcaagtactttagggatgttaaatatttaacagttttgaatgataatggtattttgtcagagtgattaatactaaatgctggaacaaatgccctctacatacttttaatgtgctttcacacaataaaagttccagttctttgagctgacatgaaagaaaagataatcaatagtgtaatgttcctaagaaagcacatgtggaaggactggctggaggctggagtgcaaacagcttctctgttgaagggaaggtgtctagtatgatgtacttgtcttacctttcacatttctacataagaagtcaatatcttttctacaaaatctgcaactgttcccatattgcttaatattagcattgctattttgcccccttacccatcctatgaaatgtttttcttttcttcctcacctttctttcaaaatctattgcattatcaggttttatttattcttccctggtaatgtctctaatcaaagacctctttctatttctagtgccaataaataagtacatatttttattactagctcaaatgtcacttccttcttgaagccttctttatttatcccaaatctattttttttcgtatttcacagcattaaaagaaaaacaggctgggcacggtggctcacgcctgtaatcccagcactttgggatcacttgaggtcaggaggtcaagaccagcctggccaacacggtgaaaacccatgtttactaaaaaaatacaaaattagccaggcatggtggcgcatgcctgtaatctcagctactccagaggctgaggcaggagaattgcttgaacctggcagaaagaggttgcagtgagctgagatggagccattgccctccagctgggggacaagagtgaaactctgcctcaaaaaaaaaaaaaaaaaaaaaaaaagacaaaacaaaaattaccttaccatgttgtgaatcatccttatgagagtgtcctactactaaaaatattccattctttacaattctttttggggcctcccccctttcttccttttctcttctattattttttaaaaatgtgttccaaataattatttgcccaatatatataacaagtacccaaactgccaaataaatgtggatttacaacatccactcaattagccttgaagatgatctgatatatagaaacacaacaaatttggggggagggtaccaaacttctaaattataggtcaccctactcatgtggcggactttagtgaaactggattttcagaacccgccaggtgagtattatccagaatcaagccagctttttggacctgcgtcttaacattaagcaattggtagaataaagtaagaccactcggctctggttaacaggcatctggatttgttttgacgtaagacgtgttttcaatataacattttggttgtccgcaacttcttggttcttaaaaccgtcttgagtatcgcagtctacatttgttctttctaaacttcaccaaattccaatgaaatttgtaattttcactacaggtttgaggagccaactgcatacgatgtggaaccatttgccaatactttcatttcttttggtcttttttagttgcccacccagaggaaagcatcagattacctggtgaaaatcctcctcaacagggcagttggagtgagcacggacaattcgtgttgaccctcggtctcctcccacttctacatcctccaagtccctgaggcggctttccgctagctcgcctgtcacttggcgcacctggctctacaggccacgccctcaagtcttccaagaggccagcggtaagcgcggtccacctccctctcccactaggcgtcggcttcacgccgcgcccacgtctcgaggacagctccagccccctcgctccctggctccgccccctcgctccctggctccgccccctccagctccctagcgtcgtcggcgtcgagcccgagcctgcgcctgcgcgtgcgccctggggcccaagttggggcgcgccgtggctagaacacggagagcggcgggcagtgcagccaatgggaggcggcgctgcctagcggctggtaggcggtgcctgcgcgggtgttaggttagcgcgaggcgtgacctagttgacaggctctgaggtgctgctgtggcggcgtccgcggggctgaggcgggtgggagccggagccgagcgcgggctgagggaggagggcggcgactggagagcggcgagcggcgagcagcgcaggacgcagagcctctttcactttttccctgctgagtgccccctcccacccctcccactccacacacaccctgtttgcccgtgagcctggggaacttgcagcttaaagccagccacccccacggcaacatgtaccccagcaacaagaagaaaaaggtgtggagagaggagaaaggtaaccggcccgtcgagtcctgggggtgcgggcggtgggggttagggtgggggcgggggtcaggctgtgtgtgccgcggcgccctccgcccgagctcccgcctcgcgccctcccggccggtgccgcctccctccggtgtccgtgtgtacacacgcgcacactcgcgcgcactccggcgtgcacgcgccgcccctgggcacctgcagctcgcgcacgtgtgggcgcacgcccctctctgttgccctcggcaccccgtcaccttctcccgaggcggtgctgcgttcgcctcgcttgcggcggggacccccaggcggcagccccgggcgcggcacaagttcctctgcaccgcagctgggacttgggcactgccggcctgggtgtcccgcggacaggtgcccgtcggcgggcgctcaggctgcagctgccgctgtgcctccgcgctccgtgcaccctcatttctttccttctcgcccctgtccccccagcccccgaatggcaaagcgtacccaccatcgggtgtttaccccttgtctaggtttccttccttcgctgccgcagcgtgacttttgaaacctggaactctaggggagccctaaaacgagcgtgttgtccgtgaggataagtgccttcagagaagtctgaatgggctgttctcccaacagtgtgtttctctgtattccatccccattcatgggctgaagttgctcagagtaagattttgtgactaatgtcactctgtatgaacccatctctgaattttgtgcgtataaggtttatctaaatcagctagattgacagtggcactgattctttaagaaacacaagtgtacgatccagcgtctcccaccaagatctcccgcttatcccatcacagtttggtaatattctaacttgagtgtctctggcgtttttcaccctccttttcacacctctttccttttcattctttagctatttacagaaatgtagcaaaaacttcttgcactcctattgctaaaataaactaaaacctgtatagcaagggtgaggtctattgagggtagtgcgcatttctcctggtacctcatctttacaaaaggatataggggtgactaggtatcaagttgatttccttgttaatagttcgttaaaacctgtagatttttattgcaagtcccggcctttatgaacacgaaggcaaaacagtggaggtaagaaagggaattaatgtggaaaaagaatccactatataggatcggcttccacaatgcacgaacaaaggcgtgaggagggaattttttttttcaaatttactgcaggaagatttaataatagaaccgaacaacacaattaaaatgatctttaaaaatgttgaaagtttagtcatttaattatgttttaataattatgggtttatagagagctaacacttctggtgttataaatcaaatgctgtcgagagtaatagcctgatagataaagtagtgtaaaataattttgctttgtttttttcagtagtagttactttagtttcaacacactttcaacaaggatttgccttgtgagcactgaaaaatcatttatgcccatgtttattgatgatgctgaaatgttcgctttgtataattgatgataatgagggcaaaacagtggaagacatagacattgttttcagtaacatgaatcattgatgaaattatagtgagtacttaagaactatttttctgtcataatagaaaaacagtgttcctcaagtaataacgttataatgtttccttcatttaacatctacacagttggactgtgaccagcaggcattttagaatcttttttaatgtcttgatttcttttcttctaataatggagaatatataaccaattttttttcctaaggaagcaaatgcaccattaaataaggcaattaacaagtaattatccaaaactaagttatttttgcatgaagtttaatgttaaaggaaaacgttactgcgatacgaagactttaatgcatatctcagtgtttctttttttcaggatgtctatgtttggaatatttaaatataaaatatatattatacccccaaggaagagctaaggatttctagtaccatagttagtattagagaagctgatgggatgcatgacctttttcctttcagcccactgggaagctgatggtatagtatttttgcagctgtcctttaaagctaaaggaaggcttacctacctcattgaaatgtcaaggcattctataaacatatttttaactcagtataccatttaataaataggtctgcctacttaattgcttggttcacagagaaaggactcattgtaaaggtgaagcattctttaaataaaagttttatgaaatgacaaagaaaatgcatatatatttgtggcctccagtatgtttcattgtttaaacaagtaattaaggagttctgaagaccacatatgtttaaataaacatgtttgatctagtattttgagtcctaattcagaaccactaatgtgcattttcaagtattgcaacttatttcattgttttgttttaaattgatctcgtttttaagtgttcacacttcaacttttaaataactggaacaacagaggccaggttgcatttctgtatgtaccttttgacattcacaaaaactgtcagttgcttcataatgtcttttaacctgctcagtaatattgtaataattttttatttgtgatctgagcttttttagcactgctttggcatactgctaatcatctcccttttctgcctttatgtgataattctaaatttaccattcccttcaagtttcctgttctctcaagaccctatcccccatactaaagagatgacattgcctttttaattcacagagaagggctaggcgcggtggctcacacctgtaatcccagcactttgggaggctgaggcgggtggatcatgaggtcaggagattgagaccatcctggggaacacggtgaaaccccgtctttactaaaaatacaaaaaattagccggtcgtggtggcacacgcctgtaatcccagctactcgggaggctgaggcaggagaaacgcttgaatccaggtgggagaggttggagtgagctaagatcgcgccactgcactacagcctgaatgacagagcaagactccgtctcaaaaaaaaaaaaaaaaaaattcacagagaaaataaatgccatgtaatatgaacagccctaacatcctcttgcatagtctcattggtctgttcctttacatgtccttttgactttgttctatcttagaggaaggacttttcttccttgtgtgtaagatgaatctttctgctgtgctctttatcccatatcttctttgagttcttgcaccatcatgtattctttcttgggtatgtttaatttcttggtgtcttcaggttcctctccattgcctgtaacagtgctcggatctcttccaccttagagtcacttttctttcatagggcttcacgtgaacttggagttgctgttctcactttccttcttttgctcagtccttcattgtcttctggatttccgttatattctaatgaaactaatgttcctgaagtcattcagtagtaacagtcatgatagtattcatgtaagaatagttaatatttaagccccatttgtatgctcagtactattcttagtagcttacatggattatctcatttaattctcacaacaaccctatgaggtaggaaactatatgaggcgaaatattgtgaggttaagagctttgaataccagttgcctgggtttgagtcctacttatactgcttaactagctgtggtactttaggtaagttatttgacgttgtttatagtttccttatctataagttgggaataatacctgcctacttacctcgaagggaaactgaaacataaagaggttaagtaacctacagatttgcaccatttagattacaactcaaacagctctgttaaccacttttcctctttattccatgctgttggtaaccacattgataaaagcaggttaatggctaagtaattttcactttttctgaccttcctgtagcagtctgtggtatttcccttagtgcacctgtagtcccagctactcaggaggctgaggcaggagaatcgcttgaacccaggaggcggaggttgcagtgagctgatatcgcgctactgcactccagcctggtgacagagcaagactctgtctcaagaaaaaaacaactctgttttctgaatgtttccttgtaccaggaacttgcacccatggtgacaactacgatttatttcattgttttcctatttgtgcccacttcctaaatactgtgttttgaggtttgatgcttccttccgttccctcttctttttcctttaggactagaattttaggttatattttctaaagtctctaggctagaccactctttaaatttccagattcttgatttcaacttcttcaatgtcctataggtaccttaaactcaatttttgtgaatatgtcacctctgattaagataccttttttttttgtctcctaatgtggctgaagttctagttataggagtgggaaaaatattggttccccattttctgttcacttgtgcttacattaatacttctgtagtttatttctgtgaaatagtcttttaaagtggttattttttgaaggttagattaccttaaactagatactaactatccctgcatccatttatctaaactgcagtaccttgtgatacactgaaagagaattgcagagtatgagaaataactgtctctctctctcactctctacatcgtggagaccattggtatggtatgggagacatgaaagctgacatacagagtgaagaagccagtgtcagtttatacattgaatattggtaaatatttcttccttgtttaggtgaaaaacgaatgtaaatagaattatttgcatgttttcctgtgtcctagtgggttgttttatacaccctctgggaaatgcataatcaactttcaatattagtagtctataggataaaggttaaactgctcactatggcatacaagtccctgtacagttttgttttacttttgtttccggctacttttcacttctgtggccattcctcttctcataccatatcttgcagcttcatttagttatagtattcatacctcctttgtttacattgttttgttagtctgaaatgttctttttacctcttcatgcaaaattcttcctgtcctttgtgaagcagcatacatattacctttttcggggagttttcctgagaatgtagtgtagtacagtggaataaataacatagggtgtagtctttgattaatggagatgtttgtctgaattttaattttggctcacttcctgaaacctctcttgctttgggcaaactactttgctgtgcttcatttccctatctgcaaaattggcataataatactatcaattttatgagttattaggaagattattttaatgagatatacatgtgaagtacctggccatagtgagttctttataaatgacatccactctaattctaagatgcaatttgtaaaatattttcattttatcgtcaagatatatatatttaaagcaattcttatatcatctacacaaagctgtaagtaaattgatagtgcagttgaggaaatatcttggtggttgcctttttttgtgctcttactatttgtacatacctgtcttagcattttatttatatagatactattttgtatcttactgtgttagactgttcttgcagttgctgtaaagaaatgcctaagactgagtaatttattaaaaaaaagacgtttaatagactcatggttctgcaggcaacacaaggatagcattggcatctgttaggtcttctgggaggcctcagggagcttttacttacagggcaagatgaagcggagggagcttttacttacggggcaagatgaagtaggagcaggcacttcacgtggcaagaacagtagcacgagagggttggggggaagtgccacacactttcaaacaaccagatctcacgaaaactcactatcttgaggctagcaccaggccatgagggatctgctcccatgacccaattacctcccactagacaccatgtcacacattggggattacatttcaacataagatttcaggggatatatatccaaaccatatcacttatccagcatatcacctggcccatagtaaactgtagatgttgcttgaaagtgtaaatgagtttacttatttcttggactatcataagagagtcttcatcaggctttgatttttttctcccctggtaatatgaaatttaacattttttaacatttaaatatggagtcactggatttgcattgtgttcttcaggactgtatcaactcttttgttagcttaacttggttaatacttaaagtataaaaataattcccatgtttaaacgttaaatacaaatggagattctgcttttattttgcaagaacgtttattgaagatgaccttagaagagagacgcaaagaatacctaagagactatattcccctgaacagcattctatcatggaaggaggagatgaagggcaagggccaaaatgatggtaagtttctcggaacattttttaggtagatatttttcccattttaggacaattgttgacagaaatgaataactggcgttcaataaagagattactattttgctatttgaaattattgtttggttgtgatttaattgtttttagtaacctacggtgttttttaaacttaggaaagtatattaacataatttgtgttctgaaatataccacatttataatatggtactttttttacaggtccttttttattttttctattctgtaacagttcttggagcaaatgctattagagatttgctgctttggtggtgtggccctttgagtttgctttaagttcatttataatcgattatcttatgttatttttaggattggggatacagctgaaagagagagtatattaggaaaaatagaaaaaccaaagaacatttctcattattttagagaatatattttgtatgatgtgttattatgtctgtatgtaaagtatttgtatgacagaatttactctcaaagtctttatgatttggtgggaatctagattatgttagaatataaaggaagttttaaggattaaaaaggtacgtgaaaaagtttctaaaaacaacataatagatttaatggatgtttaatatgcttgtctttgaattaacactcgttggtattaatgatctggatgtgaagtttagacaaacggtgcttcttaaggtgcttaacagttgagaaagactttatgaaatggacttgaaacatgctaatttcaaaggttgtggtcttagatcgatggaactacaccgggtactatgggcccagaataaagactagcatggaattcctatggataaaatctgaagggaaagattaggccttggtgtctgtgaagagaacacattgacctgaggatttgggttttagacacaactttgtttttctagaaaggcaaagcatgtgggattagcagtgaaaagctgtgggttcttttagaccttacgtagcctggaaacgtgtgaccttgggcaagcggggtagcagctctaccccacgttctaatggggtcattggacaagctgattgggatgtgcacatctgacctgtctgcccagtgtcttctgtaaatgcaagttgttttaagaatggtctgattccaaactgataagattggccttaagaagcccctgcctgatcacgtgagcatcatggaacccaaagatgatttgctgcccaccaccccgtctcagaacagaagggtgggaagccagagccacctgcattgccctagccagtccccacagtgtaacagggtctccttggcagctgtattctggagtctggttgttgctctgtaaagacctttaataaaatcttgtacaaaggttaaaaaaaaaaaaggtctggttaagacatcattgaaagagaggagagtgctgtgtaatgaaaagaatacagggctagaaatcaggagaacagaattctggtcctctgtcttacctaaggctatgtgcctcttcatgtttgagtctcagtaatttctttttttgtttataagcaactggtattgaatatttcagcagcagcactatcttcttcttttttttaaatggctacaggtcgagtatcccttatccaaaatgcacaggaccagaagtgtttggggttttggattgtttggattatacttgctggttcagcattcctaatccaaaatccaaaatgttccagtgagcatttcctttgagcattatgttggtgctcaaaaagtttcagattttggagcatttgggattttgaatttttgcattaggactactcaacctgtagtaaatgttccccaaattagaaaagaatacattgaatagaataacacctaacatagttatcctctaacaagatattgcatgtttaatcctgcctcccaatatgagctttataagtggttacaactgctctgtgtgtttcttattttcccccttatgctgttttaaacttgaaagtcctccatggggaacaaggtgatgtgatcaaaattatatttctatttttcctgaaatgttacttgcttctctctgttgtgacccagactctggtgaatggcctcttcctttttcatgaagtggaatggctcattttacaagtaatatttgtaaatatttatatacaatacacatttttcatatgactttttcttgtgttacctattcagtgctcagttattaaaaaatattagtcaagagagttttagtgttttaacagtttaaaaatcctttaaaaatataaatttacaaaaaataataaaggaaaactatacatatggttatatttgaaacgttttaagtcattgcttatacatgtataagtaggtattgatatttattaaatatgggattttaaactaagtattaaaagaattctataattccttgtcacttagtttctaattataggaaatgaacaatatttatcgggttagaacagtatatcagttttaaatttaatatcttatcattacttacgtttttatagaggaccatttttgcctaaatattcctgagtacttgaatagttcttgagctattgcttttaatttttttcttgctttgttcagatttattttactttaaccaaatgcttcttgttattataatacaatagaaagttaaataaaaaagaggggagcagccaaatatatttgtaacaatttggattttaagccttcttgaaacaaaaggaaacaaaatattgccaaggaacacaaaatcagtgtttatatggaaagggggaagcaagttttattttgacttacccctttggtaatattggaaagccatggattggaagaggaaagaatgggagatgattaccaaaaaataaaaataaaaaaacccaaaaaacaaaaaccccatccagaaaaacccattaaatacataatttgcttgctgtttatgttcatatttattaactgttgttagctaatttctagacttacatatttctaattcttcctctgtgttaccaattatgtaataattcaatatcatttgtcagttgctatgttgtggggattttaaaattcttgtctctcctattgtactgtctctagcacctggaatggtgccttatgggttggtggggcttaatcgtaagttaaataagaatgcctgaagagttaataatctacaagggacaattctttctccaaacttttttttttttttgagactgagtctcacttactttgtgccccgggctggagtgcagtggcgcgatgtgggctcactacaacctccacctcctggcttcaagcaattctcctgctgagctcctgagtagctgggattatagatgcgtgccaccacgcctgactaatttttgtattttttgtggagatgggctttcactgtgttggccaggctggtcttgaactcctgacctcaagtgatctgcccatgttggcctcctaaggtgctgggattacagacgtgagccactgcacctgcctctttttccaaacttttaatgagcatttataaatatatgtaaagctagaatacagtcatgtgccacaaaatgatgttttggtcattgacatcctgcatatatgatggtggtcccataagattataatactgtatttttactatgccttttctgtgtttacgtaggtttaaatacacaatgacttaccattgtgttatagttgcctacagtattctgtacagtaacatgctgtatgggttttagcctaggagcaattggctgtaccatataatctaggtgtgtatagactgtgtaccatctagatttttgtagtataccttacaatgtttgcacagcaatgaaatcacctaacaacgcctttctcagaacgtattccattgttaagcaatgcctgactgtagcaatgcatccattacccagtttcaacagttattacacggccaattttatttcatctataccagtgctccctataccttccccccagactattttgaatgaaatcacatatgtcatataaattttatctataaatgagtatctgtgtatatgcatatgtatgtatctctaaaagatggcatatttttgttgttttactaaaatactattattacctctcacatttaaaatttaacttaaaatttaattttgatataattaaatatccacttagtattcatgtttttcccattgtctcataaaggattttttcttttacaattgatttgcttgaatcaagatctaatcaaggtccatatattgcatttaattgatttgttccttaagtcacttttaatctatagttacctttctctgtccttttttccttcctcccttataatttatttgttgaatacactaggctgtcctgcagaattttttatattttgaattttgcttactgcatctctgtggtatcattgaacatgttcctctgtcccctttatttcttatgagttggtagttaaatccagaggtttgttcagagtggggtttaaatttttttgaaataatgctttatagattattgtacatctttttgcatcatatcacagggcacataatgcgtcattgtctccctcagtagtgataagattgatccctgggttcatgtattgtcagctgaatattgtcactaaactgtctggtgtaaagttctctgacaaccttttacctaatggttttagcagccattcgtgattattgcttagatccattacgttattaggggttgcaaaatagtggtatgtgaattttatcattccttatttatttgtcagacttctataaagaggaactttctgttattaagtcttttattatgcagtacggtttataaaggaaagcagaataaatgccatatttcccttatttactgattttcagattgagttcattccctaaaatcctccacaggtgaccaaagagtcctttttttaaaatttttgactatcattttcaatttgccccttccttctctcctcttctctgtctcttcctccctcttcctccctctcaacatgtatattaaatgagaatgtcccagtggttaacagtctacaaaggaggcatatacgtgtgtgtttgtgcatgcgcgtgcatgtatttatagctcccatataaaatacatagaattactaaacaataggcccaggatatggtagaaagacaaaggtagatatataaatgggtggatgggtagatatgatagaaagatggcattacttctttgttgagacaagagttctagttcttgggtttaatagttatgccttctgttaatctcctttcctactactgtgttaaggctccactagaataccacctagagaagcaatgttattgttacactttttggatggagtagtgttggcagagactctgccaggcttatgctaattttctctgactggttagtatcagggaaagcagctatggctataagtttagattgtctttttgagtaattacttttaatgtttatacagaacagcaataggggaaaaataaaataataatgaggatgagttaggtgaaaattataaaattatcttatactcaagtataaaatatttttaaaaattggtcatttaaagagccatctatgataataccatactgaatgggcaaaagctggaagcattccccttgaaaacgaacacaagacaaagatggcctctctcaccactcctattcaagatagtgttgggagttctgggcagggtaatcaggcaagagaatgaggtaaagcgtattcagctagaaagagaggaagtcaaactatttttgtttgtagatgacatgatcctacacgtagaaaaccccatcatctcagcccagtagcttttcaagctgataagcaacttcagcaaagtctcaggatacaaaataaatgcatacaaatctctagcattgctatacaccaaaaacaggcaggccgggaggcaagtcacaaatgagctctcattcacagttgccacaaaaagaataaaatacttaggaatgtggctaacaagggaagtgaaggatctcttcaaggagacctacaaaccactgctcaaggaaatcagagaggacacaaacagagaaacgttccgtgctcatagataggaagaatcaatattacaaaaatggtcatactgcccaaagcagggtatagattcagtactattcctattaaactactatcaacattcttcacagaattagaaaaaactactttaaaattcatatggaaccaaaaaagagcccaaatagccaagacagtcctaagcaaaaagaacaaagctagaggcatcacgctacctgacttcaaactatactacaaggccaaagtaaccaaaatggcatgggactggtacaagaacagacatagaccagtggaacagaatagaaaacccagaaataagtctgcacacctacaaccatgtgatctccgacaaacctggagatcacaaacaagcaatggagaaaggattctctatttaataaatggtgctgggaaaactgcctagtcatatgcagaaaattgaaactggaccccttccttacaccttatacacagattaactcaagatggattaaagattttaatgtaaaaccccaaactaaaaatcctggaagacaacatacgcagtaccattcaggatctaggcatgggcaaagatttcatgtgaagatgccaaaaacaattgcaacaaaagcaaaaattgacaaatgggatttaattacactagagtttctgcacagccaaagaaactctcagcatgaacagagaacctacagaatgggagaaaatttttataatctatccatctgacaaaggtcttatatccagcatctataaggaacttaaatttacaagaaaaaaccaaacaaccccattaaaaatagacaaaggacatgaacaggcacttctcaaaagaagacatacatgtggccaacaaacatatgacaaaaagctcaacattactcatcactaatgagtaatgatgcaaatgcaaatcaaaaccacaatgtgataccaactcacaccagtctgaatggctatcattaaaaagtcaaagaacaacagatgctggcgaggttatagaggaacactgatacactgttggtgggaatgtaaattagctcaaccattgtggaagacagtatgacaatgccttaaagacatagaggtaaaaataccgtttgacccagcaatcctattactgggtgtatacacccaaatgaatataaatcattctattataaagataataaaagaaggcgtatgttcattacagcactgttcacaatggcaaagacatagactcaacctaaatgcccaccaatgatagactggataaagaaaatgtggtacatatacaccatgcaatactatgcagccataaaaaggaacaacatcatgtcctttgcagggacccggatggagctggaagccattatgctcgacaaactctaacgcagtaacagaaaaccaaataccacatgttctcacttttatgtgggagcagaatgatgagaacacatggacacattgtggggagtaacacacactgggcctgtcagaaggtaaggatgggaggagtgagagcatcaggaagaatagctaatggatgctgggctcaatacttaggtgatgggttgatctgtgtagctggccactacggcacacgtttatttgtctaacaaagctgtgtgtcttgcacatgcacccctgaacttaaatgaaagttggaaattaaaaaaaaatttggtcatttagaaagactttatatttcatatttttatacatgtttatctgtattacatactataataaaggaagctagagaaaaagtgctattaagatcataagagaaaatctacttactgtttattaagtggaagtgggtcatcacaaaagtcttcatcttcattgtcttaacattgaataggcttaggaggatggggggctggttggtcctgctgtctcaggggtggcaaaggcagaaaaggtagagggaaggtagagggggaggcaggcatgcgtgatgcagcttcacagaaatacattgtaatttctgtctgacttttttgccttttcatttctctaaaaatgtatggtaccaatgctttaatcttttttccagtgcttagtttcagtgcctatgtcatagaaggttctatgtcataaatcaaaaacagtcttgaataataggaacccttctgccagattgtctaatgtcagtttgttttctggcactgcatctggtatgtcttctttctcattgtctggcactggtttggaagcactcatctccatcaagttttcttctgttaattcctctggtgacctggtgtttgttagctcttgaatttctccaggatctgcatcttgaaacccttcaccccctaccctttttgccatattcccagtctctttcatgatttccttgattgactgtgtcataaattctgtgaagccatgtgcaacatctggacaaagttttctccagcatgaatattgttttgggcttgatggttttcatggctttttctataacagcagtggaattttcagtggtgtaattcttccaaactttcatgatgttctatcagggttctctttcatagcattcacagtcttttccatagaatactgtgtgtagtgctgcttaaaggtccttatgaccccctgatatagaagctgaattatagatactgtgtttgggggcaagtagaccactttgatatttgtggtgttgaactcatggggttctgggtggccaggggcattgtacaacctcaaaataactttaaaaggcagtcccttactggcaaggtgcttcctgataggagcacagcgtctcattatctaggcctttcttgtacaaccaaaagactggcagctggtgtttatctttttccttcaaggtttggaggttagcagccttataaatgagggcaactttgatcataaacctgactgtatttgcgtaaaacagcctgtcccttcctgttttaaatcctggtgcttgcatctcttccttaataatgaatgtcttttgtggcatttcccccccttcagaatagagcacttttgtctgcgttaaaaagcctgttcaagtagatattctttctcttcgatttttttttttttgtaagacggagtcttgcttctgtcacccaggctggagtgcagtggcccgatctcggctcactgcaagctctgcctcccgggttcatgccattctcctgcctcagcctcccgactagctgggactccaggcgcccgccaccacacctggctaagtttttgtattttttagtagagacagggtttcaccgtgttagccaggatggtcttgatctcctgacctcgtgatctgcctacctcggcctcccaaagtgctgagattacaggcctgagccaccgcgcctggcctcccctatgattttcttaatggcatctgggaatttgccttctgcctcttggtcaacagtagctttttctactattattgcgacttttctttttttttaaaggcagagtctcgctctgtcgcccaggctggggtacagtggcatgatcttagctcactgcaaccttcgcctcccaagttcaagtgattcttgtacctcagctacccagttagctggggttataggcatgtacccccgcccagctaaattttgtatttttagtagagatggggtttcgccacgttggccaggctggtctggaactcctggcctcaagtgatccaccctcctctgcgtcccaaagtgctgggattacaggtgtgagccaccgtactcagggtgtgacatattttaagacagacttctttataacacatatcaaaccatcctttgctggcattaaattcttcagctttagatcctcatcttccttaatgctttaagttgtcatataatgactttgctttttctcaggtcctattagtctataggtatgctcattcttctagcaatcctgcactcacataaaagctgcatttttagtatgagattatcagtatgagattaaaagatattatgcaaaaactgcaaggttttcggacctgcgggcatagctgtagtgatgcaaattttctttcctttttttaataatgactcttaggctggattcatgtatcttaaatggtgagggattgcagctgcagacctaaatatcaagcacttcagctttttcttttaacgtcatgacttttctctgcttcttgggagtacttccagcattattaatggcactttgtgtgggtctgtgatgttattcaggtttatggtattgcactaaacatgataaaaaatatgtgacaactgcaagagatccacttttttactgtgatatgcaatttattggagagacagactgtttacgcagaggtgttcagcctcacacagcattttaagtggatacttgaaatacttgaggtcaccgcaatagcaatagaaggtggctaagaaatattacagtagtacagtatgtactgtggttaattttgtgcagttgtgatttagtactgcctctttacctttgtttacctttctcttgactgaatggcgccatgtatgatctataagtgtgtgcataagttttgataaattttcatttttgtaatagatttgggtatattttatggtagtaaatgatgaaatagactagtgtctacatgtattttaagcattcatgacatactttttcttaattttcatatttctagactatgtggtttgtctgccagtttttttttcaaattgttgcaagtctctaaaaaatgttccaatatatttattgaaagaatcaatgtataagtggacctgtgctgttcaaacctgtgttgttcaagggtcaactgtactttctttttttttttttttttgagacgaagtctctctctgtcgcccaggctggagtgcagtggtgccatcttggctcactgcaagctccgcctcccaggttcatgccatactcctgcctcagcctcccgagtagctaggactacaggtgcccgccaccatgcccggctaattttttgtatttttagtagagacggggtttcaccgtgttagccaggatgatctctatctcctgacctcgtgatctgcccacctcggcctcccaaagtgctgggattacaggcgttagccaccgtgcccagctggctcaactgtactttcctaagattattttgacaacacatcaatttcattgtgtattgcagtgtgtaccattaagtattatgtaaattgtccttatattaagctttttttttttttttttttttttgagacggagtttcgctcttgttgcccaggctggagtgccatggcacttgaccttgtctcactgcaacctccgcctcctgggttccagcagttctcctgcctcagcctcccgagtcgctggggttacaggcgcctgccatcacgcccagctaattttttatattttagtagagatgggtttcacgatgttggccaggctggtctcgacctcaggtgatccacctgcctcaggctcccaaggaagcttgtttttaaaaatattgtaaaaacaaaacccccaaatctttcattttttgatatatataaacatgactttgtgttgacacaagatggaaaattctttctttatatttcttaagtctgtaacttcatcacatagtctactagttttctttttaacatattaaatgaattatgttagtaaataaggattttccttaaatacattttggtcagcgtgaacagatattttgacatgggttacagattggtggtagccagagacgacaacttttcctttcttgctcccccctcccccccacccccaataatttttgcataggagagagtcttcttaatgtcttctttcagatgtattcatttagtttatttttaagttgacagagaaattgtatttcataatgtttttgtcttttctgaaatatttagttactgaattttcatcaacgtgtttaaaacaagaatttaagtatagcttattgatttatctaagcctttgatttggaaccaggttgaggattgccgatgaaataagtaagaaaatatcgtgccagggcaatgaaaacctatgaagatttttgagcaggagagctacagaaacttcaatacgatgagaataaattggcaacagttcatacaataatttagagggtatgcagtttccaccccttaatatcgtttttgcttctccagagttaattcacttgccattttttcctcctgcagatatatctgttcttctttcatagcttttctgtgttcacttatcataccagttcctcatttaattttctctgtttccttcaataaccgaatacatctgttctttcttgattaatctttacttgcttttctttctgtttttttgttttgttttgtttttttagatagggtcttgctgttgcccaggctggagtgcaatggtgcaatcatggctcactggaaccttgacctcctgggctcaatcaattctcctacctcagcctcctgagtagttgggactacaggtgcacacaaccatgcccagcaaatttttttttttttttttttgtagaggtggggttttaccatgttgcacaggctagtctcgaactcctgggctcaagcaattggccattcaaagtgctggtattacaagtgtgagccactgtgcccagccccttttcttgagttctcttgtttcccaatctactcttgtaaatttaagctttttaattatggtaaaatatacataacatagaatttgccatttttactatttttaaatgttcagtttagtgacattgagtacattcacagtgctgtgcgacaatcaccagtatccattttcacaattttttcatattcccagatagaaactttgagctgggtacagtggcttgctcctgtaatcccagctactcaggaggctgaagcaggaggatagcttgaggctagaagtttgagaccagccttggcaacatagtgagacttcatctctaaaatgaacattcaaaaaaaactggtggtgtgcacttgttgtcccacctattcaggaggctgaagtaggaggattgcttgaacccaggagtttgaggctgcgatgagctgtgatttgcactactgtactccagcctgggcaacagagtagacctcctctcttaaaatgaaatgaaagaaactttgtaaactttgtacccattaaacaatatctacactatacagtcttccttctcacctgtcccctcttattcttgactgtctctataaatttgccagttgtagatacaatcatgtaagtggaatcataacatgtttatctttcatgtctagcttatttcacttagcataatgctttctggattcctccatgttgtagtatgtgtaagaattttattatttttaaggccgaatattattacactgtatgtgtatagcacattctgtttatccatttaactgttggatatttgggttgtttccacctttatcaactgtgaataatgctgctatgaatattggtttagaagtatctttttaagtccctgttttcaattattttgggtattaactaagagtggaattgctagatcacatggtaattctacttaactttttgaggagacacaaaacttttctgtagtggctatagtattttacattccaaccgccagtgctattcccaccaccaatgcacaggggttccagtttctccatgttcttggccattatttattttctgttttggttttggttgtttgtgcttttgatgagcatctttatagatgcttattggccatgtgtatttctttggagaagtatctattcaaatcctttgtccattgttgagttggatttccttgttgtaggaattcctttgtatgttctggatattaattccttatcagatatattatttgcaggtgttttctcacactttgtgggtcgtcttttcactctcttaatagtgtcctttgattgaaaagtttttaattttgatgaagtccagtttatctgttttttctctggttgattgcttttggtgtatattctagaagacattgttaaatccaatgtttcataaattttctcttgttttcttctaagggtctcattgatttagcttttgcttggtctttgatccattttgtattaagttttgtatatggtataaagatcctttttgcatgttgatacccagttttccagtatttgctgttgaaaagacttgtcttttcaagacatttgaatggtcttggcactcgtgttgaaaatcaatttgaaaaaaacattctattgatttgtaaatctcttgtaatccagaaccacattattttgattaatgtagctttgtagtaagttttgaaatcaggaagtgtgagtcttccaactttttctttttgaagattgcatagctgtttggtgtcccttgagattccaaatgaattttaggattttttttccccacaaaaaatactgttgggatgccgattatattgaatctgtagatcattttgggtagtgttgtcatcttcacaatatttagagttccaatccatgaacatgcgatgtctttctacttacttatgttttctttaacttcttttagcactgttttgtagttttcagtgaataatctttcacatccttggttaagtatattactaattattttattctttgtgatgctattgtaaattgaattgttttcttaattttcttatcaatgttcattgcaagtgtacagaaatgaaactgattttcatgtattgattttgtatcctgcagctttgatgtattcaagctaacaatttttcgggttttctgcatttacgatcatgtcatctgtgaacagagatagttttacatcttcctttctagtttgaatgtcttttatttctttttcttgcctgattactctggctaaaacttccaatattatgttggctagaataagtgaaagtggacatcattattttgtttctgatcttaaggaaaatgctttcagtctttcaccactgagtattgagtattgtgttacctgtggatttttcatatgtctccattatgttcaagttattcataggttattgagggtttttatcatgggagggtgttgaattttgtaaaatgcattttctatataagtttagatgatcatgtagttcacatccttcattcttcatgttggagtattacattgattatattgaaccatccttgtattctgggagtaaatcacacttggtcacgttgtgtattccttttaagatgctgctgaattcagtttgctagtattgaggatttttttcattgtgattcataaaggatattggtctggttttcttgtatctttttctgcctttgttatcagggtaatgctggctataaggatgaattaggaagtattctcttttctttaaatttctggaagagtttgagaggattggtgttaattcttccttagatgtttcagtagaattcatcagtcaagctatgtggtcttggactttttggttgttgttggaagcttttggttacttattcagtctccttactaattataggtctattgaagttttctatttctttgtcagtttgggtagattgtgtgcttctgtgaatatattcattttatctaggtgatccaactttttggcatatcatttttcattgtattctcataattatttctgtagaatcaatagtaatgtcctcactttaatttctgatcatagtaatttgtgtactctttcttattttcttaatcaatacagctaaaggtttgtcaatattgttgatctttttaaagaactaaaattttgttttgttgatttcctttattttttttttctgttttatttatcaccactcttatttttagtatttccttccttctggtagctttgggtttagtttgttcttaagttccttaggtgtaaagttacgctgttgaaatgagatcttcttatttaatgtatgcatttatagctctaaattttctcttagcactgttttcactgcatgctctaagttttgatatgttgtctctatctcaatgaattttctgattcctttccccatttttcaggagtatgttgcctaatttccacatatcttttagttttccttctgttattgatttttatctcttaagttatttcttctttcagctaaattctgcttttgaaccctcccatgaatttttcattttggttattctttttagctccagagtttctggttggttcttttctcttcgttggtctcattcagtttatacattgttttcctaattttcttctaaagatgattgttttaaagtcttctgttaatgtcactcatctcatctgggtcaccggaattgtcattgagcagtgggcttgctgcccagtgtgcatagaagcaaatattatggcaccagcctttgataaaagaaaaagctttattgcaaggttgactagcaaggagagaggaggcagtgctcgaatctgtctccttaagctagggtctggggacaggttttataggcagagtgactatgaggggagacaggaaaatacaatgaggcatgatctcattgggctgttcaggaggtagtgcagggaccttgacccttaaattaactctgcagcaaaacagggcactccttgcttcttaatttgctctgccctgggttcagttactgaggttctgtaactgaccagagggttcctgttgcctgctgcccagatagagcctatttatcaagacaagggaattgcaatagagacagagtgtaatacacgtagagctggctaaataggagactggagttttactattactcaaattagcctctccataaatttggagcgtagtgtttgtttgttttgagatggagttttgctctgttgcccaggttggagtgccgtggcgcaatcttggcttactgcaacctctgcctcctgggttcaagcgtttctcctgtctcagccttctgaggagctgggaccaggcacgtgccaccatgcccggctaattttttgtatattgttttagtagagatggggtttcactgtgttagccaagatggtcttgatctcctgactttgtgatccgcccacctcagcctcccaaagtgctgggattacagttgtgagccactgcgcctagctgggtagtgtttttttgaaagtagtttggtgggcagggagctagggaatgggtgctgctgattggttcgggatgaaatataggggtgtggaaaatggtcctcatgtgctgagtctgccacaggaccattgaatcatgagtcttggatctgggtggagccatcttgttgtgagaaatgcaaaagtctgaaaagacatttgcaatccgaaaaggccaatcttaggttctacaatagtgatgttacttataggagtaattggggaagttgcaaatcttgtatcctccgaataatggctggtaattgtttaactatacctacatcttagcagaattcatgcctctgtcatccttctaacctggtggatggccttttattagttttacaagtggtttaggtttggggaggctattatcatttaaactgtaaactaaatttctttcaaaattagctcgggccatgcctaggaatgaccaagggcagtttggaggttaaactagaggtaaatttggctcctggatacaccaatcaggcatgctggattaatctgcacatgctcaggctttgtgatttgcaatctgggatgtagattgcagtttgtgattacagaaagcccattgtcagccgggcgcggtggctcatgcctgtaatcccagcactttgggaggccgaggcaggcgtatcacctgaggttgggagttcaagaccagcctgaccaatacggagaaaccccgtccctactaaaaatacagaaattagccagtcgtggtggcacatgcctgtaatcccagctactcgagaggctgaggcaggggaatcacttgaacctgggaggtggtggctgcagtgagccgagatcgcacccttgcactccagcctgggcaacaagagtgaaactccatctcaaaaaaaataaaattaaatttaaaaagtccataagtccattgtctgggcttgtttgtcatcttaattgttcctttgaatgggccattgttttctcttttgttgaaaatcagacatttgactattatgtggtaactctgggaatcagatttctcccttcttctgggtttgttgtttttcgttttatttattgattgattgagtacttgttgaaggctgtagtagtccatttgtcctgagactttccaaacaatttttgcaaagactagtccttgttgtgtgtgattattgaattctgttcctttagtgtgtgttcagcttaagttacagagatttcctcaggagttctcccagtttttgcagttagctctgtgatgggttactctttcatctcttaagtaggcttcttttgaacatagggatcatcttcttaggtattttctgagcatgaatcttgcttggtcatgtacgtgactttctaaattcccctgtatacacaactgcttttgaatattcttttttttttttttttttttgagatggagtcttgctctgttgcccaggctggagtgcagtggcgccatctcggctcactgcaagctccgcctcccaggttcacaccattctcctgcctcagcctcccgagtagctgggactacaggcgcccaccaccatgcccagctaattttttgtatttttagtagagacgcggtttcaccgtgttagccaggatgctctcgatctcttgacctcgtgatccgcctaccttcgcctcccaaagtgctgggattacaggcgtgagccaccacgcccagagcttttgaatattcttatttcccaaagagcctcaccttatcttctctttagggccttacctagtcttttgtattgtcccaggggtctgtgagtctgtagcggccttggaactttaagagcagggcctgctgctctttttcacctgagttttgtgttaggctaaatagaaatgaaagtcttactcaggcctttaggtatcccccagaagggttagaactacaaagctacagaactttcctgctctttgactgttttccagcacttcaacaaagtttgttcaggcagtttctctttgttttttgatgtttctctgtggggaacaaaacctcagagcttcctatttcactattttccttgaacttaataatttataatgtgaaaagcaactgtgttaagtttggctagaactaggtgatataacaaaccctcaagttaagtggcttaacccaataaagtttatttctagtttacctgacagtccagagtgggtatacatgattagtatcagtgaagaggtggtagaggtataggagtgtttgtgtgttggggctgggggacattctgcttcacgtagtctttcagagacagagttgaatgtctttaacatgttgccctggagaaccttagggggaaggggaaagggaaggactgagttggaggctgttatgagctagacttggaagtacaatggtacacctgttttgacttacatgtcttgggctagatctcagtcatacggccatatttaattgaaagagaggctgagaaatgtaaagtagttatatgttataggaagaggatggaactggaaagtgattttggcgaatagctagtaatttaacccatatcaattgcacacagaacttcctcgagcttccatgttctgttgaagcagctgtaagatacacattttatattccattgaggaggaatgaaaagagaaagcattgccaattaaactattacacagtgctttcttagaataaagtattatttctttcaataaatgcaaatataaaactcagtaaatataaaaattattttacatttactcagttttatcatgtatcatctttgaacatacgttgaaagtataagtgaaataaattgattaaattattcctaaaatgtctttgtactcagagcccaattcttttttttttttttttaattatactttaagttctgggatacgtgtgcagaacatgcagttttgttacagaggtatacatgtgccatggtttgctgcacccatcaacccgtcatctacattaggtatttctcctaatgctatctttcccgtagccctcccccacccaccgacaggccctgatgtgtgatgttcccctccctgtgtccacgtgttctcatttttcaacttccacttatgagtgagaacatgtggtggttggttttctgttcctgtgttagtttgccgagattgatggtttccagcttcatccatgtcccggcaaaagagatgaactcattcttttttatggctgcatcatattccatactgtatatgtgccacattttctttatccactctgtcgttgatgggcatttgggttggttccaatattgtgactagtgctgcaataaacctatgtgtgcatgtgtctttatagtagaatgacttataatcctttggtatatacccagtaatgggattgctgggccaaatgatatttctggttctagatccttgaggaatcgccacactgtcttccacaatgtaaaagtcttcctatttctccatgtcctctccagcatctgttgtttcctgactttttaatgatcaccattctaactggcgtgagatagtatctcattgtggttttgatttgcatttctctagtgaccagtgatgatgagctttttttcatatgtatgttggctgcataaatgtcttctttggagaagtgtctgttcatatccttcgccctttttgatggggttgtttctttcttgtaaatttgtttaagttccttgtagattctggatattagccctttgtcagatggatagattgaaataattgtttcccattctgtaggttgtctgttcactctgatgatagttgcttttactgtgcagaagttctttagtttaattagatcccatctgtcaattttggcttttgttgccattgctttttatgttttagttatgaagcctttgcccatgcctatgtcctgaatggtattcttctaggttttattctagggtttttatggttttaggtcttacatttaagtctttaatctatcttgagttaatttctgtataaggtgtaaggaaggggtccagtttcagttttctgcatatggcttgccagttttcccaacactgtttattaaatagggaatcctttccccattgcttgtttagtcaggtttgtcaaagatcagatggctgtagatgtgtggcattatttctgagccctctgttctgtattattggtctatatatctgttttagcaccagtatcatgctgttttggttactgtagccttctagtatagtttgaagtcaggtagtatgatgcctccagctttgttctttttgcttaggattgtcttggctatgcgggctgttttttgattccatatgaaatttaaagtagttttttccaattctgtgaagaaagtcagtggtagcttgatggggatggtattgaatctataaattactttgggtagtatggccattttcacgatactgattcttcctatccatgagcgtggaatgtttttccatttgtttgtgtcctctcttatttccttgagcagtggtttgtagttttccctgaagaggtccttcacatcccttgtaagttgtattcctaggtattttattctctttgtagcagttgtgaatggaagttcactcatgatttggctattattggtgtataggaatgcttgtgatttttgcacattgattttgtattctgagactttgctgaagttgcttatcagctttaggaaatttgggggctgagatgatggggttttctaaatgtacaatcatgtcatctgcaaacagagacaatttgacttcctctcttcctatttgaataccctttatttctttcttttgcgtgattgccctggccagaactttcaatactatgttgaataggagtggtgagagagggcatccttgtcttgtgctggttttcaaaatgcttccagcttttgcccattcagtatgatattggctgtgggtttgtcataaatagctcttactattttgagatacattccatcagtacctagcttattgagagtttttagcatgaagtggtgttaaattttctgtatctattaagataatcatgtggtttttgttgttggttctgtttatgtgatggattatgtttattgatttgcatatgttgaaccagccttgcatcacagggatgaagctaacttgatcgtggtggataagctttttgatatgctgctgaattcggttcgccagtactttattgaggattatcacattgatgttcatcagggatattgcctgaaattttctttttttgttgtgtctctgccaggttttggtatcaggatgatgactgtcctcataaaatgagttagggagagtccctctttttctgttgtttggaatagtttctgaaggaatggtaccagctcctctttgtgactctggtagaattcaattgttaattgtctggtcctgggctttttttggttagtaggctattaattactgcctcagtttctgaacttgttatggtttattcagggatttgacttctttctggtttggtcttgggacagtgtatgtgtctaggaatttctccatttcttctagattttctagtttatttgcatagaggtgtttatagtattctgtgatagtagtttgtatttctgtgggatcactggtgatctcccctttatcatttttattgtctgtttgattcttctctcttttcttctttatttgtctgggtagcgttctatctattttgttagtcttcaaaacaccagctcctggattcattgatgttttgacgggtttttcgtgtctgtatctccttcagttctgctctgatcttagttatttctagtcttctgctagcttttgaatttgtttgctcttgcttctctagttctttgattttagatctttcccactttctcctgtgggcatttagtgctataaatttccctctaaacactgctttagctgtgtcccaggtattttggtatgttgtgtctttgttctcattggtttcaaagaagtcatttatttctgccttaattttgttatttacccagtagtcattcaggagcaggttgtttagtttccatgtagttgtgtggttttgagtgaatttcttaatcctgagtgttagtttgattgcactgtggtctgagagactgcttgttatgatttccattcttttgcatttgctgaggagtgttttactttcaattatgcggtcaattttagaataagtgggatgtggtgctgagaagaatgtatattccgtttatttggggtgtagagttctgtagatgtctattaggtccacttggtccagagctgagttcaagccctgaatatccttgttaattttatgtgttgttgatctgtctaatattgacagtggggtgttaaagtctcccactattactgtgtgggagtctaagtctctttataggtctctaagaacttgctttatgaatctgggtgcacctgtattgggttcatatatatttagcatagttagctcttcttgttgcattgatccctttaccattatgtaatgcccttctttgtcttttttgatctttgttggtttaaagtctgttttatcagagactaggattgcaacccctgttttatttttttgctttccatttgctcgttaaatcttcctccatccttttgagtctatgtgtgtctttgcatgtgagatgggtctcctgaatacagcacactgatgagtcttgactctttatccaatttgccagtctgtgtcttttaatcggggcatttagcctgtttacatttaaggttaatattgttatgtgtaaatttgatcctgtcattatgatggtagctggttattttgcctgttaattgatgcagttgcttcatagtgttgatggtctttacaatttggtatgtttttgcagtggttggtaccggtttttccttttccatatttagtgcttccttcaggagttcttgtaaggcaggcctgatggtgataaagtctctcagcatgtgcttgtctgtaaaggattttatttctccttcacttatgaagcttagtttggctggatatgaaattccaggttgaaaattcttttctttaagaacgttgaatattggcccccactctcttctggcttgtagggtttctgcagagagatctgctgttagtctgatgggcttccctttgtgggtaacctgacctttctctctggctccccttaacattttttcattcattacaaccttggtaaatctgacaattatgtgtcttgggacacataataagagcacctgggggaaggggcggctgtgagtgcagctttagcagaagtaaatattcctgcctgctgactctaaagacagcagtggatctcccagcacagcgctcacgctctgctaagggacagactgcctcctcaagtgggtccctgacccttgtgcctcctgactaggtgacacctcccagcaggggtcgacagacacctcatacaggagagtccttttccaagttgttccattctcccttcactttcaggtacaccaatcaaacgtaggtttggtcttttcacatagtcccatattttttggaggctttgttcattccttttcattctttttttctctcatcttgtcatcactctttatttcattaagttgatcttcaatctctgatatcctttcttccgcttgatcgattcggctattgatacttgtatatgcttcacgaagttctcgtgctgtgtttttcagctccatcaggtcatttctgtttttctctaaactggttattctagttagcaattcctctaaccttttttcaagtttcttagcttccttgcattgggttagagcatgcttctttagcttggaggagtttgttattacccaccttctgaagcctacttctgtcaatttgtcaaactcattctctgtcccattttgttcccttgctgacgaggagttgtgatccttgggaggagaagaggcattctggttttcggaattttcagcctttttgcattggtttttcctcatcttcgtgatgtggacgtcctttttgttgatgttgatgctgttcctttctgtttgttaattttccttctaacagtcaggccccactgctgcaggtcagctggagtttcttggaggtccactgcacacccggtttgcctgggtatcaccagcagaggctgcagaacagcaaagattgctgcctgttccttcctctggaagctttgtcccagaagggcacctgccagatgccagccggagctctcctgtatgaggtgtctgtcgaccccggctgggaggtgtcacctagtcaagaggtaaaagggtcagggacccacttgaggaggcagtctgtcccttagcagagtgtgagggctgtgctgggagatccgctgctctctttagagccagcaggcaggaatgtttacttctgctgaagctgcgctcacagccgccccttcccccaggtactctatcccagggagttgggagttttacctgtaagctcctgactggggctgatgcctttctttcagagatgccctgcccagagaggaggaatctagagaggcagtatggctacagcggctctgcggagctgcagtggactccgcctagtttgaagttcctggcgctttgtttacactgtaaggggaaagctgcctcctcaagcctcagtaatggcagctactctccctccccacccgcccaccaagcttgagcatcccaggtccacttcatactgctgtgctggcagcaagaattacaagccagtggatcttagcttgctggaccccgtgggggtgggatctgctgagctagaccacttggttccctggcttcagccccctttccaggggaatgaacagtacggtcttgctggcgttccaggcgccactggggtatgaaaaaaaactcctgcagctagctcggtgtctgcccaaacagccacccagttttgtgcttgaaacccagggccctggtggtgtaggcaaccaagggaatctgctggtctgcaggttgcgaagaccatgggaaaagcgtagtatccaggctggaatgcaccattcctcatggcacagtccctcatggcttcccttggctagggaagggagttctccgaccccttgtgctttctgggtgaggtgatgccccaccctgcttctgctcgccctccctctgtcaaccagtcccagtgagatgagccaggtacctcagttggaaatgcagaaatcaaccgtcattgatctcgctgggggctgcagaccggagctgttcctattcggctgtcttgctccagagcccaattcttctcaatcatttttttcttacccagagttgtctgtttttccacagagtatcttttctgtgcagttaggaaagttgatgatatagcatacttcatccactgtactttgatctgggattttcttcttaaccattgatactggtttctgtaagtgttaatgctggcactttcttcatgttaccggatgatgttaatgaaaggttttcagacagttgctagctcatattctttcttcaactgttcgttaaatggattgttgcctggaatgttgagaggttgcaattgtccagttatatcactggaaaaaacaactaagttcttatacaggcagagagaactgtcattgtcaccacctcttcagtagcaactataaatgtctttaattgtaagccatctgccaatttcagagaagttaacatgttaggggaaaaaacgcatcatagaattgaacatatatagtatgttgaatttgttttgaaattcaggtttttgtgtcttgtaatatttgaggctttcctccttcccccatcatgcctagcctagtcaaaatactttttattgaatttattaaaataattacagtttatcatgatccatagtttagaaaaagaaaggatatgggggcaagatgggtaacttcagtgactttaagggctgaaagcaacaatttggagcatcgtgtcaaagttgtgggaatctgattttagaacaatataagaaaaaatttaaaaaattttaattacttctgaatgaagtggactctgacagtgaatttgctgtcattgaaagtattcagagaggttctagatacaaatcacccagacacagtaaaagcaatttcttcactgggtggtaattgaagaatatgttgtttaatgtgtttttctgactattgatattcctattctaaaataatttacctttgtactaagtggccttctcttttcagatactcaacaatgtaatttatcgatactttctgttattgattggaacaccattgagtttctttcttaatgtaagacaggcaactaaatgcaaattactgttctgtttctaattaagtgatgaaatacactaagccaggtcattctttgaaacactgattgacacagtgggaggagggagctaagaaatagtactttttttccttgcagattttacttgcaaagtattgtaacctgattttccttcaggtcacctagattggagtacagtgatgcgatcttagctcactgcagcctccaactccagggcttaaaccatccttccactcctagctcagcctctggagtagctaggactacggaaacttgctaccacttgtggctatttttttattttttgtagagacaggatcttgctatgatgcccaggctggtctcaaatgcctaggctcaaaccatccatctgcttcagcctcccagtgtgctggggttataggcatgagttactgtgcccagcctatactcttctaatttttgattctttcagggtttagttggtgaaagagccattatgaattttattttttaatttaatttctttttttttgagatggagtcttgtggtgatgcccaggctgacgtgcagtggcgtgatttcggctagctgcaacctctgcctcccgggttcaagcgattctcctgacttagccccactgagtagctaggactacaggcacacaccaccatgaccagctaatttttgtatttttagcagagacagagttttccagtgttggccaggctggtctcgaactcctgacctcagaggatctgcctgccttggcctcccaaagtgctgggattacaggtatgagccagaattttatttttaatcaaaaaaaggttttaaggaaatggctcaccttccttccctccctccctccctccaaaggacttgtggtcagactctttggaattgccagtacttaatcagctgaatgaagaattttctgatctttctgtttagtagttcaaatggtcattaccaggattctttgtatacttttggggagcaaattaaatagatgaaagacagccaacttttaggatgagagataggcatagatatatcgttttcttatcttcttccacatactcaaatttagatatcaggttatccatgatttgctttttagttcaccagacatagtgaagttaacactcctaatttagttttggctatatataacttgctaacagctctagcctgggattttaaagacagcttaactatgttcatggaatgctatgactggctaaatatgactctttaatgtttcataaaacatgtctttttcctaaatagggttgtaacattctcttaaatatttcatgcatgtctttctctctctgtgagacagatctctctagatttctctggttttatttctgacatgctatatgaagtactttttatttaaaagtaagtacaatatgtagtatctcagtgtgcatatggcttggatgcttactttgacgatgaaaaattgcttaaatatgctgacatctgaattgtatctgtaaattaatgttagcaacttgagactcagtaattgtttcttaaaatggattctaattagttacaagtaaaaagtaactttcccttaaatgttggttgtattaattacaaatactttaaaaagatatattaaaatgataaatctaatttttttcctggacattgatttatgttgtgtgatgacataacagtactggaaatcagtagaggtgacactgctgtacatttgtagctatttatattttgttgtatttttataaaacaaagaaatacatcagatcatagtcattataaagcattaaaaagatatgaaaacatacagttaaaaaatgatagcttctccttccctaaacacccaattcctaatgaataaatactgttaaaaattaggtgattatcttcccacactttatgcatttttagtttatttaatgcaccattgtgtcagacattgttctaaggattaacaaatagaagagagtttatatgaagaggcaaaaacactatgaagtaaataataatattgggaattgaggcctagagaggttaactaattgtatggttaacctagacagtctggcattaagatctgtgctcttagtcatgttgcgtcttatgcttttacaaatatactattaatatatgtactcatatatagtattttgttagcttttagtgtaaaaatttattattgtacatggtgctttgaggcttgtttttttctcacttaaaactattttttgatgatctcattattttttaaatggctgtgtatgttttactataacttatttaaatttatttactataaattattttgtctttaatgaactattagtttttttccaaaattgcaagcaaggttgcagtgaatatgtttgttacccttgtgtgtatgtgtgaggattttttgtgagattcctacaaatgatgttgggtctgaggcagtgcatatttaacacttaagtaaaacttccaaatgacccttcaaaatggccgaaaaggtttatacccacatcagttttatatgagtacctgttttctcataactttgccaacaaaaggtacaaataatccctgaaatatttgccagtggggggtaaagactagtaacgccttgctgttactatttgcatttcttaacattttttatttcttagccatctgaattttttgggtcaattacctgttcataacctttgcccatttttttctattgcattgcctgtttttgtattttaactttgtaaatgttaacagtatttttaagtttgttgttgagcactatataagttggctgtggaaccactatagtgattgagaatgcagacttgcaccagacaggctaaattctagctctgccacttctttgggaatatgcctaatctttgtacatcagtttcttcattggtaaagtgggattagtggtggtacacctcaagagattattgtgaggattaaataaattattaattacaaacagcatataactttctgatctttagtaagtgctagcttttataattattattgctctaatgatttatgctatcttgttattagcacaattttcaatttttagtcacctgttttaaaaaactgtctttttactaaattaagactctcttcattctaatatttataagaagaaagtagagtttaaatttcttcagaagcttggtttttcttttttttttttttttaacttttggtatattttctatatggaatttctttttgtgtggtaggcggtaagttgtcttagtttttttccccccagatatctatctagttatcttcactgattaaaaattctgtgttagtcatgtattaaagttttcatgtatgtagaaatctttttctagattctttatttcattattccccttgcgatctgtttattaactcttgtgtcagtatgccactgttacagttacaatagtttctttatatattttgataattttggaaaaatcccctctcatccttctgttttagatttgtcatagctgttttgatacacttttccagactgattgtagattctattctattcatagaatattcatagcattctattcatagaatattcatagcattctattcatattctattaaaacatcctgttgggttttgaaagggctaatatctttacagtgttgagtgttcttatgcaaggatatatctttcccaaaaaattaatgaacgtgatacatgcacatggagaaagaatcaaacagtacagaagagcataaaatgaaatacaagtctttctttcaagctcacaccccaaatccataaccaccattagtattcatgtatggatgtgtatgtgcttcatggccttattcaatcaagcaccctagtcttgatttactgctatattccagaaaacctttcaatttatataaatgtgtgtgtagaatttacctttccttttatcacacagaatgatgctctagtattcttcactcttttgtatcttttacttttttccactttgtaatgtatcatggaaatcctttcataagaaattctattgatctacctcacctatttttattttatttatttatttatttatttatttgagatggagtctcgctctgtcgcccaggctggagtgcagtggcgctatcttggctcactgcaagctccgcctccagggttcacgccattctcctgcctcagcctcccgactagttgggactacaggcgcccgccaccacaccaggctaatttctttttgtatttttagtagagacggggtttcaccatgttagccaggatggctacgatctcctgaccttgtgatccgcccgcctcagcctcccaaagtgctgggattacaggcgtgagccaccgcgtccagcccctacttcacctatttttaaaggcttcattgtctgtcattgtatggaagtactgtggttttatttaatcaccccctattcataagcattttgattataataattttcattttgctagtgtaactaatacagtatgttcttagagatttatttttgtattcttgtgtttatgtctgtaagaataatttccagccatggaattgctagggtatgcaatttcaaattgacagacgtttttagtttccactttaaaaatgttgaaccaacgttatattcccacttttagtgtatgcaaatgcatatttctcagcaccaacactggattatatcaactgcattatttttgccagtatgaatgttttgctatttttaaaatcatgagtgagattaaacctgttttaacattcgtcagccgtttattataacaaataacatttattgagcacttacatgggctaggcactgttctaagtgggttgcatattcatttaatgaattgtttcctcacatcatttgctcatttaaaaaaatgttttttcttagtgaactaagagttcattgtacattaagaaaattacctttaatcatatgtattgcagattttttccattttacttattgtcttgatgtgtatgtatacattttatacacagttttacatttttatgtgcttagattatgttttatgatttttttcttcttggtcttaatcggttttggttaagcttattgcttaaccatgaatatgatcatttttaccatataatttcctaattggttattgctcagttataggtaagtgttgattttcaaatactggtgttgaactctgttattcatcagtcttttaaggcatactcttggactttataggtagatgataaaagcttctgcaagtatttttatagctttgtacttgctatttctctttcttttcctttgcattagctaaggtcaccagtacagtgttaaacaatagtgctcatagcaggcattcttgccttgactttaatgcattttgttattcagtgagatttattcatgtattaattaatatgatagtaattttactgtttaggagcacttattttcagggaaagtagcctactaattagacattaacaagaaggtaaagatacctaacttttatatcagtatgtggtcttgtgcaaacagtgtattctcaactctcccatttatatagtgaggataattattaatctgtaatgtaaaattcctgtaaatgactaagcaatatgtaaaatatcagagcccacatattaaagtatcatcatatgacaggttgccatttgttgagttattttcaagtgcttacggatattttacactggggcatgacttctgagttcgtggaaaattttttgttctgaatttttcagaatggctgatctgaataataacgtatatggttcatcagcataatatgagtaaagcctattcaaacctttacatttctttcctgtcggttcccaaaattattcagagaaatggaggggtaaagtagtatagataaacaaaattgttcatcaccagcccatgtttgaaatataccattaagatagacagcggctgggcgcggtggctgacgcctgtaatcccaacactttgggaggccaaggcgggcggatcacgaggtcaggagattgagaccatcctggctaacatggtgaaaccccgtctctactaaaaatacaaaaaattagccaggcgtggtggcgggtgcctgtagtcccagctagtctggaggctgaggcaggagaatggcgtgaatccaggaggtggagcttgcagtgagcctagatggcgccactgcactccagcctgggtgacagagcgagactccgtctcaaaaaaaaaaaaaagctagcagacagcagttattcaataatgaataagacacgatttctgcctttttgaattgtatatgaggttaagtagcctttacttgtcttcccaagtgagatttactgaaactaacattttagtagtctcccattcctagcacaatgcctggaatctgttgggttctcagtacatttttgcttagtgtacttgaacttcagtgtttatgaaacatagattcctgcatattctggttcagtaggtattaattaggacccaggagtctgcactgttaacaagcacctcagggtgttttccggtggtttctcttaataaatacaaagaaaattttctgaagagagatgttatattcatctcatagaaaatcaattttgggtgggaggaagtttcactgtaatcttcatgccttatacaaaggtaactttgccttttacttcagacttcagcttttcatttaagaggaatctgtatatttagcacagtcgtgggttgttggtatccacttagtaaatatctattgattaccttatttttccctgctctgtcatccaggctagagtgccctgccgcaatcttggctcactgccacctctgcctcccaggctcaagcgattctcccacctcagcctcccgagtagctgggaccactggtgtgcaccaccacgcctagccacttttgtgttttttgtagagacggggttttgccatgtttcccagaccatgttgattattcagcattgattacttgcagtaattatggaattagtttttaatttactaatccagcgttttgtggtaaagttacaattttaaatgtagtttaaaaataaaacgtttttaaactggtctctgtttttcctccttgggaccttgtcatagcttaggtggagcttgaaataatgaagcgtgtcagatgtggcataacatggttttttaatgaccaaaatgtaacttttattttaaagggtattatatacctggttatattgaaaggtagccttgagatgtataagagccttctttgtattgttacacactcttccaaaatatggacaaatcataaatgatgaaaacatgattgcaattttgtagaatttactagttttggcatcattaatttggccaaaatacatgtaataatgggaatttaatgcattataggtttctataaaaattctacaattatagaaatatttttacagtgtcctattcagtaattaataaagccttctttcatgcaattataaatgaataccaatgtcctattcagtaattagtaaaggcttctttcatgcagttataaacagataccaatattttgtattggtggacgtgaaaatatttatttggtaatcttagtaagggatgcatattttttgattgaagactatgcatttacccagctcaaaggaatggatattttatttttgaatttaactcagtgatgtcgctaatctatgtgaacacgccaactgtgtgtgtgttggtggggggggtagttagtaaccatggagctaaggattgatgaaggttggtgataaagggaaacattcccttggaattaagacattgttccttgctgggtgcagtggctcatgcctgttactccagcaccttgggaggaggctgaggcgggtggatggtttgagcccagaatttccacaccagcctgtgcaatgtggtctctacaaaaaaaaaccccaagaaaattagcccagcatggtggtgcgagcctgtagcctcggctactcaggaggttgaggtgggcggattgaggccagaagcgggaggcagcagtgagcttgtgagggtacgggggcgagataactgtctcaattaaaaaacaaacaaacaaaaaccaggcgcagtggctcacgcctattatcccagcactttgggaggccgaggcagtggatcacttcacgtcaggagtttgagaccagcctggccaatatggtgaaaccccgtctctactaaaaatacaaaaattatctgggtgtggtggtgggtgctagtagtcccagctactcaggaggctgaggcaggagaattgcttgaacccaggaggcagaggttgcagtgagccgagatcgtgccactgcactccagcctgggccacagagtgagagactccgtctcaaaaaaaaaaaaagattctgtgtattagacacataaagcacttgtgtgccaggtatagttgtgttttacaaatattgacttatttaatgactacaataactccatgaagtaagtacaattattatttctttttacaaatcaggaaactgaggcacagagaagttagagaacttgcccaacgtcatactgctgttgagtggcaaagttgggatttgaacccagaccttctatcctcttcacctttgttaatgctgccttttgtttcctgaaagcattgctggtgtgtttatgcgttatgtctttactactaattatatttgatttttggaaagatgtggtattttatgctgtgcattatgtcgtttttgtggtttataattcataatgccatgatgtttttaatttaacaaacaagtattagaaaaggtaaagttgttgtatataataactttgctaataatcactgaacgttgtctcagcaagtatatgtgtaatgaatataaatttataccattaaaaaaaagtagccattcattcattcacattttcttgtaattctgcttgtttccatatttgcacttaagatctgttgaacgttaaaacaaatttgcttccttagattttttaaccagtcaccatttttttaagttggtaggatgggccatattgaagataaactatattttacaaattttatcagcatgctctatgaacttgcttctcaaactggagtattaacatatgtatgtgtttttaccagggtgtttgtgaagctacacataaaagtattactcttttaaagtaccatttctagttctaaagattggtgagggtggaaatattaagtactttaaattttcagcttttaaaaattttttatgttgaaactaaatgatttttaagaagcaaagaatttcacataaattatggttgaccatcctagagaccatgaaggttgtattaattcattccatggaaaacttttaggagtacttgattatatttgaagtaaattggtatcttggaaagttgtgaaattggtgaacctgccataccaaaatggtaaacaaaaacaaaactttcctggggtactgaaaagaatgatgttaccaaaggcacgtcttgttttaaatcttatgttttatttttttctttaatcttaacaaaccccacttttaaataaatccttagtaaaattaggatttatttggggctgttaatttacaaaaggattgattgtgatattcctttaaatagcttgcttcttcagtttacaaatgttcattatattcataatgttcaggcctgcatataaataaagcagggaaaaccggtgatagatacttagttttttaactataaaacatcctggtaaaaacattaaaaggttgtaaattggggaacctgtatagccagtgtgttttttaggttggcatatataagtgatattgatataattgtcttttgtttcattctaaatactgagcttagggcttgaatttgccatctgtttttttttttttattaagtatgaccattaaaacaggaataatttgattgaagactacgcatttacccagctcaaagaaatggatattttatttttgaatttaactcagtgatgtcgctaatctatgtgaacattgtagagtgacataaatgtcttctttagagtatccagatggaaattgtggcacaatgcttttgtatttcagtgacttcagaaagaaggtaggcctttaggagagtatctggggaacctttcaatagggtaattgtggggatagcaaattaagtacagtcgtgtgttgccaacaacagggatatattctgagaaatgtgtagttaggtgatttagtcattgtgtgaacatgatagtgtgtatttaccacaaactgagatggtatagctacctatcacacacctaggctatatggttatatatagcatagcctattagtcccaggctacgaaagtatacagcatgttactgtactgaatactgtaagcagttgtaacacaatagtatttgtgtatctaaacatagaaaaagtacagtaaaaatagagtgtaaaagaaaaaaggtataatttttttagcttaatctgttcttttaaaaattatatttcaataagtttttggggaagaggtattgtttggttacatgaataagttctttagtagtgatttctgagtttttggtgtacccattacctgagcagtgtacactgtacccaatgtataatcttttatccctcacccccatcccacccaaatatggtatacttgtttagggcagttagcttgcaggactgaaagttgctctaagtgagtgagtggtgagtgaatgtgaagtcctgggacattactatatgactttataaccactgcacttaggctacactaaagttgtaaaaaagttaagtgattgtgctatgacattatgacagctacagcatcattaggcagtaggaatttttcagcttcgttatgacattatggaaccactgttgcatatatggcctgttattaattgaaatgttgtgtggcacatgattgtagtgggcatgctattctggagtttattttctttgtggaatttgccatctaatagcagagataagtataaaacattttcttttagtagaaagttaagttagaaggagtatactttgttcttttggtttgagtgccatttagacttgagtgaagaagaaaaatagttggtagaattcgcatagttctcaggtttcagattcatagtctgagtttcctgatttgtcactaaatttgtttctcatccaaacatttttaatttacctcatctgtaaaactatgtagattgcaaatttttataatgtagctaattacttttataaaagagaatatttaaaacaaattgtgcatgatagaggaatttgtatcttgaagtttcttgtgctttaagtaggagatgaaccagaagtatgaattaaattgttggagagttttttgatttttctttttgcttgataaacaggaaattctggatatgtgatagtaaatgtttgaggctcctctaaggaagtgctccatcaattttctgtccttgctattttggaggggaaatttttcattttgaggacataatttctatgatatgataaatactaagaatttttcaaaaaataaggcaaatatgatagcaatgagtccagattgcagtgggaaagaaatataggaataagaaatacttctgtaacagctctggaaaacaggaaaagatgaaatcataaaccagaaaattttgaggctttctagaaagatgtaaggctgacaagattagattcctgaaaaccattagtattgaacagcttgtactacacataggggaaagtatctggtttctgagtagaaaagtagacttgcttacaaattcacctagcttagagatgtcagggctagggcagagaaatggctctgtgagcagtatcaaggtaattagaagactctggaattgatgagtcttgaagaaaaatctgtctgttcctctctcttctttaccacactaagagcagagtctgctcacaaaatccaatagccttccattatggggttgatggagatgggggagactcttgagggaagtaaagcagtgattttcaccagccatcagtacagaacaatccggatttaaaaagatgaagacaatgaggaaacactggatattagaggaaaaattaacagtgtaaaagaaaggactggtactgaaacaagcaaagcaaatagctcagagataatagtttatatagaaaataagaaactgaactttttagtattgggaagatacagtattgagaaaggaaccatgaacaaaaaattcttgacaattaaaaatatgattgccaagaagtcaaaaaatagagaaggttgtagaatccagagtactaagttgattccacagctgctctctgaacatttgttgacctagaggcttgcagttaaaggtcacatggattttaggagagagatctttgggccttcaatcattagattgaagagttagaaccctgcagtggaaaaaacacactcaaagtgctttttcctatgttcatactcaccaattaacacagaagactcctgtgacctcaaaatatgtaggatttcttcccaccagtgagtgagcagtcagttctgcagacaccagctagtgtcctccaattcaattcttttcttctttttgagacagagtctcacgctgtcgcccgggctagagtacagtggtgcgatctcagctcactgcaacctgcaacctccgcctcctgggtttaagctattctgccttagcttcagtagctgggaatacaagtacgtgccatcatgtccagttaatttttgtatttttagtagagatggggtttcaccgtgttggccagactggtcttgaactcctgacctcaagtgatctgcccgccttggcctcccaaagtgttgagattatacgtgtgcgccaccgcgtgtggctcctccaattcagttctcacactatctacctgaagacagcatcaaagcccagaagttgagggttcagtctcacaaaactgcccattactcctgataccagttgcaaacccaggtggtgggtttttttttttttttattgagacatgatcttgctctgtcacccaggctggagtgcagtggtgtgaacacagctcaccacagcctcgaccttctgagctcatatgagcctcctgcttcagtctcccaagtagctgggactgcaggttcacatcaccatgcctggctaatttttaaatttttttgtagagatggggtcttactatgttgcctgggctggtctcaaactcttgggctcaagcagtcctcccaccttggccttccaaagtgctgggattacaggtgagagccactgcttctggctcccctgggttgttttacctgtgcttctgacggaccaactataaatcagggatctcacaccctttccttggtttcagttaagctgctgaagtggcttacagaacacagggatacacatttaccagtttattataaaggacattacaaaggatatagctaaagagatggatagggcaaggtataggaaggggcatagagcttctctgccttctctgagtgtgccaccctagaggaacctttatgtgttcagctatctggaagctctcagaagcctgtcctattgctacttttatggagacttcattggataggtgtgattgaagaactgtgtagaaatgtgattggacaaaaaggttatgagctaatacttatagactgagtgggaaaacctagaaaggccggttcagattcttagcctctctgtgcactgttaatttctccagggtatgggagaacctcttctgaaatgggtgtcttattacctgcagtcagacaacgtaggtcagagaatttctttatgggcagcttcaagatggaaaggcaggggaaaattcctgccttggggagaaaaaggatcatgtgaaaggagggaaagagaaggtcagagacattaccttctgaggcctacttctgaaggccaatgtataacaaggactgtcagtgttatgaaccaggatccatgggcgaaaacctgtgtcatctatctttcacacctgcataaagccaggattcttcacgataaggcttcagtgaaagggagcctagaaaattaaatttactttccacgagaaagacactgtgtcctgaattggtgggttcttggtctcactgacttcaagaatgaagccacagaccctcgcggtgagtgttacagttcttaaaggcagtgtgtccagagtttgttccttctgatgttcgcatgtgttcagagttttttccttctggtgggttcgtggtctcactggctcaggagtgaagctgcagactttcgcggtgagtgttacagctcttaaggcggtgcgtgtggagttgtttgttcctcctggtgggttcgtggtctcgctggcttcaggagtggagctgcagaccttcgcggtgagtgttacagcttataaaggcagtgtggacccaaagagagagcagcagcaagatttattgcaaagagcgaaagaacaaagcttccacagtgtggaaggggacctgagcgggttgccactgctggcgtggcagcctgcttttattctcttatttggccccacccacatcctgctgattggttggtccattttacagagagctgattggtgtgttttacagagagctgattggtccgttttgacagggtgctgattggtgtgtttacaatccctgagctagacccaaaagttctccacgtccccactagattagctagatacagagtgttgactggtgtatttacaaaccctgagctagatacagagtgctgattggtgtgtttacaatcccttagctagacataaagattcttcaagtcaccaccagactcaggagccccgctggcttcacccagtggatcccgcactggggctgcaggtggagctgcctgccacttctgtgctgtgtgcttgcactcctcagcccttgggcggtcgatgggactgggtgccgtagagcagggagtggcgctcggggaggctcgggccacgcaggagcccatggcagtggaggggaggctcaggcatggtgggctgcaggtcccaagccctgccccacagggaggcagctaaggcccggcgagaaattgagcacagcagctggtggcccaggtgctaagcccttcactgcctggggcttgcgggccggcttgccgctccgagtgcggggcccgaggagcccacgcccacctggaacttcggctggcctgcaagcgctgcacgtagccccggttcccgcctgcgcctctccctccacacctccctgcaagctgagggagccggctccggccttggccagcccagaaaggggctcccacagtgcagcggtgggctgaagggcccctcaagcgcagccagagtgggcaccaacgtcgaggaggcgccgagagcaagcgagggctgccagggctgccagcatgctgtcacctttcaacatcagagacgttttcttctcttgggcttttggtgtgggactgaaaagtttccactaaaaacttgtgaccattagcctgccttcataagggtatgggattgtaatttatactacctgcatagtttaggaaactgcagacagaaaattatttaaaagcaatcaaataaatgttggcagtgctacaaagtacctaacagaaaagtgaattatcttcagagggatgctccttcaggtatgcccattgatagagtctaaatgaagtgctttcatattaaaaaaatatgagaaactcagcaatcatgagcaacagtgagcaggaaagacaaatagcagaattagacccctgtgaatgtcagatattgaaattactaggtaagacaatggagtataaatgaataaaatgtttcaaaagaattaaaagggaggggggaattaaaaacatgagcagggagcaaaatactgttaagaaataccaggtagatctgaaaaagaatctaaagcagttgtagaaattaaagatataataatgaccttgaaaaatattaaatgggttaagtagattgaactcagctgaacagagaattaattaacttgaagacagatttgaagaaagcccagatacggaaacatgaagatgtttagagtcagaagaataaacgtctaatgtgtatgaaattgaaatttcagaaaaggataatgaaaagactcacagttggtgtccaaagaaagaatgagaaattcccaaaattaaagtgtgaatcattaaactgaagaagtacgattaatgcagaggaaaaaaagtaactggataatactgaaaactaagagaaccttttttagcagccagaaacagattatctacaaagctatagaaattagactggcagcagacctctaaactataacaatgaatggtagagatcatagagctaggttttcaaatgctaagaaaaacaaatgtcatcctagggagagtaactggcagaatcattcagaaacaaggattttgaaatagatttttcagacagcatcagattgataaaaatctgacagtattgtgttggtgagtatgtggaacaatgggaactcttagacagctggtagaattataaacaactgcttttgagagtaattcagtaatgtctagtaagtttcagtatgcctttctccagtaacccaggaattctacctatgcatacatatatatcttagcattgtttattgatctcttttgaccatgatataactgagatcaaattttcgggaaacaaaatttatccttcctacaggcagtacattgtgatctgtctctgtacgtcatcactttgttcatcttcctttttcccctttactcccaagcattctcttttatttatttatttatttatttatttatttatttatttattaagctgtttgtgatcctggctcactaatgtgatattattgatgggttacaaactgcagtttgaaaaacactgccttaaagaaacaaacagaataaggatagggatattcatagcaatattgtgtgtgagagtgaaaaacttgaagtcatcttaagctctaacaaatggaaaatgggtaaataaactgtggtatatctatctaaggatcttgaactagacatcataataaatcattgaattacaatgcctatattaaatgaatacccttacaaatatagagtatagaaaacaaattacagatgagtatataatgtgatactcacatgaagcttaaaaaatgcaaagcaatggtatatatagttttatgagtatatacatatataaaaacaaagaaatccatggaaatgggctgggcgcggtggctcatgcctgtaatcctagcactttgggaggccgaggtaggcggatcacaaggtcaggagttcgagaccagtctgaccagcatggtgaaactccgtctctactaaaaaaacccaaatatacaaaaattagccgggcatggtggcatgtgcctgtaatcctagctatttgggaggctgagtcaggagaattgcttgaacctgagaggtggaggttgcagtgagccgagattgcgccactgcactccagcctgagcaacagagcgagactccgtctcaaaaaaaaaaaaaaaaaaaaatccatggaaatgataaacaccaaacttaggttattcctgggagtgaaaaagaaaggtatttctgttatccagataatttttttttccttaagctgggtagtggacataaaggtatttattaaataatatcttgtactcatgtgtatatctaaaatatttgacagtaaatttgtttgaaatggaggtggcagtattgacaaattgaaatttctcagaaagtacagcagaaagagttgaacattatgagagaaaagtttgagacctgtataatagatgtgggatatcagtatgtgtgaaataggaattccagaaataaaaaatacagtgcatgtagcagaagcagtagatagtaaaatggtagaataaatttgttctgagctgaaaaaagctttaaaataaaacctatgaaatcaagtttttggtaaaatcaaatatttataaaacttcaaaatttcaagtatcaaaagaaaatgaagttcccagataaacagcaggcgtacccctaacaaagaatctgattggcatttgatttttttttcttttaatgctgcactggatactaaggaagagtagaaacattcctatagaattctgaggtagaagtattgttaacgaacaccatggattttcatctaggtcctgctgctcactgcacagaaagccagtcagagataatgattattgccaaagaagaaggctttaatctcatgctgcagctgaggagatggaagatcagactcagatccatctccctgatggactgaaactagaggtttatatagcagggaagaaatgtaacaatatgcaagaaaacagtaactagaggggcaaggaagcaatcatgatgaatgaggagtccgctctctatctcattgtctggttgttgggatctggtgagtttcagttatttgatagtttttttgggaggcctgaaagtcatttccttaggaaggaactcagataaaacaaaaatgagtttcaagctttaagaccagaaggatcaatttctatgtttattaaaaaagacataaaaacccaaaaaactatctatgggactattgggtcagtttcagtattacgaccctaaagttctatgtgcaataaaactattccttcacgataaaggcaaaatatattctttccgaaggactgtgagcctataataattacatatttaaataaataaatatagtatttgggagtacttaagcaaaatgaaatgaattggaatggagaattttctggaccaaaaaaagaaaggtttatgttaaacatttgtgaacaaaaacaaaccaaaacccagtcagtgacatttaaggttaaatacaaagaattactaataatgtactttgaagtgtaatataatttttgagaaaatattcctgatataatgaatggaacttaggaaagaaatgacagctgagaaataaaattctaggtgacttaatacaagctgtcctacagcaagtgggagtggagcaaggaggggaaagtaaaagaatactgtctattcatggtatactatgcaaagagcttctatgcacaggaatggatggatattttatacttcttgatgtttatgacaaaatacaggctgaaatacgtgttgaaaatttgaggagacttttaaaagaaggccaacaatcaactcacccaaacttcctcaaacctgtttgacagaactaaaaatatatttaataaaaaaaaaaaaaaacaaaaaaacaaaaaagcctataacagcattaggtattaagaagggtgacattggtgcagcaaacttgggggaattccctgatgatagaaagtagatggactgagaggggcagaagaacaagaacagagaaaaccgcaactgaaagtgaaaagctcctgaggttcagtggacctcaaggaactctatttgtgttaccagtttgaaagaactggagtggaggggaggtggtgatgtgataatcagagtaattaattaaaaaactgcctctaggctgggcgaggtggctcacgcttataatcccagcactttgggaggccgaggtggacagatcacctgaggtcaggagttcaagaccagcctggccaacgtggtgaaaccctgtctctactaaaaaaaaaaaaaaaaatacaaaaattacgtgggcttggtggcgggcacctgtaatcccagctactaaggaggctgaggcaggaaaatcgcttgaacccaggaggcagaggttacagtgagccgagactgtgccattattgtactccagcctgggtgacaagaacaagactgtctcaaaaacaaaacaaaacaactaaactaaacaaacaaaaaacaaaaacaaggctggtgcggtggctcacgcctgtaatcccagctctttgggaggccgaggcaggcagatcacctgagttcaggagtttgagtccagcctggccaacactgcaaaactctgtctctactaaaaatacaaaaattagctgggcgtggtggcaggtccctataatcccagctactcaggaggcagaggcaggagaatcgcttcaacccgggaggcacggaggttgcagtgagccgagatcgcaccattgcactccagcctgggcaacaagagtgaaactcccatctcaaaaaaaaaaaaaaaaagctccaaactgcctgtagtagctggatacttcccttcctcgcttcctcattcatactgaatgatcagcagcagggtatttttctcaaggatagagtcatggcttctattctgcatatgatgattctggagaaggcttctggttgggattggaaagagcctgagaactctatcaagaactcatatgggaagaaggaaaggaaagatggctctgtatgtgtgtaatacatgaaacactctatcccaaaagtaaagccttccttattttggcagtcttgggggttccagcctataatctgctttgcaagcacacacactaaaacatgctgcttgatatgttttgcccgcattgagcctgaaatctgctctcccattcagggaagatggcttcagagacggacagacgtgtagatctataggagaaacccaggccagttagatagttctggaacactattcacaaatttggccaaggagcaccagaaaaccaacagtgcaaaacagaaagtgaacgaaggaaaaaactgacccctggaaagtgggaatggtgcaacaaatacatagaacttaaatataataacctcagagagatttcagagggcaaggtagctaaaaattcaaatcaggccattgtgaaagaagcaataggtgaagttctcagaaacgaaaaatctgattgttaaagaataatcaaaggaaggactgaaaattgaaacagtgatttagaaataaagttgaagaaacatactggaagctaaagataaaaagatggagataaaaaatatgaacaagtgtttaagtgacatggggcacggaaccaggtcttcagaggagacaggaggaggggagaaaagacgtaactaagtacaatacctaatgccgtggcgtattagataaatatttaaaaagatgagtgagattgaaatatacttgtgaaaagatggtcaagatatattaagtgaagaaggaagttgtgagaacagtatgcatagtatggtatttgtggttaaaatctatatgcatgttcaaatgtgtacaagaaagagtgaaaggatatgaaacactaataatggttaccttttgaggaaaggatggaggaatgagagaggaattcttttaaaatacataatgttgttttgaaaggaacatttttatttaaaaaatgaaagaactacaagttacattggagaggaagggaggagagcaacatgagggtagaagtggttacctaaataagccatttaaatttacacataatctccaacctatacttttctttataacatgtacttttctgttacttcttagcagttgtctccttcccctattattcctggacgtttacagaagtatattttcacacacttctctgaaccttcccttttacccaaagtatggtgggggtgagggtgtgactgataatttccttattgcacatagattttgtgagagatgatatagatggggagaatcacgtaaagtaaggatatctttaaattctaggtattggtttactaataatagtatcaacccatcatcttttttggaatgagtcagcatataaataaaataatgaatggtaaagagaaaaaacaaagagaattataaattcaaaaggtatatcctggtgggtatttttgagttgagattaggaattgattagtatcagaatagtaacatgtaagtataatcacagaggtttgtagtggtattctggaccacttgaaaggcccatcctttttgtgaggagatggatatgatccttggtttcaatatgccacatctactataaacttctgaaccctccaccatcattcaggatgcatctctcatggttgaagaagtggtggaggatggcatgggaaagagtgcctgaggatccttgcctggaacaagttatggaaagaaagtcttacaggtattcttcttacatattttacttgattgctatgtttttatgggacaaaatagttctctttcttggaagagtgggttgggagggggagagaagaggaagatgggtgtgttggggtagagcagtggccttcttttccaagggtggtagagaaattaggaaagaatattagtgtctttctgtcttttttctttttctgttcccgtacaacttttctgtcatcttcataactaagttgtatcagagttttcgaattgcagactcatttacatgataatatgattcatcaggaacatttaggtacacagcatgctgacataatagtattagctatcaataactcttagaaaccaatgggaaatgtttagatctgtgaattgtactaaattttaaatattttgaatatttttaatacaaatcttatttgtaactaacttgttgatgatctcttctttggttatgttaattggctatttaaccatttcacactctgatttatttctcaggcatgaagatgttaacaatgctgtgcgttttaattaagtagttaattaactggagctccctaagtcttaagttcctgatttttctctagaataccagaaacttaagtgccaagagctcagagaatggcttccaggacagctctagcctcactgcagcttaaaaaattgcaaacagatttttttttttgcaaaccatatgtcagggaatttctcagaggttttctaagaaattcttttatttgaagttttagaaacactatcttcagttgtattgctgataattcataattctgttgtcctttttaaatgataatataaaaagtatgcattagtatgtggggaagttgtttttgaaaacttacagcagttggaacttactcctgtaacaactctgttaagtggaagtaaacaaagataagtgagcataaaattggtcaaggtaaagtaagtgaaatgaaaccatataatagtagagtttttttttttcttttctgtttcagtgaaaataagtaatgttgctcttaagagagaattttgtattattttctcctcttcttttttttttttttttctagcttgggctctaggaaaagagccttttatcccaccttgtcttccagtccattttgaatcaagaaagactcattgaagactcctttgagaaaagtctgttttgaagaaggaaaaagaaatactgtttgagagaaggcaaacagacaaaaagggtgatagaaatatgtatttttgttgtatatgtaactctaagagaccttcctagagtgaatgaaggtagaaaactgaaaagggagtaaattaaggaatgattgaattttgtgggtcttgatggaaaaacgctggtcttcttttaatgtggaaaaacagctagtgcttcagtcctaggaattatgtctctgctgtgggcagttgtcataaactcttctcacaatccgagctgctctttgtcctctgtgaatgaaggtacttttgcttccatttcatccaaggatgaatgaaaatgtatagcatctgcccaaacctaaaaagtacagtgtgtttatcacgagagctttgtaaggtacttcacttccactttaaaattctttagtgctcaaaaccaactattgtgggtttttgtcaataaatactaatttttcaagatgaagtatggtgatttctattcatattgtggtcaattttctcaattttgtttcccatagatagcgtgatggaacttaaattttattttttacacttaaataactgtgctttttgtgatgcgtaatcatgattttctcttttccttgagattttaacagaccttatattagtgcatatgtcaaaataaaaatttttaaatagtaaatatgttgtaatattaaggatattgatttttttctattaaatgttgagcttggtgttggtataaaccctgatcctaaacggtaaattaatacttggaaattaagagtgtaactatgttatatagaaaccatcttgcgaattggtttgtgtgggtggtttttaaatttagtttttaatttttttagtatgtaatcgtactctttcaggattatctaaagcacttattgtaattggttgtttacttttctgcctcccccaccacattgagtggggaaataaaaccaaatgagtatttggaatctagtatgatccacccaatagtgaaagctaccaggatgggaatgattcctggagaatactggggaaacttgtagagtgtatgacaatttagcaagatgtataaggatgaggaggaattccaaaagcaggtggatgggggagctccaagaggggagtttccagctgagtgcaagttgtagaccatttactgtagcaacatcttagagtagaaggctggatggtagaagaggagctgcagagataagcagaggtagctagcacacagttatgagaagttggctggagaatgagatttggcaagtgctccatgtaatgaagatttgtttaaagaaaagatgtgatagaaaagggctgagttttaaactccccaagtttaagaaggtttgaagtttttaaactttaaaagtggccagggagggagccaatagagtaaaagtataatggtgagggttatgctggatgcaagaaattagtgtttcactaaagaagaatgttcagttgtgtcagatgtcacagagaggtgtagaaacataaaaagtgcaaggaatccttcagatttggtaaagaattgccactggtaaatttgtccagaacaatttcaatggggccagaaaactctggattgtgaagtactcagagatgagaacatgcaggcagtgattttattttagaagaattatttatctgtctttgcctttcatttaaaggcactttctcaaagttcaggttcctgactctatgatataattatttatagactgcctttctgaaaatagttctatatgggttaattttgttaatattagtatgttgacaaaagaaaacataaaggtcgatatgattattttcaaactgagaagctgctgtaccaaagctagtttataaaattagattttgtatttatggacttactcatctactatgttacagtagtctttgttttgtgaaactccaaggaaatattttctacacatttcaggttaagaaagaaaaacatgcgtttattttgtcttaaacatgaaataatgttttaagcattctaaaaagtacttacaaatggattaaacacattggcgttctttatagttttactctggttcttttttttgtgacttgttattcatagtctttgcaatgccgccctctagtgatcgatttccaaaaatgcattaattaacttgtaagcctgttacagtctttctcttttgactctactgatcctttgccacagcctttgtttggtgttctcttttattgctcttccattagttattcttattctcctttaatggcattagggaaagatcagaagtttcaggagcaaaaaaaaaaaaaaaaaatacatatatatacacatttgactatgaatccttaaaacttgtccatttaccagtctgggcatagggcaagttacctgtccagagttcttactgggaatgaatgagaatgtctttttgtggcacctgacacagacagcaaagagcaggcattcaacatataccagctgtctcttccaccctcttctccccaacattgctgagagtagggatcagtactgttttttttttttttaaacctgtcccttctcctcttatataacatctcaatttgttgtaattacctgtttacttgtttgtgttctataacttctagaggtcaggtatcatgtttggcttgtacatatttgtatctggtatttagcagaggccagtacacacagggtcctcattggatatatatttgttgaatgagtaaatgaattaatggatgccagtttttaataagaaccccagactgtgttaccgacatttctgttgattgattgattatgcagattgtaaatgggtaatatatgatataattagattttacccatgacctttcatagaggtatttatttcatgactttttcagtttattctatagttattggtcttctcaggttttggataatatgataatttgtgttttccttaagaattgtctgttttgttcagtttaaaaaaattattagcaaacacttatgtatagaattttcttatgatatttgacttccatatgtgacaaaaccccctttatcattacatttatgttatgtcttgtgttgtctgtttttagattgtaattagattggaggtatatatgtattttattgtttttttaaagcaatggccctttgaattttattcttctgcttgctaactgaaaaaataattttacctgttttttttgtcttccaggtttttctaacaacttagtacttccatttttctttttgtgcaaaagcttttattactctaaatttgcttctaaattacagatttgagtaaatgccatataatagaagatgctgtttttgttattttctagattttcaataaaatgtagctgcaatttcctcattgatctaaaagttacttaagagggtatttaaaaatgatgaaatgtatgtgtttacaattgttattttccatttttagtataatataatcagagaataaggaatgtacagtttctggtttttgagaattaaaatcttttttggtgatacatataagatcagtatttaaaatgtgccccaagcactgacaaagaaggtgagtcctctgaagggtatacagttttatatatttattcagatctctttttttttttatgtgcttcagctatcatgtatttatgataattttattaaagttttgtattactgttgtgtgtttgtcatttttctcattgttttttaacgttttattgctacattatttgattcttagaagtttgtgattgatatcttcataatatattttattcttcatcaattaaaaatattcaatcttttcattaaacattgcttatcatgtggatatccaaatgggaaaaacaatgaaacttgatccctgcttcccaccatgcacatttgattgaagatctaaatgtgaaaagtaaaataagcccctagaggacagtataagagaatatcttacatctttctatcagactgaaagtatcagtactttataatcttgaagtaggaaaatgtttcttaaacaggacacacaactcacaggtataaaagggaagattgataacctggactgttgacagttcaagaatttctgtcatcaaaagttactgataagagaaaaacaaaacagtaacagcagatacttgtaatatatatatctgacagatggcttatatccatactatgtaaactcctacatcagtataaaggacagacaacccaatagaataaatgggaaagagatttgagcagtcagttcaaactgtaaagacataatattaacactcagcagaatggctaaaattagaaagatcgacagtaccaagtattagcagaaagtggagagcgatgcacctctctttttgctgctggtgggaaaatataaattgtaaaaatcacttctgaaaactagcaacacctgctaaagctgtgggtatgtgtatacatacatatatccagcaacttcgataggaattcatgcagatacccactaaaaggcaagcacagtaacattcaaagtagcattatttgtattagccgaaacctggaaacaaaaatggccatcagcagtaaaatgggtaaacagattatggtagatttaattcagtgctgtatagtaatgcgtacagcaataaaaatgcatgaattgcggccccgtgcaacaacaaagataaattacatgaaccgatgttgatcaaaataaactagacacaaatacttaccgtgtatgattccctatataaaattcaaaagcaggcaaaactaggaatttaaaaactataaaatacaaaagcaggcaaaactggttattagacctcaggttagtggctacttttatggatgaggaagggatagggattgggaagtggtattgggcttctaggtattagtagtgttccttttcttgacttgggtggtggttacatgggtatactgaccttgagataattcagtgagttgtaaaatttatgatttgtgagtttttctgcatatatgtatgcttcaataaaactcaaattacggtaagcaaaaaatactgctttagtgtgaggatattattattaaataatattaaaataactagaaattcagtgaaacttaatcacgattgtattacctattgaaaatgtcagtgaataataccctctgctaattgtttgcctatatgttctcacattcagtcctacctcttctctgtcctctgtatggcagggtacatttagaaaaatacaaaaaaaaaaatgaaacttttttctcttatattttggttttgtttttattttcatttgttgattatatctttgccctctttttttaaaaaatttttccttatggagttttttcctatattgagagtctttgactccttttttctttgacttttactagaggagttctattcatttttctttttctttttcttttttccttttaccttttttttttttttttgagacagagtctcgctctgtcaccaggctggagtgcagtggcgtgatctcggctcactgcaacctctgcctcccaggttcaagcaattcttctgcctcagcctcctgagtagctgggactacaggcatgtgccaccacacccagctaatttttgtatttttagtagagacgaggtttcacaatgttggccaggatggtctcgatctcttgacctcatgatccgcccatctcagcctcccaaagtgctgggattacaggcttgagccactgcgtctggcctgttttattcattttcattcatattttaactgctggcttattcatttagtttctcatgcttcattgctgttatgcaaactgttttctttctacgtgtgtagagggttaactttaattctcctgaaaactatttctatgtttttcaaatatttgagcctatattttttgaattaacactattaaagatacattaatttccccagtttaaggtgaaacaatttaacttctcccattctttttcctctcacctctgtctttttaatgatgtagttcgtgattcagattaaactttattttcaattttttatttttgcattttgtttaatctcgagttaatttcagacatatgcttttttgtaaacatatttacaatcattattcactcaaaaatttattgagcacctactaagcaccagacactgtcctaggcaaataagaatataagtgaaaaagacaagacccctgatctcatcaacttgttgatggtcaaaaataggtaaataagatgctttaaattttgaagggtagtatgatgggaataagtagggtgaagtgatacagaatgaatgactgcagttcggattaaggctatgttaggttggtcagagaagtcctttttgaagcagcaatatataagctgagacttgaataagatgggacatgaagctgggtggagtggttcagggagaggggttagccaatgccctgatgaggtttcattttttggaagaacatttattcaatattactgattgaattttgtcaggcatttgagatagtcatgaacgaaacaggatttttgctttcaaagtatttacattttacgcagaacagataaatagatgagcaaataatttcagaatgtgataagtgctataaagaagataaaatgctagaatgaggagaagggaccactttaggtaggataatgagggatgcttttctgaggaggtgacatttgaattagtaacttggaagtcagtaatagacccagacatgtgtaaatctagggaacagcatttagggtagcgttttagttgggttggaacaaagagggtgaagatgggttgaatcttttcgacccttacgtgcttatgataagcttagaacttactctaaatatggtggaaaactataggttatgactacagattcaattactatagcaaaagatctttaactatagagcaccaaacaaaattgaagttactttcatataactcagtccaaagctggtagctggctattttccttccacaaggttgtctaaagactctggttccctctatcttagtctttaaccctctgataagcagttacctgtgtctatgtggtccaagccacttcgccatttacagatccatgtttctaacttgggaaaggggatgaaaggctagcaacttaaggaggaagggacagaaatttttgcatgtaggagtggaaaacattaccagaccttttagctttgaggaacatgttaatttttttttaaggcttccattaagaatgttgatattcataggggacacctaggtttcagtgaaatcaagaaagtcaaggaaacattgagagaataggctgaggagatagacgacatttctgatctcagataagtagttccagaaggcatgcacagtgaaatcatttgagacctgggatggaggatgggggagattcgtaatcttctttgtgctcagaaagagaatctgaatatttttgttaacagtttcagtgccagtccacttatgctattatgttatttctcttgggttattgtgacttatttatagattggctttgtagtttcttttaacagtatttcagatgtgcataggactggtaaaaaatgttgagcttttctgtattttggccagctgtgaattcattgagtatagtctttgtccctgaaacttcaatagcctttgtttaattgattctaatatttgaattagttgacagattttaaaatattcaagctttatgtccttaggtacctcgtgtcttaataatatagccatgaaaatattaacatttgtaatccttatacactaaacaaaaaaggggggagtgtgtatataataaagcatgttaccttaaagctatcacactgattgttttactaatcatttgtatatgtatatacaccatagaagtataaacaacatgcactctcacactgaaaagcattgctaaatatgatggtttctcctttgaaatgtactttgagatatttttgcatgtaggtacactattgattacatcttctattaatagactattccactgaaataagttggatgctggaaaattctgtttaaatttgattagatacttgagttgaatgaatttgtttaaagttctttttaaaattgcatgaaaatatgtgaaaaagtttaaaaataatctacagtattttggcaggataacaagaaataaaatttctttttaaaaaatgtgagttttggtaaatgtttctccttcaggactggtgcttctaatacaggttggtggttgtgcatatatttatggtttcacatatcagtactcaaagtctgatcataatcatgtaaaaatcattgaaggaaaaggttgcgagggtgctggcccagagtttcaggaaggtgtgtacctaagtactctaggacagatgtgtatttccactaaatatcttagaggtggttatttcataattttccttaaattctgtggattgatgacctcaaaaataatgatgtataagtatagttatggaatttagcattaccagcatcttaagcatagctgtagttacatatccttccatgtttgtgacaacatggagaagctcgtgaagacacactgagtcagtaagctgatagctcttactttctgtgaatatgtgcatagtttacaaaagtctgttgggcttctgatattaaaattatgttagtgaacttatatataaaataatttgaggagtggtcctccaactttaatgtgtttaagaatgatcttacaacttgctaaatcctgatgtcttggcccttgttccaagagctttgcttggttctgtggaacacacttgaaactattttagagattaaagaataaaaaatagaagctttgaagaatagtgatctgtgaagcaggaaattaaaatatcatgcctaagtcattaacatttctgcatagaaatttgcattagtttgatataagcctttctattattgttcactaaaatattttaagtgattgactttgaaagtgtcctttgttttagcttctttgttccattctttcctgacatgttcccttcagtcttcttttactttctttagtaaatgtttgagtgtttaccatgtgtcagtcattgtgctaggaatcttgaaggactcaaatacgcaaaacacatggatctagcctagaagttctcatttcagagattaagcgtcatttataaaacaagtgataattgtataacatgttgaatgacacagtcattcagagtagtgaaaaattcacaaaacagctttgtagtagctcctaaaatatgaataggagtttctcaaggggacagaagggaaatggcattccagttagaacaatatttgcaaagacatggaagcattaaagagacatttgatgagatcaaggtggtgggtaagttgtagaaaaggaggctataaaataggttagggccagagacttttatcttttaatttattttactgtttaacttatgccaggggagttgcagtgaatgtcacggggagaaaaaaagatatttcaaaagtagaattggtaggatttagagactagttggatgtgacttagagtttaaagttagaggagtcaagggtgactaattggaataattaaggaaaatacagaatctaatgaaatctgacttctttaattttcaattatatttggataaacaaggacctttaaatctgatagcctcttttcagggcttattcttcctgaagtcatcttagcatgtgaacattacctcttatagtctgaagccacatttgtttgtttttccctcagccctactggtgaaactgtacgatcttgcagtctgcttcaaaagcctgtgtgtgactcagtcattctactttaggaattgaaaccaaagaagtgatcagagatgtgttccaagatacatataaataggtctttatattatagtgtttttatgattaaaaaatgggacatggcttaaatggctttcaaaaaaggaattgatttaatttttgtatatctaaggtactgaatgggtaagttagggaaaggctgggctattgtaacaaagagatttactaatgattccatggtttaatttaaaaagatggaaatttatttctttataggggaatgtttcaggtcaattagaaattctacttctgtggtcattcagggacataggctctatccatcttatttctctaccacctcgtggggcattaatgatctatgctcaattttaggcacatccatatgctggctttattgaaactgttcttgccatggttgccagcaatgacacaggttgagtatctctaatctgaaaattcaaactccaaaatatgaaactttttgaggggtgatgtgacgccacaagtaaaaattctacacgtaagtacttaacataaactttgtttagtgcacaacattattaaaaatgctgtataagatgtatatgaaacaaatgaattttgtgtttagacttaggttgcatccccaagattatgtgtatgcaaatatttcaaaatctgaaaattttgaaatccgaaacatttctggtcccaagcttttttttgagacagggtctcactctgcagcccaggctggagtgcagtggcatgatcttggctcactgcagccttgacctcccaggctcaggtgatcctcccacctcagctacctgagtagctgaaactaagttgtgtaccaccacacccggctaatttttgtatactttgtggagacagggtttcaccatgttggtcaggctggtctcaaactcctgggctcaagtgatcttcccacctcggcctcccaaagtcttggaattatacgcaagagccactgagcctgtcctgtccgaagcattttgaataagggatactcaacctgtaattaatacatgaaataggcatttcagtgcttctgttgtttcactgtgatatttgaaactgctggccaactttctcctccgtgggcttctgctggtttctcttctgtccctctaagtatttgttcactgtgtctttttcatgttcttttcctttgcccttcctataaaggtttttgttctccagttttctgtctttggtccgttttcatttacatgtgtacctatgttgatctcacccagggccactaccacatgatggtgtctcctaaatctacatctctagcctgaaaacctttgttttgagcatcaagacctgtacatgtaatgcctctctacctgagtactctgcaggaaattaatatgtaacatatccaggactgacttaattatcttctttcccaagctggctctcgcacctgcattacctctcatagcctcctagatcagaaaccaggaagtcaacctcagcaatttcttgtcctccctcttccagtgagacctcaacactttattaaatatgcctcgagtattattgctgacattttcatttttctatctccattgccacagtcttagttcaggcgaagattattttaagagcttcctcagagatctgtgtttccatttaggctccctttcaatcctacttattggttaaatgggtcagtgattttcttctactggtatttggtgggcagcagctgtagttttaaattgcatgatatctggcccagtgctgagtgcagttcagctgttaatacgatactaaatgaagaacatttgtgaataaagacaagattagtaatgaagtaattattaccataatattcaaagaaatctggaagaaaattagaaactactttcacatcggtagggaaaaagtactagagccaaagaaaatgattttggtattttactgtttaagtttacatacaatctgaatcacggaaccaaagacatttgttgcagagattagcattatttaaggaaatcaagaacaaatagttcctgaactcagtgtgtcagttcaacctctgcacctttgaatttggctggactcctgtgggtcctaccaaggctgcacgtaacagaaagctatagacttccattcctgttctggccagttaacttaaattctttgtgtgtggacatctgacacacctgtttgattctccctcttggtgttaggactcctcgcatctgatctgtggtgatccttcacagtctctctcgcaatttctttgactgttgtataactctgcagtccttaactatatttgctcacctaattttttagtgctttctgagcttcaagtaagaagctttcttctttatttcatgcttcttggttgagtcatctctggcttacctggcaggagaaaggagtatttgggcataattagtgtttttacaaagtatgtatagggtattgtgctggctggtatatatggcagaaagaagtgattctgcctcaactcagattagtaataattctcctcctgccagttgacgtttattgtgcttttactatgtctagggcactttctcacatgctttactatgttttaatccatttaattctcacaacaatgctgtgagagaggtaatatccccataagtggggaaactgaggcctagaagggttatatttgaccagtaccacagagctagtaagcgacagagttgagattcaaatcggcataatgtttccagaatctgttgcctccgttttttactgactcttgaaagaggggttaatatggtacatgcatagctataacacaaacagagatgctcttttaaataacattaagttacaagacaacatgcaaaatacgtgagtcgtcattgtggagggaaaggaatattggactgccatccactagttctgtgaccttgggcaagcaacataacctctcagtactttagtttcattatccatagagttcaaaggtcttttgcaaaagttctgtggattacatttttttttctttttactaatttaggctttgtttccttgttgtgtttagatttaggtatctactgcagattaaattacatcttttgaaaattttgattttccacttaggttataccagtgagttagttatagctttgtatgtgatactgtaaataactccattatttgtgctttattatgtgaatttggacttgtatagaacaaaccaggtcctcttaagcataaacacattctgtaatcaatcaattctatatttattgggcatttactatatatcttattctctgctagaccctgtaaaatcttggtatgttagtcaatatattagctttggttctgcactcaagaattcttacagaaatgttcactgtttggtattttgatacatagtcttgaaagtctgtccatttttgtgaaatggcaaaatatcaaaatgacaacattttaaaacattttatttttgtgtcagagtagagacaaacactgatttcaaaaatttcaaaattttacccaagacccacagtaagaaacatatgacctatgtgtgtctaatgtatatgtaacagacaaaattttcatgaaacaattatttactacatgtgactcactgtaatactttagttctagtctatactattttgtgcaaatgttcattgcagtctatcaagttaacctcacaggttctaaagctcttaaccgacaggctgaaaatcctacacttgactgataaggcaaaattatgaatgctgttgttttagtgatttttttttttttttttttttttgagacagagtcttgctctgtccgcccaggctggagagcagtggcgccgtcttggctctctgcaagctctgcctcctgggttcataccattctcctgcctcagcctcccgagtagctgggactacaggcgcccaccaccacgcccggctaagttgttgtatttgtagtagagatggggtttcaccttgttagccaggatggtctcaatctcctgacctcgtgatccgcccgtctcggcctcccaaagtcctgagattacaggcgtgagctactgcacctggcctgattttttagtgtttttttttttttttttttgagacagagtcttgctctgttgccaggctggggtgcagtggtgctatcttggctcactgcaacctctgcctccctggttcaagcgattctcctgcctcagcctccctagtagctgggactactagtgtgcgtcaccatgcccaggtaatttttgtatttttagtagagatggggtttcacatgttggccaggatggtcttgatctcttgacctcatgatctgcccgcctgggcctcccaaagtgctgggattacaggcatgagccactgcactcagcataaaaaggtttgtgttttgaatgaacatttatttccttttttataaatgaggatttcgtacattttactaaaagggcagaaatgtgcttctccttttctttgaagtataatcttttgaactttatttttacacaagattacttgaagaattaggttgcattattatataagctttagactgagtcatactgtgtattcatatcacaattttttaactaaattgttttttagcagattatagcagtaggataaaatgcacatttttaatgcctgagctcccatcccaaacagcttcacacatagtctcattaaaataaaaaatcctgggagagtgaagtgtgtccttatttaaagaacttctggatctatttttacccttgtgaggctgattcttatgaggcagtttgcacagtgactcagcacatgggttctagaatcagacttccattgttcaaatcttagctctgtcagttgtaagaccatgggcaagctagttgattgatctctctgtgtctcagttttcttgagttacctcaagagggtggttataaccattcaaaatattaacatagagaaacaggacatatagatctataaaactcgactttattttaggaaagggtagaattaggatgtctgcagatggctccattgttcgttcttaaagatacaatgctgaacgctctcatgcgcatgatttttctcttgagtgctcgcccttccaattcaacagctcacttatttaattggcctaagacttaattcccctgcctctcttcctagctccaactttcatgaagcttccttggataaaaatcttagcaacagattatcctctcgcaccccccaccccccctgtgctccacagtttctgagattccaaactaatcctggcagggaaaatcaaggaaaccttcatataaggatctcatatttgagtgtaagctcacctgagcaggagggcattccaggcatgatcagcttgctaagtaatacaggaaacaaaaagttcagccagaatacgaactcctcattctagtagaatgatgataaaacatacacagataacttcaatactgtgaaggatatgataaatgtcatgaggatgacccaaagtgctttgggattcagagagtgagaagtaacattcataggaagttttatgaaagtagagacatccaggctgttttaaaggatagttaggagtaccagagggctttagggtgggatgaggatgaccaggcaaagggcattctaaagtcacaggggaaggaaatagaggatgtattgaggaaaagtgagaattcacccatgatgagaaatatagagagtaccacagattggggaataggggctgataagattggaactatccaggttttaaccaagtgatggaaagccttacatggtgggctgtttgggatccattaaagaacttacaagttaatagcttttgcttgaattctgcccaaagataaattttttaacttgaccagtaccatgttgcttttaaatggcttttttttgttttgttttgttttgttttgagatggagtctggctctgttgcccaggctggagtacagtggcgtgatcttggctcactgccacctctgctgcctgggttcaagcgattctcccgcctcagcctcccaagtagctgggattacaggcccccgccatcgtgctcagctaactttgtatttttagtagaaatgggtttcaccatgttaaccaggctggtctcaaactcctgacttcaagtgatcagcctgcctcggcctcccaaagtgctgggattactggcatgagccactgtgcctggccgttaaagttcattttaaatttttattttaaattttagtatttaaaaatcaggggattttacattacaacttagatttcctttttttcctgtaaaacggagatctgaaagtacaaggcccacatccctgcatgacatgtgagcagaggcaacatcctttggacagggcattctttgctttcagatttacaacacagtatatttgtatatatttataccaggctggcctccctcagttatgttgcctgtctgtctcctataggcatttggatattagatttctgcagtagagaaatgtattagaagtcaaaaatagttactgaaatggcattaaaaaaacagccagtatgaaccaagtttccatcagataaaaatatatcccaaataaatatttgcacatcaagcaaaactgcaatcaaaacaaatattgggatctagtatgcagaaaattcaggaactcagaatgtgcttagtaaatggggccaaaaagatccccaaagaatgtcacttccctgtgtctatgctcctatttactgctcttccaatgactttgggcttttccatgtgatttactttgaccaatgggactgcagcaaacatgacccaaccagaggcttaaagattgcttgcacgttggtgtctgtgctcgcttatcacgcaaagccctggctagtatattggagaatgagaagccacgtgaagcagagacagaccatcccagctgaggcccctataccagcctgactactgccagccagatgtgagtggggccatttagaaccatctagccttagtcaccccaccagctgactgtagaactgcctggttaaccacaagctaatgagcaatataaaggatgttgttttaagccactaagttttggaagggatttttgcacagcaaaagcttaggaggaagctttgaagatgtagcccaaaaatgacgttgtaaacctccagcacactagctactattaattagcctacgagagagaatcttctaatataacatctataatacctaagagaactgaactatatatttgagaataaatggatatgctggagtatagaggggtttgtgtgtgtgtgtgtgtgtgtaatctagaacaatgatcagataggagatggaggtgtggagattgactggctggtttcaagaaatgatctcagaaacagcttgacccctgggattcctctagttccctgattgtatatccgtaaaacctcttaccgaacccaaaattatttttctgatcatcttgataatacatttattataatttcatttttacattaatttctatagatatttgtggggttttcttgggatggtatactactaattatttggtttttcttttggggagcgggaatgttgatttaaatctgtatccacatggctggattaagactaaactcacttttcaggcattctcaaaagggaggaggttcactgacagcacgccccttctgatatcattagacaacttactggtacccttggtggcttctctgaatcctgtctatgggtgccaaaatacagggatttcaatatgggggaaagtaagaatttggagtattcccaggcattttgtgtgaatatctcccagcatcttattcttttaagtgtgacggctaagggatcatcaggacctactgatggtcttccagagatcatcaaatctggctaaatcttcaaagcttcctcctacagttagcttttgctgggcaaaaaaacccttccaaaacatagtagcttaaaacaacatcctttatattgctcagtacctggtgatgatcccttagctgtttatcagatgatcttcagggagtttgacagtcccatagggaaagtgatgaaacaattttaaaacgatatttaagaagtttgaaatgtaaaatatacttatgattttaatgaaaattctgttatatcctcaaatggaattataatcttaaaagttatgcttttgaaataaagacagtattggccatttcatcttgtgttttttttttttttttttttttttttgagatggagtcttgctctgtcgtccaggccagagtgcagtggcgcgatctcagctcactgcaagctccgcctcccgggtgcatgccgttctcctgcctcagcctccccagttgctgggactacaggcacctaccaccacgcccggctaattttttgtatttttagtagagacagggtttcaccatgttagccaggatggtctccgtttcctgacctcgtgatccacctacctcggcctcccaaagtgctgggattacaggtgtgagccaccgtgctgggcccgaccatttcatcttgattaaaattgagttaacagagtttgtttctcctcgtctgcctcatatcgttagtgaattatatcttttgttaaatttgcttttcttgttccaacaggattacatgatatctctacctcataaaatgaatcaatctatctctaatgtggcttattgatgcctaaaatagaggtgaaatagtaacataatgccagaactcagaataaggtcataggccaggtgtggtggcttacacctgtaatcccagcacttttggaggccaaggcggaaggattgcttgaggccaggagttcaagaccagcctgggcaacttagtgaaactttgtctctacaaaacaattttaaaaaatcagaataaggtcataaatataaatactaaacagaatttcagtgtaaacaaagtagtatatgtattgggatatgaatctctgagtttgatgattttgtataaacaagcaaagaagaaaacataaatagaagatacatgattaatatctgcaaatttgattttatgttattttctagtacttggtgtgttgtatgttataaaattttgtcaaatagtagcagaaactactgacacctttgtattgctttcaaagtatcataactactctggaaaaccagttatgtttttttcctctagggcaaaggcaagtaatgctttttcttggtgtgtgtgtgtgtatggggtgtggtgggacagggatgaaattgctgcattttgccactaaaggaagagataggacttagacagttcattcacagatggactctttgaactaaaaatggtatatgagagcctgcatagcatgttgatgaagatcatgggctgcctgggttcaaatcccagccttcttacctgcggagcatgttgattgattaacatcatgggctgcctgggttcaaatcccagccttcttaccagctgtgtgtacttggtcaaaccacttcatttctgtatggctcagcttcattttacttattgagggaatagtagtaatatgtactatatatgtatgtttgttatgagaattataggagttaatatttgtaagcattagaagagcatgtagattggccaggcgcagtggctcacacctgtattcccagcactttgggagctgaggtgggcggatcacgaggtcaggagatcgagaccatcctggctaacactgtgaaaccctgtctctactaaaaatacaaaaaattagctgggcgtggtggcggacgcctatagtcccatctactcgggaggctgaggcaggataatggcgtgcacccaggaggcagagcttgcagtgagctgagatcgcatcactgcactccagcctgggcgacagagcgagactccgtctagaaaaaaaaaaaaaagcatatagatcatggtaaatgctatacaaatattaagaacatgcattagaactaaataaaaatgtctatgagagggaaatgttttttataaagatgagattacgcggctgggcatagtggttcatgcctgtaatcctagaactttgagaggccaaggcaggtggatcacctgaggtcaagagttcgagaccagcatgactaacatggtgaaaccccatctctactaaaaatacaaaaattagccaggcatggtggcgcatgcctgtaatcccagctacttgggaggctgaggcaggagaatcgcttgaacccaggaggtggaggttgcagtgagccaagatcatgccatcacactccagtctggtgacagagtgagactccatctcaaaaaaaaaaaatgaaattatgattcacgcaaatataaaatgagcacttatcaacacatttaactttggttgaaaggagaatttaaagaaccatacatatataggcaataaagaatactgaaatgaatttacaagtaatgtaaaataaatgaaaataaatataaattgtcctcaagataatactcagttgtattccagggaatataattcatgtgcatttatatggacaataattcacattattatccattttctgcagcttacagagttttaaaatagctcaaagacagtgaaaggtagagatcaccgtgataggtaagctatacaggacacccactaatttcttggagtgagctcatatcgaaagtttttcacattttctctgacatgtattataaacaattataaatgtaatcattataaacaattataaaaccagtgcaaacttaataataaatattaccctcagaggaggaagtagaagggacatactttttccccaaatatgactttttgaacagcatatgatattgacaaagactgtctctttaaccaaactttagttaggtccctctggacaagcccttttcttgtctagaccctgtccttgtcagaccttcgttgtccagtttgagcaagaatcttgctaagtcagtttagagagaatctcctatcccaaatatctaacatttcggtatctgatcaaattcctgatcccccaccatcccccaggcaacatatgatcatactggcctaccttcagcaagaatcccatcttacccctagtgtttcctcttagtgatttttccatccattgaccccatcctgccccttggctataaattcccacttgttcctgctgtatttgaaactgagctcagttcgatactgacgtctcttttcctctattgtaatagtccctgaataatgtttttactgctttaactgctgtccagctctagttcctttaacagttaatggtcctgtgatacgggtaggattagatttattattggattcctggatctctcatccaggactcagctgtatacctttgaagcctttgtcttcactcctgactgattgatctgggatctgttgatgagtctgactcctaaaccattgccctacatgacagttcactgaagcatggtaggaacagatattcatacttaagattctgagtttactggttgaagttgggttagagacctatgttttttttgaaaggtactactgggctggtagtctttcttcatggcttttggttccaagtggggattcacatccagaatcctgagatggaaatggtttctcctggcactctgtgaggtctccctgttctgtttgaacatgcttctcccatgggaacttattagttgactgaaaccctcttctcaaggttctgctgactacagtagtctcccctgatccttagttttgctttctgcagtttcagttaccagtggtcaactgtggtctgaaaatattaggtagaaaattccagaaataaataatttgtaagctttaaattttgtgctattctgagtagctttatgaactcttgtgctatctactccatccttcctgggaagtgaatcatcctttttcagtgtatccaaattgtagatgctatacagccattaagtcactttgtagtcatctcagttatcacattcactgtctgtgtattgcactgccggtgttcaagtcacctttattttacaaaataatggccccaaagcacaagagtagtgatggtggcaatttagatatgccaaagagaagccatgaagtgcttcttttaagtaaaaaggtgaaagttctgtactcaaaaaaaaatcgtatgttgagatttactataagaacaaattttctatgcgtgaaattgtgaaaaaggaaaaaaatttgtgctagctttgctgtcgcatctcaatctgcaaaattacagccactatgaatgacaaatgcttagttaccgtggaaaagacattaaatttgtgagtgtgagacattaatagaaatgtgttctgactgacaacagccgagtgtaatactatctgcggtttcaggcatccacgaagggtcttggaacatattccctgtggataggagggactactagtatgtgctcctctaaatctgtttacttattatttgacaaggataatttagaacttcactggcttctctaggaaacttaagatctttccaaagtggctcctctaagacctctcccttcccattgcttctgctcctccttctccccttgccatctttgatttcccctttaattctcttgaatcttttgatgtttcccttcaaagccttacctctttcatcatccttctgtccatatctgccagactttttcttccctacttcagcttctcagctccctataggcacttgaactttaagcacactgtccctcgttgaaggttttcaagggtctcaaggatccccaaaagcaaccacctgaggctataaaggaaaaaacactaattggaaacactgaatattttatccagtcagatgggctttggagacatccttaaagctgttcgatgtcacctcagttactgcctaaaatttggtccacagcctccataagattacatgggaaaatcttaaaaatcttctctataaatattattaaaaaacattaactctcatatagaacaggtaacctaatttgttccatttatcaagaatacaattttgacaaaaatgtagaccaaagataaaactatattactttgtttacttgattaattgctaaagttttagaataaaagctgtaagatctgtttgcggctatctgcgtatttgtttgtatatgtttatgtatgtatgttatatatatgtgatatttttctacctaaggatagtattaccagcataattcataaaatctcataaggaagcactattcaaattatcttagagattaatgaactcttatataagttaaatattccaaaaactcccagaaatgtggaaactaacccaaatgtgttttaaagttcatacgggctggatgtggtagatcacacctgtaatcccagcactttgggaggccaaggcgggaggatcacttgaactcaggagttcaaaatcagtctgggcaacatggtgaaacccatctctaccaaaaaaaaaaccccaaacgcacacacataaaaaatacaaaaattagcctggcttggtagtgcatgtctgtagtcccagctactcaggaagctgaggtgggaggaacgcttgagcccgggagttggaggttgcagtgagctgagatttcaccactgcactccagcttgggtgacagagcgagaccttgccccctcaccttccaccccccaaagaagtacatataactttgctaagtcttcaataaataagattaatattattggtttaataaaaatgggtttgtcttaatgacttgtcagcgttaagtataatgtgggcatgtttttattctacttaggtttgctgatcagataaacttatgtctactagatatttaagattataaaaattataaatttcacctaagaaccactgtacaagtaaacatgcactaacattgaattgctttatagccatgacttcttgtatatcaagcatagcagtaaaacaaaaatccatgtgtttaacttttttaggtttttgcttttataatactttcctaataaatgcatatgttgtagaaatcgttaacagggaaataacttgagatgttggctagctttgtttaatgttatagtatgtctgcctggaaattgtttttaaaatctttttagtaatttgcaaccttagacttacattacattacattaatagatattcattaaaatctacataatttctaagaaatataaatgactgaaatactaatgctaaacctaagtttgagtttatatactttggctttttattttcatatgacataaagaaactagatataattgggcctgttaataaaatgttcttctgaaagattacactataaagaaacaaatatctctaggaattgtaagatgatatactcataaaacctgctagtttgctatagaatgctagtatgtgacacagtttacagctgtctccttaagttttctttgtaaaagtgtattggtcgttaaaattacatttaatacatgtaagttaaactactaaaaataataagtgtgaggagaaacaactctgtatgcaaagtatgtgaggaatgaaggacttttttttactgttgataagggaaaaagagtgtaattttgtcttaaaataagattactggttattccagaatgagaaagaggaaaaatgtaggacgaaatctgaatggatatggaaaactgtaggtttgcagaaaaggaattctttatgttttcaagctggctatgattaaattgatttctatataaagtttttttttaaataacatcagcccaacagtgtgctaatataaaactagaacttggttttatttctgttaaagcaacaaagttttcttggaatattggtctgttcttagtaagagactgtgaaaggtttttcttttttttttttttttttcttttttgagacggagtttcactcctgtttcccaggctagagtgcaatggtgcgatctcggctcactgcaacctctgcctcctgggttcaagcgattctcctgcctcagcctcccgagtagctgggattacagacatgtgccaccacgcctggctaattttgtatttttagtatagacggggtttctccatgttggtcaggctgatctcgaacttccgaactcaggtgatccgcctgcctcggcctcccaaagtgctgggattacaggcgtgagccatcgtgcccggccgcctctttaccttttaagtaatctgcctagggaacaaaaattctgtgccttatcaaaataatttattgtgctttgtgttttctatgtcatctccttttaagagaacttaactattgtttcatagttatcgaggatcctgtttaatcagcattcaaatcttttgacatttttgagttttccaaaatcaaattctaaatgaattctttttttgtttgtttgtttgagatgaagtctcgctcttatcccccaggctggagtacaatggcgcgatctcggctcactgcaacctccacctcccaggttcaagcgattctcctgcctcagcctcccgagtacctgggattacaggcgcctaccaccacgcctggctaattttggaatttttagtagagaagggggtttcaccatgttgaccaggccggtctcgaactcctgacgtcaggtgatccgcccaccttggcctcccaaagtgctgggattacaggcgtgagccaccgtgcccagccctaaatgaagtattaatcttggactgaccttgagatttcccataggtcccctggaaaatgtcaaaggattttttctttcacctagtaaaaattttgtttgtttgatatattaaattatgtgggaaacattgtcaagtaaaaagtgatgcttaagcttttctaggttatatttgtatgggtaaatattaataataaaacattccagaaattatgtgaatttcatagacatttgccaataccctcattgtccatcatatgttctggtatatactgttatcatcataatgccaactattatttaaatatttaaatattgtgtgtcacaaaaataaccaaattccctcaccagttttatcatttttataatgaacagatgtttaaccacagacattttaagtcttttattatccacagatagtttttcttttactctgattcttcctgaaagcttccataatcagcttataagccagaatgcttcattttcaacaaaactgattgtctcagagacctgtggaaaggactatgccaggtactctggggtatagccttctaatggcattgcttagatacttgtagaccataccattggaatgagtatggatttctgcagctagtagagaagctgacgggttcataaaactgctaacgcaggataaagcagaagattcaattacatggggccgaataaactaataaataagataatttttatggttattgttttggaatatttatcattctttaatgtcttatttaaggagactttttttctgttgtctcatgctttctataactcatgacaatttagtaggttatgcttttgtaaaaagagatgaaacatattttcttccaacctgatccctccagaattcagaaacacttactgagtattcttattctcaatggcaatacaattatttggataagttcaataagattctgtcttccttgtaacagggcatacttggaaaaatcagtttataaccaaggctttgactggaatgtcatatttgagaatgatgcattgaatcagatacgtccagacagttttaaggcacaaagactttatggagtcaatgcttacaaagtcctcttgggaaaaccggcctggtacctggcttattgggcaggggttcccaatccctaggtctcagactgggccatacagcaagagttgagcagcaggtgagccagcatcttccctacccccagtctgtggaaaaattgtcatccacaaaactggtccgttgaaccaaagactgctgttatagggttcccagccttataggtgggtaaggaaggtcacttcctggcaggtccaggaagcttaggatattttgggaacctcacaagagaggaattcacccaaatctatagttcttataggaaaaatatggtagtgcttggcttgacttttaatcttcaagaggcttttagaagcctaatatgaaggtcaggcacggtggctcacgcctgtaatcccagcactttgggaggccgaggtgggtggatcacgaggtcagaagatcaagaccatcctggctaatatggtgaaaccccatctctactaaaaatacaaaaaattagccgggtgtggtggcaggcgcctgtagtcccagctactcaggaggctgaaggaggagaatggcatgaacctgggaggcagaacttgcagtgagccgagatcgtgccactgcactacagcctgggcaacagagtgaaaccccgtctcaaaaaaaaaaaaaaaaaaaaaaatctaatctgagattcctcataaaaaattccagtaaaacaaactcaaaaaggcctaagtggtcatttttgctgcaattatgtaaataaccaggccaaatctaatgagaccagacttattttgtaaacaagagttaaaaaaggaagtgagtggagagaaaatttatgcttaaatggaaaactatagtgtacccttgtgggttattaaattctagtcctgttcattttttttttagctttccgttgtcaacctataaactggactggatcctgccatcttatgcattttctcaattattctagtttcctctgatagcctactacaagtttccaaactaacatttctaatttttccccaccttcctcacttggcatcactgagaactaaaactatgcttttcccaaagcccaggaagctgaagctgtaccacttggtataagctgaagaaatcaccacaccttttcatgtatgggtaacttcatgagaatctcttctttccttgaacaataagagggactgacaaagtctgtcttcttaagcaaactttaggcaggtttctctaagcctttttcttgtctaggccccattcttgcaatacctgcgtagcccagtttcagcaagaatcttgctaagttagttaagagaaaatctcttacccttgatatcagatcactcttgatacttggtcaaattgctcatcccccaccaggcaatatgtgatcaccctgacttgccttcagcaagaatactgttcaggctctataaccagaatccccctatatttcctcttagttatttcccatccactcacctccatcctgctccttggctataaatccctgcttgttattgctgtatttggaaatgatcccagttctatactgaggtctctttccctttattgtaatagtttctgaataaaatctgtttttactgctttaatcacttccagttctggttttctttgacattatcagaaatatataatatgaaagagcaattactgtcatgtgtttacactgacagatatttcagcttgcaattgtataaaaccagtgatgtacaagctgagttggtgctttgtgtacatagagaatgtccatgagggcgatatacttggcaactttttgtcttatttattactgaaaacctagggtatggaaaaagatacattgagatctgtgtgtgaaaaggaaggcaaggcattgctatgcaaataaaagaggtggcctctaagtggtaatttatattgttgtatttgcaaagaatagttggtggtcaaaaatacttcattaggttttgatttactgttgaaggaaatactgctaattattagtcctatcaagctgtagcctttaagtatgtacatatctttttggcatactatgtgaggaattgggctgtaagtataatctgactgttgaggaaaaaagagcctcatgttagtttttaaaatgagagacaatgaaaatattccctcataatgctgataacttgagtaaagaccattttgagtaacttatttgagcaacattgtcacagcagtatatttattcaataaatatactgaattgcttgaacctccacttcagtctcaaaatattccattttaaaaatttgcagatgacagattagagtttcttttgaaacaactgaacggtggtataaaaatggtttaaacttcaatgttttcccatacctttctttttttttctttttttttttttttttttgagatgtagtctccatctgtcgcccaggctggagtgcagtggcatgatctcagctcactgcaacctccacctcccaggttccagtgattctcctgcctcagcctcccaagtagctaggactacaggtgcgtgccaccatgccctgctaattttttgtatttttttttttttttttttagtagagacggagtttcaccatgttagccaggatggtcttgatctcctgacctcatgatccacccgcctcagcctcccaaagtgttgggattacaggcgtgagccaccgcgcctggccctcccatacctttcttttataatttctttgcttttgagaaagaaacacatgacttattgtctcatatgtttaaaaattctatcactgcaaatgtgagttacttacataatgcttcatgagaaaatgaaataatacttcttagagctaaaagcagttaaagaatgattagaaaatctatttactctgtttcccatgttgaaatggtctttctgcattcgtgataagtctgtcaatttaatgcctgatagagttctgaaacatcttcagtgatgaatctttgtaatttctaggttcacaatagtctaaatatccatttgtctctgacaaagccaccaaatgtttattgtcatttaacaatcgttaatggagaatcaagagtttataatttggttaatcacaatagaaactagttggatgtggaactcaaggacttgtggctcagagtccttgtcattgggtcaggtgttgacaatttgataacagcacaaacaaaatatagtctctttcactgataagcaatagtaataaatatgatattttatttaaaataaaatattttgaaaaagtatcttagtattgtggtccatgaatgctgaatatggatgctgaaataatatttgtcacctttgtaaaaaaaaaaaaaaaaaaaggtagttttggccaggtgtggtggctcgcgcttgtaatcccagcactttgggaggctgaggtgggtggatcacctgaggtcaggagttcaagaccagcctggccaacatggtgaaaccccctctctcctaaaaatagctgggcgtggtggtgggtgcctgtaatcccagctacttgggaggctgaggcatgagaatcgcttgaacctgggagatggaggttgcagtaagctgagactgtgccattgcaccccagcctgggcaacaagaatgaaactctgtctcaaaaaaaaaaaaaatgattgtgtttgttgatcacttactatgaggcaaacattctaagtgtaatgaactcacttacagtggtttacaaactgatgcatggagagaataatttatccagactcacccagctgttaactggcagaattaggattttaacagagtcagtctggtaggaaagtctgctctttcccactatctggcagagataaatagtactgtaggagtccctgagaggtcaactcaagtgtaagtattttatattttgaggttcctaaagtttttctctatgtcattaacatacaagttgcccacattattctccttgtcattattactacaaccagtgagtattttgatagaatacttctgggagaggcccaggcgcggtggctcacgcttgtaatcccagcactttgggaggccgaggcgggcagatcttgaggtcaggagatggagaccaaccccgtctctactaaaaatacaaaaaactagccgggcctggtggcgggcggctgtagtctcagctattcggagaggctgaggcaggagaatggtgtgaatccgggaggcggagcttgcagtgagccgagatcgcgccactgcactccagcctgggcgtcagagcgagactccgtctcaaaaaaaaacaaaaaacaaacaaaaaaaaaccttccgggagagaagcggttactaagaagggaatgctttatagacagagaaaggatcatttttatggtcatagattattttctagtcttggccaaatttttttttttggggagggtgtattgtggtccaaagacaatttaggtgactcataacctatcacctctaatcccccaggtgtctcaagattgcatgctcatgagagtatctcagtgagtgaatagcagtgtctcctctcattaaaaatttatgcatatcataaatacttttaaaaatgagagtgtctcagtgaatgaataacagtatctccttgtatgaaagatttacacatatcatactttaaaaagtttgagtttaatataaattcaaaaatataaatcagctttcctgtaagtatattaaaaacctttttatgaatagcaattcaaaatattttaaaacatttattttgcacagcttttactagatttatcttattgctattttgttcaaaataaatggaaactcaagtttatagtcttgctctaaatcattttttaaaatatcagatttcagaaagtaacgtttttggcttattttagatatacctgcttgctggctgttgtgtgttggggtagagctttctttttaaaatctagtagcaccctctagagcaaaaggtaaaatacaatttgataagaaaggagcagtttcacaaattcaaatttcctatccggagtaatagtttgttacttagaagtaccaaagagctggccaggcatggtggctcatacctgtaatcccagcactttgggaggccgaggtgggcagatcacttgaggtcagaagttcaagaccatcctggccaacactgtgaaaccctgtctctactaaaaatacaaaaattagatgggcatggcatggtggctcatgcctgtaattccagctacttggttggggggtgggggggtggtgggggagaggtgggcggggctgagggcagagaatctattgaacccggaagacaggggttgcagtgagccgagatcacgccactgcagcactccagcctgggcgatagagtgagattccctctccaaaaaaaaaggaagtagcaaagagctgaacctaatttttttttgctcaaatatatatatattcttatcaaggatgccttttaggtaagttcttcttacctaagattaaagattaatacatctttttcttacctccttgtgaatgtaatggtacataattttattttagaatggatattttaataaaattacccataagtattgaatttcttgttgaccaatataacatgctaaagttttattgtatgtccattttgtatgtgatagtgtgtttgttttgagaattacaaaatagagaataaaccacaccccttgtacttacgctcttatttccacttgttttttgtagtagagcatgacacatattgggtcttgtagtagtcttgagtaaaaaattatctcgattaagttaattaataatattattattgatatatatccattttctattacagaagaaaatactcaggaaacatcccaggtgaagaaaagtttgactgaaaaagtttctctctatagaggtgacatcacattgctagaggtagatgctatagtcaatgccggtgagtagttgattttcctgtgatgtgtttgttatgtaagtattatttcaaaatttttaaataaataagaatgtaagtattttagaaaaaaatgctttttgacgtagaaatgtctattctgtttctcttcttgattaaaaacattggagatctatttttttgtatgttctgcaattaatgtgcatctacagtaccctctacagtgaaaggcgctaggttgagattaggatactgcaccactggagaagtgacagattgttgcagaaagttcttcagaaagaactttagcaagtatattattgttactttcgtagcttgaattaatagttggccaacataaatacaagctcatcaagcttttttcttcttttgaataggttgtcaggtgatgattgaactatgtaagacaaaagtgaaaatataaagaaattatttcagttatttcaaaacttaagttgttagggttccagttttcattttcattatgaaatgcttaattttaaccagcatattttaattatttttaataattagttgtctagttaattttcctatttcaacattgggaaaaattttacagatgttatattttattatgtggctatatatcaaaaaagatataacagccgtgattctacaaaaatattgtaaatgagaggatatttaatgattttaatttgtgttttgtaaagttaggctgtttgaagtttgcaagtgtcaattaaaaacaaatctggacttaggtaaggagaggctttatctaaatagactatgacaataaaaggaggaggatgatttcaatagggggaggcagaatattgtgttatcgggaatgtttttccagagttcagctggttctggggaagggctgttaaggaggggttactcaccttccattgcttcagggtggaccaaagttcaggggttttgaggaaggagaggagcctgactaaagtttggtcaggtcgtttgtgggcattgaccaaccagaatggtaaatggggacaaagagtttggctaacatgtatgagacagagaatgggaatttggaaagtctgtttctggccttgtcattggttgcaaggtggtcatctgtcagttttatctagtaaactttcccagaacacaaaagggtaggggtaatttcttgactgtggctctttccaagaatacagagttcaggtgagtttcagtgttatctccaggtttcctttggtgataataaattcacagagaatagtaggaaagtgcattggcaggtgaacagaagggtctaatggagaactgaaacattgttcaaggatattgtacagctctggcaatttagcagaaagttcagaataccggtcagcttgttgttcccttagaattgggtatcagttacagctgggtgcggtggctcatgcctgtaagcccagcactttgggaggtcgaattgggtagatcacttgaaggtaggaattcgagaccagcctggccaacatggtgaatctcatctctaccaaaaaaatacaaaaattagccaggtgtgatggcgagtgcctgtagtcccagctactcgggaggctgaggcaggagaatcgcttgaacctgggaggtggaggttgcagtgagcagagatcataccactgcactccagcctgggtgacagaattgagaccatgtctcaaaaaaaaaaaaaaggattggatgtcagttgctttgtaccacagctgctttgctgtaatcaaggctcagttttctccttttcttcttctgatgcttctgcacttcctttctcctttgctgcttctgctgcctgtctaaaatgtaaaagtcttcttgagagaggaggctgggtcatttaattgccacccaatatgactcactccttcatcctcaggttacctcatagggtacaggtctctcttatatgtagtatctatggattgctcatttgtggccctgggtatcaagatgctttctctgtcccgtggggcctctgggggaagacaggcccttagaaagggtctcaggaagtcctctcctgtagttttaataagatatcactatagctagtaatttaatgtatatgccctaaattctataaatatatgagctttaattttaaaacatttaaaagattatatgtgtgtatatatgcataaaagatatatgtgtgtgtatatatacataagagagatatatatacacatataatcttttatatatatacacacatataaataaaagatatatatacacacatgtgatcttttatatatacacacatatgtatatgtatacacatgatcttttaaatttttaaaaattaaagctctgctgggcgcattggctcatgcctgtaatcccagcactttgggaggccaaggctgatggatcatgaggtcaagagattgagaccatcttggccaacatggtgaaaccccgtctctaccaaaaattcaaaaattagccaggcgtggtggcgtgtgcctgtaagtcccagctactcgggaggctgaggcaggagaattgcttgaacccgggaggcagaggttgcagtgagtcgagatcgtgccactgcactccagcctggcgtcagagcgagactccatctaaaaaaaaaaaaaaaaaaaagttaaagctcatatgtttatagaatttagggcatatacatcaatatatatagacacataaaagatatatatttatactcacatatgatcttttaaatttttaaaaaatgtttatatgtatgtacatatgtatataaatacacttatcagccttcctgtgtgttcttgtaatttctagccattactcttagttctgtcctgaggaagtacaattgatcatatctacttcctttttaaatacttgaagatcactctcacaagttttctccttcttgttattaagataacattgaatttgccacgttagcacacacttaatacagtaataatggtctttgttggattttgctgtcttcccatggaagccacacactagtgccattttctctttttgtgtcaactccccaagcaatgtcatctccttcttaaaaatatttaatactgtgtatttgttaaattgaattatttaatatgtatgattgaatttgtagatctctgactaataggacattcagcattggaaacgacacagtgaaccagttggctctggtgttttttatctgatcaattaatacaaatattttgggagtaattattgaaataaatggtgcaaaacagaagaacatcattaactacctcatcactattttgttcttttaaatattattatcttgctcttgcctaaatgtataatttttcatagctgctgcataatatataagggtatgatgaatttatatgaagacaggcagcaacttttgcttactcccaaaacgatttggtaattttagctcacctctctggttgtgatgattgtaatttggccatgttttgcatctcacaaggatagtctcatcaggaagatcccaggtagatagaaaagggatgccaagtgaatatacactgtaatggctctatttacagctttctactgtgcagtttgtttgcctggtgtggaaggagtggaacagctgttaacttttcaggtgaacaagacaacatggcaggaaactatagagctgcctctactgagagggggagtgaaaaacagtacccctagtcactatgccaaagcagcccagttgtcacctcctattagacttctgaagttctcatgaccatattagtacattggaacacctggtcttagttgctatgaatgaaatgatttcatattttaaacttatttctaataaagtgttttttgaactaccttaacctctttaaatgtgacccagggtggacttcttgtgtattatattcttctctctaggaaattatgcatatttagtatgttttaataaaacagattttgcaggcattatagtacacagggcagtagcacaagtttagagttaggcagacctgggttcaaaattcaggttatcataaccaaggccattttttatttaaactttttattttgaaataatgatagaaaagacaaaaataacacagagtcctatgaaccctgtgtaaacttctcccaatggtggctttgtatatagctatagtacaatatcaaaagcagattttaaaaaataatttattttagtttcagggagtgcttgtatacttgttacatggtatattgcataatgctgaagtttggggtatgactgatcctgtcacctaggtaatgagcatagtactcaatggttactttttcaaccttgccctttcttttccttcccccttattagtgttgccatttttatgtccatgtttacccaatgtcaaaaaccgaaaattgatattgttacattactgttgtctagactacagactttattcagttttaacaatttttaaacttgcattcatgtgaatgtgtgtatatatgtgtgtagttctttgtagttgtatttaatgaatagattcatgtgaccaccaccacaatctagatacagaactattccattatcataaaagaactccctcatgctggccgggcacggtagctcacacctgtaatcccagtactttgggaggtcaaggcgggtggatcatgaggtcaggagttcgagaccagcctggccaagatggtgaaaccccgtctctactgaaaatacaaaaattagctgggcacggtggcaggtgcctgtaatcccagctactctggaggctgaggcaggagaatcgcttgaacccgggaggtggaggttgcaatgagccgagattgcaccattgcactctagcctaggcaacagagcaagactccgtgtcaaaaaaaaaaaaaagaaccccctcatgctgccacctttgtatttatatccacccatctgcctcccttcctgttttccatctctaaggttttatcatttttagaatggaatataattctaaaaatacataatcaataatgctgcagtgaacatggcagtaccgatatccctttgacatacttttcagtttctttggatacctagaagtagaatcaacagatcatatggcagttttatttttagcttgttgaggaacctccatggtgttttcctctgttaacttacgttcccaacagtgtgcgggagttctcttttctctgcatcctcaccaacacttgttagctttcaacatgacaaaagccattccaacaggtgtgaaatgatatctcattgtggtttccatttgtgcttccctaatgattagtggtgctgagcattttttttcatgtacttgttggtcatttgtgtgtcttcttctgagaaatgtctgttcagatcctttgcctgatttttaatggggttatttgttttcttgctgttgagttctttaagttctttatatattttggctattaattccttttcagatgtattttttgcaaatattttctcccattttgtgggttgtctcttcactttgttaattgtttgctgggcagaagttttttagtttgaggctgtcccatttgtctgtttttgctttcattgccacagaaattgaacttacagtagagagtatggttaccagaggctggagggggattggaggaaggaaatggggagttgttgatcaaaagtttcaaagttttagatatacaggaggaataggttttgagatttatctcatagcagggtgactgtaataaataataatgtattatatatttcaaaataactaaggaagtaaatcgcaaatgtctcaccataaagaatgatagataagtgaggtgatggatgtgttaattagcttggtttaatcatccacactgtgtatatatatatcaaaacatcacattgtacctcataaacgtatacaatgattggtcaatcaaaataataataataataaagtcatgtaaatagaatcatacagcatgtaatcttttaaggttgccttttttcactaaatataatgctctgagggccattcagattgtattaatgaattaatgaatttatttattaattcagtaattgttcattcctttttattgttgagtagtggttcattgtatggatgtaccagagtttgttcaaccattcacccattgagggacatttggattcttttcagtattttgctgttaccgataaagcttttatgaacatttatgtacatgtttttatatgaccatacatttttgtttctctgggatagacatccaagaatgtgattactaggttacatgtaagtgcatgtttagttttgtaagaaactgctaaactgtttttcatagtagttgtaccattttacattcttaccagcaatgtgtgataggttcagtttttctacatccttgccagcatttggtggtataattatttcttatttattttagctgttgtaataggtgtgtgttaatagctaatcatgttttttgatatttattttttatttttaaatttttttctctgctgtttgaatcagcatcatcattattttaatttgtgtttccccaaaggttaattatgtcaaacacctctccatatgcttatttgccacctgtatgtctttttggtgaaatatcagttcatatcttttgccattttgtaatgggtctcagtgatatttgtgaattttgggcatttttattttttaaggccccaccctaaatcatattgatatatactgaaatatactacagcccacatccaaaacagtccatacttagttggatgatagttaattagttaatataatggcatgttttgtagatatttaggtaaacattaattttgattttgtacttttcatattttggaaacctaaattatctttttctaggctcttgaaaagctttttggtattatgctcatagtactaattataaactgccctgctgacatcagcttgattgggcaaattattcaaccctttaatcctcacttttgaaatctataaatagggataatactagtaattaagatcagacagatgttgtaaataatgtgtgaaaaatacgtagcacagttctcgcacaaaatatgtacttggtatagtttagctatggtatttatttttgtatggctactgaatggatttaatactactgctgtcttttctgagagaactcaggttagtagaggaaacggaggatatcttctgtgttaagcattgagattttccattattcagagccagttttccgctgaaaagcactggtgctcaagctagagcagctgctttcttcctgagcagttttcaaaattccacatatttttatatggatttgtctagttactaatatataattgacacttacctgtatgtacttttagtttgactctattttaccttattttttaaagacaggaatctcactctgtcactcaggctggaatacagtggcataatcatagctcaatgcaggcttgagctcctgagctcaggccatcttcctgcctcagcctcccaagtgctaggactacaagcacgtgccaccatgcctggctaattaaactttttttttttttctgtagagacagcatcctgctatgtttcctagggtggtcttgaactcctagcttcaagcgatcctactacctagacctctcaaagtactgggattataggtgtgagccaccttgcctggcctttgttttgattctggttttaaataaagtacaactgtctgtacaaaaaagaggtgttttcagaactagattgtctatacgtgatgttcagattctgcctcacaaagcagtatttttgtagaaaaaaattcagtatttactatgagtaaaagtcacactttaaaatcagttacctcatggggatgcttgaaaatattttggtacatatgcttagctctttacggttaaacaaacagattttcaaatgctgcctaaatagaggagtaagaaacactcatttgacaaaaaaaaaaaaccccaaaaataaacaaaaaaaccccaggaaaatgtattgagtgcttattatcagttaagaactaggttgaacagtggaggtaaagacaagtaagtaaacagttgctgtacagcaggatgaagtgtttattagagccacgtccaaggtgccatgggcaaatagagaaaagcaaacaactcaagaaagcaggtgagtgtatattgcacttaggaaaccacatgtggctgagtgtgcttggagcaaatacaggcagaggccagatcatgaagtgctttgtatgtcactttgagggctgaggtttttttttttaaaattttttttttattttttagaagatggggagtttttgaaaacatttttagggaggatatgtgttagagagatccctttggctgcagtgtgaaggataaattggggaaggattaagtttaagggggagactggaagcagaaatgaaactatttaactttgtactaagtacttcagcttaaataagtctgatttttcccctcctagctcataattgtagctgttgcttcttctgactctgccctctttaatggtgggatgattcttggatgattatgatttgaatgcagtttgatttggagtaacctcgaaaagcttaagtctattgtgactggattagagcagacaaatagaatcaaagtgtatttgttctttcaacaactttcttgaattctcaatttgtacatatgacatatcaagacactgctaatctggcttctgctaaactgttttcattaaaactgttctcaccaacgtcaccataacctctttttcttgaagtaatgggcccttttttgatccttgttttcctggatctctctgtagtatacaatactgttgactacttcatccttgaatgttaattttcctttagcttcagtgacacatttggtagtctcctctccttagctatacagccataaccttcatttaaatcacattatttcttacctagactattgcagtacactcctgaatgctttacttgcaaactcacctactctccagatgcagacaaaattatctttctcacattacttctctgtacagccacctttagttgctccccatggcccataagattaagggcaaacttagtgtgtcaaacaagacttgcttcaatatccctgccttgccagtctccagtccaccagtctcttgccactgacctgcaattttttctgtcccccaccgtttttctcatttctccctcccacccactttctctttcccccttttcctcctgggctttgcacaagctgctgcctctacctaaaatattacttctctaaagagtttcccttcctagcagttcctgcctcagtctttcagcatgccagatgtttcatctcctactggaagcgtggattcccctccatccttccaatcttgaatgagtgtcagtactatgggttccttagctttatacacttctgctagcatagcacataatctaatatcagttcacttatgaaggccaccgaaatgatttggatacatttgcttataaaggctttataagatttttaccaaaatgaaatcacaaaattaaaaaaaaattgtgggaaacttgaagatccccaagatcttcagatgccagtgtgagaaacacagccatagaggataggaaatgtaggactcaagtgagagactggaattaaagacatagattaagttagcatattaattttataaatatgattggtaagaggtattgagagctaaatgtgctaaattgttatgataacctaagaggcatatttaacagatgaagaaacatagccacggagaggttaagtgattcacctctggttatacagccagtaagtagatctagagcttgtgttcctagcatctttcctgttgaattctttcacacagaagctatgataccatcctaagccatctatctatattaaatatagataattccttagttgaccttttggctcttggaacactatcaaccaatatgtgatatcaggagtttttattaaaagcatgtagtaattatcatctctattaaataatacctcatgttttagtccttctctgggaatttaacaaccacatcttgtttgaattgactataggtcagttagtgaagtgctgacagtctgagcaggtctggaaacatggcctactgaagtgtagttgacctgcctttgacagttcattgtaactttggaaggattatatccaaatattttaaatgcaaaagaaaaatgttaccttgctcactgtgcaggaatagtaaacaataagatcattcctcttcttttcaaattttttggaagtgtttaatttactagtatgtaggacagaacgtatttacaatcaggtctagataggtataaataaaaggatgaattaaggttaaaaatgtctgtgggtcctagtaaattatattggcacacttttggactgagagtggattattttttctccacgtacagatggattctccatgtacagaagagatagacctggaagcaaatagatacagttcattgtgtataaagtatgtatcgagtactctttgttgatgcaaagagagttagtaaattatttgttttgatctaattcctgtgatgaataaattgtaattttgagtcagaattaattttcaggacctagatataagttattttaccttttttttttttttttttttgagacagagtcttgctctgtcacccaggttggagtgcagtggcacaatctccgctcaccacaatatcctcctccccagttcgagggattctcatgcctcagcttactgagtagctgggattacaggcaggcagcaccacacctggctaacttttttgtatttttagtagaaatggggttttgccatgttggccaaactggtctcaaactcctggcctaaagtgatctgcccatccggcctccaaaaaggattgcaggtgtgagctactgcacctggctagttttaaaaacagtctttgcatatatgccatatggtcagggattttattagttccttaccttgtttgagccatagagctaagaacatacttggtcccttatcttaacattgcatgtcctaaattgtgttttgagagaggataacagatgcatctactaatctttggcctcctgtctttctcccttcttgacatttacacacaaactttgcccatgggaagtttagtgcctttcctagatttctgaggatttgttttgaggatgcttacattttcatgattgcttctttctctgtaatatggttctagtaaatttccgatggccacagtttcctccttatttcttgccattgctgttttctctgtcttccctgcaggcttcatcccacacttagaacaacccaatatttcctctatttcccaaagcactactaatattatgggtagtaggtgtgtactgtaatttaagggttcatcaaacaggcctgccatcttaatgtagctgcatataggattatctgtttacagtgactaggtccttgtatagtcttataccaaacccattggtcaaagagctttggtcttttctagagcttggggataaatacatccatctgatttatggttcagtatgtcattagagacaattttacttgtactgtgccacaatcacagaaaaatattttggagaagatagattgcaggctgtgttatgaaaaacgaatgataactgtctaattgtaattggttggttatagccaaaaattaattcagtttgtcagaaaagtgatttttaaaaatggaaagtgaagaaagttgatttatttattttagctcttcctaccccatactacaaggagaggcatatttacattgtgattaattatagaggacttggagtcagatcaatcattattttaaatatgcctattcaacttcctggccaaataactctgacaaattatttaacctttctgaacctcagttttctcatcagcaaaatggagataatacaggttgaatatttcttatccaaagggctagaagtgtttcagattttttttgggttttggaatatttacatatacataatgagaaatcttggggatgggacccaagtctaaacatgaaattcatttatgttcatatacaccttatacacatagcctgaaggtatttttatacaatattttagaatacttttgtgcaataaacaaagtctgtgtatgttaaactgtcaggaagcaaagatgtcaagtgttgaattttccactcgtggtgtcatattggcacttaaaagcttttggattttagagcatttcggatattggatttttggactagggatgttcaacctgtcgtagagcctatttcacaggtctgttgtgaaaatctaaagaaatgatggccgtctaaagagatacaaagtacttcacacagtgccttatatacagacacatcagtaaatggtagcagaattatactccttagttttaatatttgaaaaaatttttatatgaatgttacaaggtaattatgggtgtttttcaagtcctgtacaaagatatgtgtaagaccaactaacagggtttattctgtgtccttcagctttagctgtgacagtatttacttgaattgcatttaggacaagttgtccaattctgaagttttataataaaagccaagtttttatgacattcttgtaatttgtatgaaccattgaccaaggaaaagaatggttttagtgtacgttaacaatgtgtttttactacattagttgtgaatgtcatacttgtgtcaaaaattgagatgatgtcataagattgtatagataaccatttaatagctgagcatgatttaagaataattgatgtagaatatatgaatttttatataggtaaataacatattaggactgcacaggatgaaaggaattgtacttattagaaatgttttattcacctctacttgcttaaaataaatgttatttttatgtatttgttcagtaaaactgaaatgaaataaggcatatttgaagttagaatttaagttattggggaaataaggttaatttactctcttaaatattttaggacacaattaacagtaactacttgattcagtttgaaatttcatctctactagcaaagcatcaaaagtcatcaaagtcaaaagtcattttgacttttcacaaagtttttgtattatatattttttctcttgactttctgttgagcagtaatagatccaaacacacacacagaaatatatagcttaataaattttgaaaaactgtcacacctgtgtaatagaatccagataaaaaagcagaacgtggctgggtgtggtggctcacgcctgtaatcccaacactttgggaggccgaggcaggtggttcacgaggtcaggagttcaagaccagcctaaccaacatggtgaaactccatctctactaaaaatacaaaaattagccgggcgtggtggcatgcgcctgtaatcccagctactcaggaggctgaggcaggagaatctcttgaacccaggaggcggaggttgcagtgagccaagatcatgccactgcactccagcctgggtgacagagtgacactccatttcaaaaaaaaaaaaggcagcagaatgttaccagtaccccagaagccctcttggcatccctggtaatgaatatagtgaagtgtatttactatcttgacttctagtaacgtggattacttttgcctgtttttgtatttcaggtaaattgacctatatatattctttagtgtttggctgtttttgttcactattatgcttgcaacattgatacataccattggttatagatgtagatgattcattatcattgttatgtaatatttcattgtataaatatgtcacaacttatatatcctatctactgttgatgagcggccttaagtagtttctagtctgggtgttttagtactgcaatgaacatggtaacacatttgtgtgtggtatttttgtaaatagatatctatatatttgtgttggatctatatctgggatattaactgtaaaatcataggatatatgcataggacactgttgtgtggttttcactttatacttccaatagcagtgtatgagagttcttattgctctagatccttgtcaacatttattttctatgtttttaaaaatagtgcataaattaggtcaactggtaatattttcattaatttgtaagatataccatgataaatcaaatttgatagcagtttgtagctaacaatccatgttaagccagcatttgtaagtgaagaaataaaaaatgtaaatgttatggtcatatggccaaggataagaagatggggttgttttatgtagttcctattgagttcatgaaaatacaaatgtatttttctcccatagatggcaacacttaggaacaaataaaccattgtattatgaaggtaatactattattattactactatcactgttaacccttcatcatatgggaagacaaagggaaaaaagtttttggaatgatattctcaaaactacatttggaaaaaaaggtaattttagaaaaatgtctcagaaagtctatttccatatgtgaaatattccataaagcctgtcattttgttgaacatagatattttaaaatcctgcagtataatcttaaagtcacattcaaaataggttgatattaatagtttgcttttgcatcgtagatatgccttattaataaataagattcgtctaatttcttatagtattaataatttaaagatatatcacattaatttttttccaactataacactgatgcatgtttattgagagaaaatatagaatagtataaagaagtaaaatgtgtcaaattttactatccagaaataaccactattaatacttgttttacatccctataggggattttagagactttaaatattatatatagtatatataaaaatatatattttttttattttaaatatatataaatatatatttaaatgtatttatatatttattttaaatatataaatatatagtatatatacatttatatataatatatataaatataatatataatatataaaaatataatctataatatatattacatattatatattatatatgatatataatcatatatcatatataacatatataatataatataatatatatcatatataatatataaatagtatatttatttttgattaatataatcaaaattgacttgacttaagttagttcaagagttttgacatctttaccgtattgtcctcccatctcggactgtggctggttgttagatttattttatcttttccccctgatatttgtcagtacaatttttttattatttattttatctgattattttggtgatataatcaatttgataattgtccaccttactgaagttaattataaaaacttttgagttggttcccttggattttctaggcatatacatttttatgcacactgcttctctgccctttttattccattggctaccacatggcaacaatattaaattagttatcataaggcattcttgattattcccgattttattgggaatgaccatagtattttgcaattcattcaataaatatttattaagtacctactatatgacaggcattattttaaatatgagagataaaatgatgagaaaaacagttataatctaagcccctgagtttacaacctagtgggaaattgtggtcaaagagttatcttaataaatataaaattataattatgtaagtttagcgttgatagattggggcttttgttgtaaatttccttttaaatttggctaattataaggaagcctaagtttccaactataaagcatttaggtccttattagagagagtttgcctgttaggaaagttgaaatgaagttaaagtattaatcacaatgaaatggttattttgtgtttataagcaaagacaaaataaaacctaaacagaaaaacccacctcatctatttttgacccctgtatctctgcttttaagggtctattccctggagttaaatattatagtaacatagtcttccaggagctttgttttggtctttaagagagactaaaagaaaaaaaaaacgtgagacaacagctgcttcggcatttattccatgttattttgagtttttaagcaaatagacaaaataaaacatcaatttctctgcatgatttctttaaaccttttgtgtttttttcttcttgttgactgagcacttaagttcatactttttcatattgctcttttttctttaaaataatttggatgtcttttaatgagtcttttttttttttttttttttttttttttaagacggagtctcactctgtcactcaggctggagtgcagtggcatgatctcggctcactgcaacctccgcctcccaggttcaagtgattctcctgcctcagcctcctgagtagctgggactacaggtttgtgccaccatgcccggctaatttttgtatttctagtagagacggggtttcaccatgataaccaggatggtctcaatctcctgaccttgtgatctgcccgcctcagcctccgaaagtgctgggattacaggcttgagcgaccgcggctggccttaatgagtactttcattgcttctgaagaactcagagggactcaagagcctgttgagaaattcattattaaaactgttaattataaagttactgaaatttcagacttcttaatttgggataaccatctaaataaacaattaacagctggctacaaactacttatagaatgatactgttaaagtttgggggagcaatagttcttagcatagaaacaataatgttcagaaaccacctcctgcctctctgcagatccaacccaatttccattcaaactaagtcagccaaaggggaaaaaatgactgcacaccattcacttcttttgttttccctcctctgctatgccagaaattgctggaaattgtccaaatcaccactgttgatagctgtcatttagtcaatctgtgggatatgtttgagtaggtgatggatgggaatatatgatataggatggggattgggatataggatatatggggatatatggggatataggatggggatgggaatatttggggatataggatgtaggatggggaagaacttttttttttgaagtggactctacactggttatagcttcatgtttgagcttctagctattaggatctcagtgtctttttaaaaatagtgtggggatagacagaaaacagcatttctatgaggatggagtgaaagaacaaatgaacatgagcttttgtaatgtgttaaattatcattttttgttgttatttagccctgcatctcagcgtctttttcttcaatctgacttatcactttgtttttctgatctatattttttttttctgaaggaatttgtgcagtcaaactaaacattaaatccttcaaggaattagaagataattctcaagagaaaataattgccagggagatggatggttgccaacaaattcccttctgagtttatttttttgttttcctactttgagccctgctatccctatttttaaaggaatatcttctgaagttaaatagtaacaaagtcttccagagtctttcttttagtctttgagagagactaaaaaatgcaagggaaactggcagccactgcttgggcatttgttccatgtttttagagatcgtcttctctctttgagaattcttcagtgcacttagggaaacttatattttgtttgttatacatactggtcaactgggttttttaaaaaagagaacagtttttttttccagtctgattataaaaggaatacacatgaatacttaagataggaagaatgtaaactagaataacagaacttcatctctaatgtttgtaagtatatatatcattgtttgttaaagttcagtgtttatgcttctggttattttattttcattgcatagatgtattttgtttttttacaaaactggtgcaatagtacattttaaaatttgaggactgcttacttttttgtttataaatacaatactttttatatgtaattttaaatagctacatgatattcaatcatatacatgaattttaatttatttaatcatcccctcattgttggaaatttaaattattttaagttttttactgttataagcaggctgcgacaaacatcctagcacataaatgtttgtagaaatctttgattattcccttggaggacattcccttaaagtgaaattatggaagcatgaaagttttaaaacttttttaggtacacacagacacacatacacatacatgtatatcttatatctacatacacacacacgcacatacacacacataaccaaatagctctatggaaaggttaaattaatttatatctcaaggtgtaagagtatatatttccctaaactttaccattattaggtttgatgaatttttttatgctttgtctttgaattatacttcaatgttgttttaatttccatttctttgaagacagggagtataccttttggtattaccttctgtaatagaaagcaggatcttacctataaaattttattggcaccaatagggtacaaagtaacttggtggtgggtagccaagaggcattggtgttggggtgggacttgaggagcaacacacgctgaatgtttttcagctaagaaactcagatagccgaagttcaatgtcactgcttctcctcctgaaatttaagatggtggggaatacagatgattgctgaagttcctcagagtgagagaggaactgtttattcaactttcagcatagtacctaccatgtagcacagcacttggcactggggatgtctatggctatggctttggttcttggagttcactcaggacagtttttctgaaactttgaggttttaccttaggcaagaagctctcaagtttctcccccagggctaagatgagagtggggatccattggtgacgtataagccagagcacttctccctttgcatccccagcttcagaagatggactaagccctcacatgctgcttttcatttggactgagccaattaaactgagactgtagaagagggaaccagtttctgggaaagtaaacagcagcgtttatattagtatgagggtcatagggaagtggattcttattctacctgtggttaacaatgaatataaataccctctgctgtagttcagttcttgtaattgcgtggcttgtcagaggtcaattatagtttaaatataagctgaactgtataactatactaactgataattcatgaggcctaggggctggctaatcctcatgtgcaaccttatttggaatattccatgcacttttactttttaaaatttttatttaaataatgagtaaggaggaaggctgaatagaagcccacaccatttgtctctcctgtaggaatacaaaattttaacaactacacaaaaaagcaccatcacaagaaccaaaaatgagatgaggaatcatagtacctgattgtaacttcatattgctgaaagatgcactgacgagggtaggaaagatgttcttgaatcaccaatgccacctcagccccattcctcggcattggctatgtggtacagagaatctgaatttggaggaaggagagcacagtgcctgggtgactcagtaaactcagcgctgccttgtcacagtggtgatcacagctatgctgggctcagccagtacctgtgcatggaaggagcatttggaccagacctagccagaggcgaattgcccatcccagtgttcagaatttgagcttcttagtagacctccccactgagggccagagtgctctggggtcctaggtaaactcaagaggcagtctagctcacaacgactgcagttcctatgcaactcctagtgctagtctgggcttggagccagtgaactagggtggcatatggcctagagagacaccaaatggggcagctaagggagtgcaccatccctcttccaaccccagacagtgcagtttgcagcaacaaaagtgactccttctttctacttgaggagaggagagcaaggagtgaagaggactttgccttgcatcttggataccagctcagccacagtaggatagggcaatgggcagagttgtgaggccccctttctggccctaacaggccaaaagagaacctgcggccttgaaggaaaggacccagtcctggcaggattcatcacctgttgactaaagagaacttgggccctgaataaccaacagtgataccagatagcataccatggaccttgggctctgagatgtgctggctttaggtgttacccagaacatttccagctgtggtggctatggtgaaagactccttctgtttgagaaaaacagaggggccacagtggggtagagtaacaagcaggttcttggacagcatttatggaactgccctgtgcctgtggggagcccactgccctgaagggtgagtcctaggcctggtagcattcaccacaagctgactgaagaccccttgggttttaagtgaacattggtggtagcctgacagaaccccacatgggctggtggtggtagtggccacagggagagtctcctctgcctttggaaaggggaaggaagagaaggaaggactttatcttgtggtttgagtgccagcttaaccgtggtaggcattggtgttggggtgggacctgaggagcaacacatcacgtaaatctctaaggtttttgactacagtccttggatctcagagagcattcctgaactcacctagggcctgggggatctcattgccctgaagggagggacaaaaatctggctggctttgccacctgctgattgtagagtactagggccttgaatgaacataggtggtagccaggtagtggttacagtgggccttgggcaggacctggtgttgtgctggcttcaggtctgaaccagcattgtcccagtggtggtggtcacaaggatatgtgtgtccctataccctcagttccaggtggctcagcatagagaaagagattcagtttgtttgggggaaagtaaggggaaaataataagagtctctgcctagtaatccagacaattcttccagatcttgtccaagaccaccaaggtggtacctttatgagtctgcaagaaccacagtgtttttgggcttggggcctaagtccctttgaatacctggaaagtctttccaacatggaggggcacaaacaagcccagactgtgaagactacaataaatacctaattctttagtgcccagacaccagtaaacatctacaagcatcaagagcatccaggaaaaaatgacctcacccaatgaacttaaataaggtagtagggaccaatcctggagaaacagagatatgtgacctttcagacagacaaatcaaaatagctgtgttgaggaaactcaaattcaagttaacacagagaaggaattcaaaattctatcagagaaatttaacaaagagattgaaattattaagaatgcagtagaaattctagagttgaaaaatgcaagcaacatattgaagaattcatcagagtctcttcttaatagcagaattgatccagcagaagaaagaattaatgagctcaaagacaggctattaaaatacacagtcagaagaaacaaaagaaaaaagtatagaaaagaatgaagcatgcctacacgatctagaaaatagcctcaaaagggcaaatctaagagtattggccatgaagaggagatagagaaagagatggggtagaaagtgtattcaaaggaacaatatcagagaattccccaaacctagagaaagatatcaatatttcagtacaacaaggcagatataacaaaaaagactacctcaaggcatttaataaccaaactccccaaagtcaaagatagggaaaggatcctaaaagcagaaagagaaaagaaacatataacataaaatggcacttcagtacatctggcagcacctctttcagtggaaaccctgcatgccaggagagaatggtatgacatatttcaaatctgatggaaaaaacccctttgccctagaatattatgtctggaaaaaatatccttcaagcatgaaggagaaagaaagaccttcccagagaaagagggattttatcaacaccagaattgacctacaagaaatcctaaagggagttcttcagtctgaaataaaagaacattaataacaataataaattatctgaaggtacaaaattcactggtaatagcgcacagaaaaacagaatattataacactgtaattgtggtgtataaactactcaagtacaaagactaaattaaccaatcaaaaataagtacaacagcttttcaagatatagacagtacaataagacacaaagaggaacaacaaaaagttaaaaagtgggggatgaagttaaggtacatggtagttattagtttttttttcttgtttatgcaatcagtgttgtcatcagtttaaaatattgggttataagataatgtttgcacgcctcacggtaacttcaaattgaaaaacatacaatggatacacaaaaaataaaaagcaagaaattaaatcatgctatcagataaaatcactttcactaagaggaagacaggaagggaagaaagaaggaagagatcacaaagcaaccagaaaacaaataacaaaatggcaggagtaaatccttacctatcaataataacattgaatgtaaatggacttaagtctccaatcaaaagacataaagtggctaagtggataaaaaaaaaaaaaaagctagacccaatgtctgttgcctacaagaagcacatttcacctatcaagacacacatagactaaaaataaagggagggaaaagatattccatgtcaatggaaagcaaaaaagagtaggagtagctatacttgtatcagacaaaatagatttcaagacaaaagctgtaagataaagaaggtcattatataatgataaaggggccaattcagcaagaggagataagaattttaaacatatatgcacccaatgctggagcacccagatgtatacagcaaatactattattagagctaaagagagagatataacccaatacaataataactggagacttcaacaccccactttcagcattggacagatctttgagatggaaaatcaacaaagaaacactggacttaacccgcactatagaccaaatggacctattagatatgtacacatcattttgttcaacgtctgcagaatacacagtcttttcctcagcacgtggatcattcttaaggatagatcatgtgttaggtcacaaaacaagtcttaaaacattcaaagaagttgaaataatatcaagcatcttctctgaacacaatggaataaaactagaaatcaacaacaagaagaattttggaaactatacaaacacatggaaattaaacaatatgctcctgaatgaccagtgggtcagtgaagaaattaagaatgaaattgaaacatttctcaaaacacatggtaacggagacaaaatgtaccaaaacctatggggtataaagaaagggaaatttatagctaaaagttcctacattaataaagaagaaaaacttcaaataaataacctattgatgcatgttaaagaagtagaaaaccaagagcaaataaaacccaaaattaatagaagaaagaaataataaagatcagagcagaaacaaatcaaattgatatgaagaaaacaatacaaaagatcaatcaaataaaaagtttggtttttgaaaagataaataaaatgaacccatatttagccagactaagaaagatagaagacccaaataaataaaatcagagatgaaaaaggagacattacaacgaatactgcaaaaactcaaaggatcactagtagctactatgagcaatagcatactaataaattggaaaatatagttggaaatggatatattcatagacacatacaacctatgaaaattgaaccatgaagaaacccagaacctgaacagatcaataacacattatgagatcaaggccacaataaaaagtctctcagtaaagaaaagcctgggacccagtggtttcattgttgaattctactaaacatttaaaaaagaatgaataccaatcctactcaaactcttctgaaagtcattctgtaaggcaagtattaccctgataccaaaatgaaagacacataaaaaaaacaccaaaaacacaagtacaggccaatatctctgatgaatattgatacaaaaatccttactaaagtacaagcaaactgaattcaacagtacattaaaaaaaccatttatcatgaccaagtgggatttatcccagggatgcaaggatggttcaacacatgcaaatcaatcagtgtgatgcattatatctatggaatgaaagacaaaaaccgtatgatcatttaaattgatgctgaaacagcatttgataaaattcaatattccttcacgtttgtaaaagatctaaaaaaactcggtatagaaggaacgtatctcaacataataaaagccatgtatgacagagccacagctggtatcaccctaaatgggggaaaactgaaagcttttttttaaagatctggaacatgacaaaaatgcctactttcaaccactgttattcaacattgcattgggaattctagctagagcaatcagacaagagaaacaaataaagggcttccaaattggaaagaaagaagttaaattatctttcttttcagatggtatgatcttatatttggaaaaatctaaaagcttcaccaaaaaacaaatagaactaataaacaaattcagtaaagttgcaggatacaaaatcagcatagaaaaatcagtagcatttttatatgccaacagtgaacaatctgaaaaagaaataaaaaggtaatcccatttacaatagctacaaataaaattaaatacctaggaattaaagaagtaaactatctctacaatgaaaactataaaacattgatgccagaaattgaagataacacacacacaaaatggaaagatattccacattcatggattggaagaatcaataatgttaaaatattcaactacccaaagcaatctatagattcagtgcagtccctatcaaaataccaatggcattcttctttacagaaatagaaaaatcaatcctaaaatgtatatggaaccacaaaagacccacaatagccaaagctatcctgaacaacaggagcaaaaactggaagaatcactttacctgacttaaattatactgcagagctatagtaaccaaaacagcatggtgctggcataaaaacagacacatagactaatggaacagagagtctggaaacaaatccatacacctacagtgaactaattttcaacaaaggtgccaagaacatacattggggaaaagacaatctcttcaaaaattgatgctgggaaaaactggatatccatatgcagaagaatgaaactaaacctatatctcatcatatacaaaagtcaaaccaaaatggattaaagacttaaatctgactatgaaactactacaagaaaacattggggaaactctccaggatattggtctgggcaaaattttcctgagtaatacttcacaagcataggcaaccaaagcaaacatggacaaatgggatcacatcaagttaaaaagcttctgcacagtaaatgaaacaacaaagtgaagagacagcccacagaatgggtgaagatatttgcaaactacccatctgacaaggaattaataaccagaatatgtaaggagctcaaacaactttataggaaaaaaatataataatcccattaaaaatgggccaaagatgtgaatagacatttctcaaaagaggacacacaaatgtcaaacaggcatatgaaaaggtgttcagcatcactgatcatcagagaaatacacatcaaaacttcaataagatatcatctcaccccagttaaaatggcttatatccaaaagacaggcagtaacaaatgctggagaggatatggagaaaagggaacctttgtacactgttgatgggaatgtaagctagtacaatcactgtggagaacagtttggttcctcaaaaacctaaaaatagagctaccatcatccagcaatcccactgttgggtatataactgaaagaaaggaaattggtatattgaagagatatctgcacacgcatgtttgttgcagcactgttcacaatagctaagatttggaagcagcctaagtgcccatcaggagatgaatggataaagaaaatatggtaggtacatatatacacaatggagtactgttcagccataaaaaagaatgagatccagtcatttgtaacaacatggatggaactggaaatcgttatattaaatgaaataagtcagggacagaaagacaaacttcacatattctcacttgtgggagctcaaaaaatcaaaacaattgaattcatggagatagagagtagaaggatggctactagaggctgggaagggtagtggggggttggagggtaagtggggatggttaatgggcacaaaaaatagttcaaaagaatgaacaagggctagttttgatagcacaacagagtgactatagtcaatagtaatttagtggcacattttaaaataactaagagtataatttgattttttgtaacacaaaggataaatgcttgaggggatggataccccattttccatgatgtgattattacacattgcattcctgcattaacatatttcatgtactccataaatgtatatacctactatgtacccacaaaattaaaaaataaaattgaaacatttttgatgtatagttttattaattttagttgaaagaaatgtatgctttatttgttacatatacaggtcaacttaatttctaaatattattttttacttttttatttgtgacttttaagcagctgctacctttgtagattctaaaaaatctggatggtattcattttctcctattgtcttaatataattgcacacatttggccattttttgacttaatttttctggaaaaatgacatttattattgaattccagtctttaatttacataaaaattaggcaccagaaagagtagtggagtaaaatagcttatcagtagataatagacatcctcatattttcatgaaatataaatctatacaactttaggagtttcagaggaacttaccgatttattaactttgcgttgggtgaatagctcttttatgatgtgaattctgtatctttaaaaaggatacttgattaagaacagtattcttatttgtagcccaaatttgtgccttttgaataataatggtttattaaacttggtgttgtgtaaaggaagatttggccattttgataaggaaaggttgagaattatttttcaacattcttctctagtttacctttttagttatagaagcaccccatgtttggtttacaataagaatagaaataaatattttatttttacatactgttagtacaaaggcagcagctttttcactactcattttatttttgtaaatttgaagcaaatttatggcatgaaatttccccagcttcttttgaccttgaggtgcaatatgatttgctttgtgaagttttaattttatgacacatcacatttctgtcatgtccaaaattaaacttcagggtaggtgtatatttttctacactgggattatgaacagaataaattatcagagaattatgtttaaatgaatatataagtataggaatgtataggcttagctacatctctctacataaatagcttgttagtgtgcaatcagtcactggagttgccatgaacttggagcttaatgaacaggtggagaaagaggatgaattccagttcaaaatggatctgacagcttatcaggcaatttcactgatcgctaatccagttcgtttggcaacttaatttatcacacagttagaattctcatcccgtgggtttccaggtggaaattaattctggaacatgtccattaccactgggttgaagagacctgcttaagctttgtgaggaaatttagaaataaattattttaaatgcataagccagatttctcttatgattccctttgtgtttatccaattccttcttaaaatatttggatgctgctagcatttgatggtatgcccatggaggtgaactaaggtttatttattcattaatatttataaattaaatggaagaaattgttaatcctaattaattagtgaaataactactataatagataatcctgtgaatataattctatctttaggtatagaaaaattgctgatctcgaacatgttttaagcatttcatagcaacaaataatgaacagaagaaattatttccttaaagctcacaaatctatgtcttctgagtacttacaaattctctaattagtctgatttacagcccattattttatgtaaaagtatctgctaaagcaatttccttgacaataaggaagaaatgcgacttgcctctcacagctcacattctgactctgtttggaattcccaaggatgagtctaattaaatgggcttggcttaggacctggctgtagcttaaaataccttcaaaaccagaaacacattttctccactttttaaagacttgatttatagtgcatagaaagttaaattgaatattgatccttgaaaagcaaatgtgtcctgtaaaaaatgacaacaaaagaatacaataaaagatgacagagtgattgattgtccaaagcctatagatagtagcctcccccttttatgtcatcttctctaggcatctgtagctctgagagggtgatagggatgaagtgttagaggaggattagttgcaccctgacatgaactgttacattttataagaagattgaggaaggtggtaacaaattatttctaagaaggaattttgagaaacgaggaacggggcacaagatcagtaagacctatgatataactccaggaagggacacgacggaatttcttataatttctcaaactctgaagcatcttcaaaaagaatttaagtcagtgaaaaataattgagatgatagaaaactacaaactggcgtaacagtgtcattgattggatatgtcaggaaaattgtgcctatcattcttatgaccaggcttattaaagtaatatcttcataatctagaggggctcagtgttggatcatcctggcatccttctcaaatcccttttctgagtccttggcatttttccctggagcatattgcagacctacaaccttgtcatttcagaaactgtcctttcatttttacctttgaagggaaatggttactgagtccagtactagcccttgggaatcaagccaaaagaaaaaaatggtagggcattgtttgattttctcctcctttcctacaagagcagtggttgcgtcaaaggttcagtgggtattggaatcaccaagaaggagataatgatgatgataaagcacagtggatcaattcggggttttcctcctttttttaaaatgtttttcctattaccatcactgtcactgtgatgatgataatggtaataggaaaaatatataaaacaaaatggggaaaaccgtaaatagacccagtgtgctttataacatttctgatttactatttattactcctcattatttaataaagtgtcccatgtactatgcaaatggcagacagtaaaacccccaccatgctgtttagtgaaatgtgaggatcatgtataaaaaatcctcaagctagacttaggttggatgaagaagacagtgagaaatcttgtctttttaggttaggctttcttgtttttcctttgtttaacttttgtttcttcaaatggcttgcagcttggaagagacaacttttggtctaaaaactattttggttgcggacagaggcagtatcattgaaaaaacagtgtgttcaccaattagaagttcatattgcttttaattctgcttccaacagttttgggacttgaagagtgaaattgagatttgtgtattttttcttcagtgctgcataaatggccatttatggtaaaacctgagaataaaggaagaccaaaaaaagcaaaataaaataagacagaaatacacaaattatagtgattctgatttttccttatgaaacttgagatccagtaagtaaacttcggttggaattattgggcattcaaacattatcattcacataagaaaaaggctccctgtcagtaagccgagatattagatgtgtaaatataatgagccatttgtggagacaccgaccagattgccctgcattgtgatagaattgatgtaatttgagtatcagatggggctgattggtgaatcttgagaagacagttacttgacagcaatgatagattttgaccctgttgtaactggtatacttgaggtaggaagcaattctactcattctgtcaaacggaggcctccactcataaagtgaactattatttagaggatcttgtcttcttggctattattaaaatgcaatttttgtctaatcagctgttattaaaacgcaattaccaaataatatattcttctcactatggtgatttgacagatcaaaagctttctgagggcagagactgcgttatccgtttacgtatctccaatgctttgtatcatgtctggcccattgttagtactcaaaaagtgtttgcggaattaatgaatggttgagtaagttgcttcctataatcaagacttttagttagaatggtggtaaatttagacttagaggattttgtactttgtatcagtggggctgccctaactggtggatttattttttaatgcaatttttttctttttatttaaaatttctttggaagcacagatgatattataaacataataatgtaaataaagtaagaagaaataaattactgattactccaccttccagcagactgtgttgattttttcctgttcatctctatgcatttatatacttttttgtttgcatttttatgacttagaacccagatttgatgtgttatactgagttttctacttaatattaacatttttaatatagtatttaggccaggcacagtgactcatgcctgtaatcccagcactttgggaggccgaggcagttggatcacgaggtcaagagatcaagaccatcctgggcaacatggtgaaaccccgtctctactaaaaatacaaaaattagccagttgtggtggcatgcacctgtagtcccaggtacttgggaggctgaggcaggagaatcgcttgaacccgggaggcagaggttgcagtgagccgagatcgtgccactgcactccagcctggcgacagaacaagactccatctcaaaaaaaaaaaaaaaaaatgtacagcttctaattttacatggctacatagtatattctttactttgtattccccctcaacaatattctatttccctatcgctttatctttctattgaattcctactcagctttcaaggtcccatttaactttgcaacagtcttccaatttctgttgactcttatgatccttgtactttacgtacagtgactatagaacttttgatactttaacttttttctttttatgaaaattatgagaaataaggtacatcagagcatggattacacaactctgtgtcctgatgcctaactcaatgttggtcatgtagttggccctcgacaaatacttgcagataacattctaaggtctgggaatagagggataaatgagatatggtttctggattttatgctcaaagtatattggtaggcaggtaggcagatatcatgtagaaactgaccttctagagttgtttatatggtgctaggaaaaccgagaggaggccagtatattcacagcatagctttttcttcttaataatcttttttcctctactttcaggaatggtatgtgtaggctaaggagttctcacattttcatgactcttcatttcctttggaaattattttctaaaagattccatttcctcatgtttgcttttctcatgccttgtttgcccatgtcacttgctctttttcatttggtatcttgaaatatagtttttcaccacattatataatcttcctacataattgcagcaggcaaagttctaagatgttcctcaagattctccatacttcccccaccaggatacaggccctgagtaatccctggggctataaatttgatggattttacttccatgactaggttatataatatagcacatttaagaaaggaagattatcaggatgggtctgactcaccgtagtcatgattatgactacattaatcctttgaaagtacagttttctctgtacttctggtctacaaacatgtgagctaataaatgaatattgttttaagctgtcgagtttgtggcaatttgttatacagcaataaaagtgaatacaatagtatattaaccatttgtggtatttgctacatatatattttttagtttatcttgctataagttttgtttgtacaaaactcggcttcttcatataattgcatctactgaagatttgtttctttatgatttctagtatttcttcaaagtttagaaggcattaaacagggtattgttggtaggacgcacagaggatttgagtctgagtgtcaaataattaatttgattagactctgccactggcattcttttgcataataatttataaactttcaacctgaacattgactttctccattgctacttagctgaggagaaatacgaattctcctttggaaaagtttggggatttctagaacactaaaccattctttttgatgattgaatggaactttcaaatcttatatttcaacacgaatggggatctcacaatggaaggcagctccctagaactatgctgttagccctttccttcaccataatacttggcaagagacaacttacacagacttttcatttttattctacccttcttccaaattctctggatggtctagcctgtattgcctgttgttttcagtgttgttctgatctcaaatgggcttccacaagtggctagaagggattagttttcatatttcttccattagttcagtattgaactaaaaagcatggttataaatgacaactttagtgactgtgattttttttttttttttttttttagacagagtctgactctcttacccagattggagtgcaatggcgcgatctcagctcactgccacctctgcctcccaggttcaagcaattctcctgcctcagcctcctgagtagctgggactacaggcacccgccaccatgcttggctaatttttgtatttttttagtagagaagggatttcaccatgttggccaggctggtctcgaactcctgacctcaagtgatccacctgcctcagcctcccaaagtgctgggattacaggcgtgagccaccgcgcctggccaaatgactgtgatttttttttttttttttttttttttgagatgaagtttcactcttgttacctgggccggagttcagtaatgcgatcttggctcactgcaacctccgcctcctgggttcaagtgattctcttgcctcagcctcccaagtagctgggattaccggcgcctgccaccacacctggctaattttttatatttttagtagagatagggtttcaccccattggccaggctggtctcaaactcctgaccttcaggtgatccacctacctcagcctcccaaagtgctgggattataggcatgagccatcgcacctggccatgactggatttttaacacccatccacattattggtcactgttggtgcttcaagtgtttctgtaacattcctggattgacactaaaaaaaatcctaaacaagagaattgttactattatggatacatttgttctttcaacttacaaatattaaggacctactgtctgctagctctgcaggcctcgccattttttgccttttccatttgacacttatatgtcaaatagcctgtgctaagaaagtccttaatgctacaaaggaaagtaaatgtacttatatttgttgcctgacttaacaggaatatataggcaaaagctagtagttatgctgaatttaagacagtatgtttggtctaatatccagaattcacaaggaacttaaatttataagaaaaaaaatgaacaaccccatctaggcaaaggatatgaacagacacttctcgaaagaagacatttaaggccaggcacggtggctcacgcctgtaatcccagcaatttgggagtccgaggtgggtggatcacttgaagtcgggagtttaagaccagcctgggcaacatggtgaaaccccttctgtactaaaaaaaatacaaaaaattagccaggtgtggtggtgagcacctgtaatcctagctactcgggaggctgaggcaagggaattgcttgaacccaggaggcaaaggttgcagtgagctgagatcatgccactgcactctagcctgggtgacaagagtgagactccgtctcaaaaaaaaaaaaaaaaaaaaagaagaagacatttatgtggccaaaaaacacatgataaaaagctcagcatcactgatcatcagaaatgcacaacaaaaccacactgggagaccatctcacaccagtcagaatggtgattattaaaaagtcaggaaacaaaagatgctggcaaggctgtggagagataggaacacttttaatctgttagtgggaatgtaaattagttcaaccattgtggaagacagtatggttattccacaaggatctagaaccagaaataccatttgacccagcaatcccattactaggtatataaccaaaggaatgtaaatcattctactataaagacacatgcatgtgtatgtttattgcagcactatttacaatagcaaagacatggaaccaacccaaatgaccatcaatgatagactagataaagaaaatgtgatatatatatatatcacatgtattatatatatatatataatggaatacatgaaatcagaacaccatggaataaaaatgaatgagatcacattctttgcagggacatgtatgaatctggaaggcatcatccttagcaaactaacacaggaacagaaaaccaaacaccacatgttctcactcataatgagttgaacaatgagaacacatggccaccgagaggggaacaacacacaccagggcctgttatgggtggggggtgaggggagggaacttagaggatgggtcaataggtgcgacaaaccatcattacacatgtatacctatgtaacaaacctgcacgttctgtacaggtaccatttttttttagaaggaaaaaacagtatttttatttttataatgtaagtgtgtgataatttgtttaaatctaatattgtttctattagcttaagttaagcattgagacaaaaattggaagcatggaaatgagaaaactctagtaacgattctgtcaggggtgcatagtcattgtgtatagattaggaggtagaaagtgatcccgtcttatgattttaaagtttgaaaggaactgaaggataatccaggccaaatgcttcatgtcatagatggggaaacagagtcctagagagaggaaataacgtactcaaggacgtggaggtcctatgtggcagaaccatgcgtaggaccctatttcctgttactcacttcttttcctttccttgatttgggttgctttgttactggtacttaataattcggtagaaacttgacatgtacttcatgatattaaattgatattgtaggttggactctggaggggttttaggactccttgtcttttctgtgggattgaaacaatatggtttctattaaaatattcagtgacccttctatcttttgaagtatttggttagatgaaatgtggatagtaaccaaaacctctataagtagtattatactttggtctgattgaattactgagcagttttgtattattcttgttgagtatttttggtttgttggtttgaaaaaggaaacagttctacagatgtgtttttttctagtaacttctgactgcttttctattgatctcctttttacgtcaaataataaagctaaaagaagctttgttatgtcttttaacaaaatattgatcttttattggtatgaaaacatcttggttgttaaattgcttcattaattttatacctcttttatattgaagtctgtaattgtttggtgtaagagttactccagttactgcttgttttaaaattgattttccttttaatttagagacataaatgaatcattttttcccctttaatttcttcctgctatataaaagacattaaaacttttttaggctatcaataatattacataggtctttttggataatacagtcctatgttgttggtgaaggttctaaacctgctagtcttgcctagtttcagatattgtctggtaaaataacatcactatattatgcatgcagctactccaatacatatggaattcaggaaacttggatttgaattgtctctcttttagttattatctgtggcaagtcacttagctcctctcagtatctctgtttcctcatcttttaagtggagacaataagatttttagagtccttgtatggactaagtaagataaagcatgcatccctggcacattgtcaatgctcataaatagtagctgtaaaaatactgcacctagggtaaactatagaacagtatatttattctgaaacattattcctgttagctattatttaattcacccagcttactttcctcatcagttaatctgtaacccttttctccttatataaaagacttggaattatttcattgagggaggtcaataagaagattcccaaggaggatctgattaaagagtatctattttccccatgataagatcaataattccttctcaagggggtgtcagaacgaatatttgaaaattaccttccaacaaactctttctttgcttctgggaatagtacatatttggaaaggagacaataaatagatgggcagtatcttgtgcaggagttctgaacaactatagaatgcttccatctgttcacttttcagttttgttctccttgactttcctatcttagactcctgaggttgttagatgcacccctctcatccacacagtgactgtgtctatctatctggcccataaaactcctttccagtatgtgagaaatacatccgttatacaggattagagacagtggcatcgtcttccacactgtagtttaactcaggcctggcaccaaactagtgttttttgatgaggttgttatcaggcaagagaatgaagctagttctgtagtatggtaccacagagaaattagcctgtttcatgaacaaatgcagataatagggtacataatttttagtacttgaagcatagccatgagtgtaatctgattgtcggaaagtatacaattcttaacctatggcccttattttaaccaaacatagtctgaatgttacaaaactttaaattatttatagaaataaagtcattttatcattgattatctgaagctcctgtttttgtccttgataaatcatataggacctttagttacctctccaatttgcactctctctgtatttctggacatatcaacaaactatttctcagctgctatgtggcattggtcatactgtttctctcctacccaaatgctccttgctgaaggagcctcaccttcatcagcactgcagcatccatggtaaagatgtagggaagacaactaagaccccagctccatgcttcacctggtcacctaggccctttgaagaaatcttgcagtgcggcataccattagtctcccttggacaagaaaatataaagtcctgcctccctagataccagcctacctaacgaagccttctaaaatagtgggctttagaaaatcaaatctcgtatctgaagatagtggtaatcatcaatgtttcagaaaggtagcatttctggcccttgagtgcacttataaaggttgatgaatgtcagtggtttctggcaggtttaatgcttaggcaagggaaggaagggaggaatcaaggaagaataggaaatagtgaagagagtaagtaaacagtggggaaataaaaatatgtctgtgatcagcagtggtaaaattcccctgaaatttgttagagatacaacttagtagttgcctgaagatgcttatctttccctagtggtatttaaaatctctctctcctgccactagcattttagttctttctttcttctttcatgtatgtttaatttttgaaaataattggagatttatggtagtatcagtggtattttttccattttttttctcttgaactatgttttctttgctccaaaaagcaaatggcagtcttcaaaggacgatttgtttctatttgtataaattgagtataagctgcatccaattcctagtgcatgcataaaactctttttgaggaaatgtgaccaatatataacattttattgaatgtttcttgaaattggtgtcaaactgttttttatttcatttcttttgggatgcctaattgaattgaaacttcattatttcattccatggcttaggccacctttagagggaatataccatgtgagctcctacttacccattaagaccagatatccactagggacttaataggctaatgtgttcctctttcacctcctatgtcctaaatttagcattagctaaattgactaattaaaataaccctagccttattcctcttcctagtggatattgttttatttaaacatttcatcacagaacttggtacaattgttaggcacttcttacatgatcctggaactgaaatgtcagatgcgtgtagggtattataacctaaccaaccataatgagataccaggatggctatgattaaaaataaaggaagtggtgagaatggaataaaaagtgctgcagaggatgttgagaaattggaacactcaaacatggctggtaggaatgtaaaatggtggagccactgtagaaaacattttggggattcctcaaaaagttaaatataaacttaaccgtggaatgacccagccattccactcctaggtataatgcccaagagaattaaaaacatatgttttcgcaagaactttcacatgaatgtccatagcagcattttttgtcatagcccaaaagtggaaacaactcaaatgttcatcttctgacgaatggatacacaaaatgtggtctatccatacaatgaaatattattgagctatagaagggaatgaaatactaagatatgctacaatgtagatgaatctcaaaaacattgttctgagtgaaagaagccagacacaaaaggttacatattgtaggctttcatttatatgaactatccagaatagataatggaggcagaaagcaaaatggtagtagccaggggatgacagaaggaggggatagggagtgactgtttaatggatatgagatttaatggatctgagatgaaatgtcttgaaactagataaaggtggtggttgcacaacattttgaatgttctacatacaactagatttcacttacactttcaaaaggttaactttatgttatataagttttacctcagtaaaaaataagcaaactcacagaatttagagtgaaattctaaaatcttgacagccacttgctcccttcattttttcgggactaatcttgtataatttcaggcttaggctaccttgttggggtaagatcagttttaaaattcataatgctttttttctaaaacaaagtgttcagtaaagataaacaaaaagaaaaattagaatcaccataattgtaccactcagaacaattcttaatatttttgtatgtgtatttcctgtgttttttccagtgtgtaatatatgtacacatactctatacatgcatgtacatatttgtgaaatagggtcattttgcatatagtgtttataacatacttttatcatttaatgatgcattagaaaattatttggtctattttctatagtttcacaagtatacagcataactcttttaaaatatgtcttcagaaaaaaaaatagcagcaaaatagggtaaagatcatgtttcatttgtttttgaatccctggagttgttcaaaagaaatagccactttattggattgggttggactggattggattagattgaattaaactagaataacttctagaaaccaatgaagaacttctgaaatattcaacatcttgttttgttataatactctcttagcttcattttagttggtgacttgatatacccctttttcccttcagggtgtcaggattgtagaagcctgagtgttacgtgaagcaaatgtccccatgtattctgttttagtttactatagctgccacaacaaaataccatagatggggtgacttaaaaagaaaactttattttctcacagttctgaagggtggcagtccaagatcagaccagcaggtttagtttctcctgaggtctttctccttggcttgcagatggctgccctcttgctatggcatcacatgtccttttctctgtgcatgcgcttccctggtgtctgtatgttctcatctctactttttataaggacatcagtcaaattggatcagggcccaccctaatggcgtcattttaacttaattacatctttaaaagccctatacaaataaaataaacacattctaaggtaatgggggttagggattcaacatatgaattttgggggtccatgtaggcatacctcatttattgtactttgctttattgcgttccatagtgtgggtgtgtgtttgttaattttttaaagcaaattaaaggtttgtggtaaccctgtgctgagcaaatctgttggcactgttttttccaatagcataggcactttgtgtctccatgtcaaattttggtaattgtaatatttaaaagttttcattaaaaatttaaaacattttcaattattatgggcacataatagttgtgtatatttctttttcattattattatatctgttacagtgacctgtgacaattggtctttgatgttaccattgtaactgttttggggtaccaccaaccgcacccatagaagacagtgaacttaatctataaatgtgtgtgttctgactgctccatcaactggctgatccccagcctctttccctgtcctcagggctgcttattctttgagaaacaacagtattgaaattaggccaattaataaccctgcagtggcctctaagtgttcaagtgaaaggaagagtcacatgtctctcactttcaatcaaaagctggaaatgattaaacatagcgaggaagacatgtcaaaaggcaagaggccaaaaatgaggcctcttgctccagttgggagagttatgaatgcaaatgaaaagttcctgaaggaaattaaaagtgctactccagtgaacacatgaatagtaaggaagtgaaacagccttgctgctgatatagagaacgttttattggtctggatagatgatcaaatcagccacaatattcccttatgccatagcctaattgtaaggccctaactctcttcaatactgtgaaggccaagagaggtgaggaaactccataagaaaagtttgggccatagtgtgcaggtagctgtccctacttgcttcttgctgaggctgcctcagaacccctttccactgcttcatgattttctgttgtctcttggcaaaaatggcaaataatgatgctgttctgaagaggctggagcagaaggaggcagaggtgggtcaaatcattgaatatcttaagcagcaagttgctctacttaaggagaaagccatttttgcaggcaattttgagggaagagaagaaactttgagtaggaaactgaaggaagaagttgaattgaaacaagagctaattcagacagaaattcaaaacagaatgaagcaaataccatttccatctggtattccactgcatgctaattatgtggtttctgaacgtgatacaatctacaccagtaacaaccacatcttctggtatcaaagaacagataaaaggaggagcaggagaagaagagaaagcaaaagagaaaattgaagagaaaggagagaaggagaaaaaacagcaatcaatagcaggaagcaccaactctaagccaataaatgtttcccaactagatctttgaattggttgcatcataaatgtcagaaaacaccctgatgcagattctttgtatgtagaagacgtagttgttggggaaatagtcccaagaacagttgtcagtggtctggagaatcatgttccttttgaacagatgcaaaatcagatggtgattttactttgtaacctgaaacctacaatgatgaggggagtattatctcaagcagtggtcatgtgtgcttgttcaccagagaaggttgaaatcttggcccttcctaatggagacaattacttttgatgctttccctggagagcccaacaaggaaccaaatcctaagaagatttgggagcagatcccacctcatttttatactatgatgagtatgtggctatatacaaaggagctccctttgagatgaaagggaagggagggtgtagggttcaaactatgaacaacagtggaataaaataaaacaaaatgccttcattatggaaatacattggagaaaaccttataaaaaggaatgtatttgccacttgtacctaaaaaaataataacaacagcaaagtttgaggctaccagaagtttatgaggtttaagaaaagaagctatgtccataacataaaagtgcaaggtgaagctgcaagtactgatgtagaagcttgaggcaagttatccagaagacctaggtaagataattgatgaaggtggttacaataaacaacagattttcagtgtatatgaaacagccttttactagacgatgataccatttaagactttcatagctagagagaagaaatcaatgcttggcttaaagtgtcaaaggacagggtgacactcttggtaggggttaatgcagctggtgactctaagttgaagccagtgctcattcaacatttacaaaatcctagggcccttaatattgatgctgaatctactctgcctgtgttctataagcagaatcacaatgcctggatgacagcatatcaatttgtggcatggcttactgaatattttaggcccacttttgagaccagctgctcagaaaaaaagattcctttcaaaatattacttttcattgacattgcaactagttacccaaaaattctgatgaagatgtacaaagagcagtcatgttaacacaacatcaattcttcagcccatgcaccaaggaataatttcaacttttaagttttattatctaagaagtatattttataaggctataattgccatagatagtgtttcctttgatggatatggacaaagtaattgaaaagcttctagagaaaaaagtaaccattctagatgccattaagaacacttgtaattcatggaaggaggtcacaatattaacacgaacagaaatttggaagaagttgattctaacccttgtggatgacttcgaggtccatccaagttcaaggcttcagtggaggaagtcatagcagatatcgtggaaatagcaagaatattagaattagaagtgaaattctaaagatgaactgaattatttcaatcttgcaataaaacttgaactgatgaggaattgcttcttatggatgagcaaagaaagtagtttcttgagatggaatctagtcctggtgaagatgctgtgaatattgttgaaatgacaacacagaatttggaatattacataaacttagttgataaagcagagcagggtttgagaggattgactgcaaatttgaaagaagttctactctgagtaaaatgctattaaatagcatgacatattgtagagaaatctttcatgaaaagaagtaaatcgatgttttaaatttcattgtcttatttaagagattaccacagcaaaaccaatctttagcaaccactaccttgatcggtcagtagccatcaacatcaagccacgaccttctaccagcaaaaaaattatgacttgctgaggactcagatgattgttagcatgttttggcaataaagtattttttaaagtaagttatgtgcattgtgtttttagacataatgtcattgcacatttaatagactacagtttaatataaacataattttatatgcactgggaaaccaaaaaatttgtgtgactcgctttattgcaatatttgttttataaaagttgtctggaactgaacctgccgtatctttgaggtatgcctgtaattcggtgttcataaaatatacccaactgaggaagacaatgtcattgtgtctacaagaatcttaccatggggactcagttaaagtgagtcacccaaatctatcaagaggtagattttcttacatttttatgaatggctctgattagcagaggagaaaattgataaaaaatatgtgtggcaagaatagtagaaaaaatgttggacattttttgtttttaaaccaagaaaatatctaggctgggcacggtggctcacacctgtaatcccagcactttgggaggccaaggtgggtggatcacctgaggtcaggagttcaagacaagcctggccaagatggtgaaaccccgtctctgctaaaaatagaaaaattagccgagcgtgatggcgggagcctgtaatcccagctactcgggaggctgaggcagagaattgcttgaacccaggaggaggttgcagtgagtcgagatcacgccactgcactccagcctaggcaacagagtgagactctgtctcaaaaaaaaagaaagaaagaaaaagaaaatatctaccgttagcataggaaaattcattatagcagcatattcccactattttaatggcctgaagagaaatagcactatattagcagttcataattaacccataagcagggcttgttgatcagtattttttgggaaaagaaggcttcacagtcgggattttttggtgctaaacagaagatactcctttcaaataaaagcaaattgggataaatttgtcattttttggagataaattatgaacattttagattagtagaatcttcctaatgatgaattccatttcaaggacaagttttgtttaaattttatcttcaagatctgtgaatatagaaaatttaaaataattgtgttttttttgtttttttttttttttcttgagacaggctctgttgcccaagccagactgaagtagctcaatcatagcttactgcaaccttggacttttgggttccagtgctcttcctgcctctgcctcctgaatagctgggactgcaggaacgtgccaccacacctggctaattttaaaaaattttttagtagagacagagttgcctgggctatgttgctcaggttatggaagattttttaaaacctgttttcatattggataatgacttctttaaatgtatactcttcacttgagcaggggataaagagttgttttctgaagtttggcttgagaaaacaactgtttgggttttaaaatccaagtggaaacatgttacaaatgaaatttttttttatttctcttatttaaaacaaacatagtttatagcttttatatattaacaatcaaatagcagaaccatctacatttatccaaaataagctagattagtttgtgtgtattttcatgtaagtcaaataggcatttgcttatgaggagtcatttaaatgcagctttacaagaagtggtacaattgtctgcaacatttctttatctcaaagtaatttggatgaaataacatcagaagatgtcagtttaaatgttccacttgaaatccggttagtttttgattattcacactaatggaaggagagtgtaggcatgtagactccgaagagacctttaatccaaaaattacttcttagcatttgaagatatttgggtaatacatttggataatggtgtgtttcatgtcctttggcttttttaatttaaaaaattttttcagagacaggatctcactctgtcactcaggttggaatacaatggcaccatatagctcactgcagcctttggtttaagagattctcttacggtttaagagattctcggccgcgcgcggtggctcacgcttgtaatcccagcactttgggaggccgagtcaggtggatcatgaggtcaggagatcgagaccatcctggccaacacggtgaaaccccgtctctactaaaaatacaaaaaattagctgggcgtggtggtgtgcacctgtagtcccagctgctggggaggctgaggcgggagaatggtgtgaacccgggaggcggagcttgcagtgagccaagatcacgccactgcactccagcctgggtgacagagcgagactctatccaaaaaaaaaaaaaaaaaaagattctcccacctcagcctccagagtagctaggactgcaggtgtgtgccaccacacctggctaattaaaattttttttttgttgagacagggtcttgctatgttgtctaggttggtcttgaactgctgggctcaagcgatcctcctgccttggcttcccaaaacattgggcatacaggcacgagccaccatgccagacccttttggctttattgacagcctttgaattttaagtaaatgctgaaatgtatgtagcttactggaatatatataggagactttatagttctttctttagatctttggatttccttaagagacagagcactttacaagaccttttgtttctcaaatatacatataaacagcaacacatttgaaagataaattccaactaatgattaatgttctttgcagagaatgacaaaatacatattaattacttagggttctatttgtattttactttcatagttagaaatctgtttctttttctttcttttttttagaggcaagattttactctggtgcccaggctggagtgcagtggctcaatcttagctcacttcagccttgaaccccccagcctcaagcgatcctcttttctcagcctcctgagtagctgggactacaaaaacatgccactgtgcctggctaattatttttatttttatttgtagagttggggttgctttgttgcccaggctggtctcgaactcctggtttcaagtgatcctcctgccttggtctcccaaagtgttgggattataggcatgagccactgcacctggccagaaatttgtttaagtaaaatgactgtatcagtcagggttctccagagaaacataacatatgtgtgtgtgtgtgtgtatatgggactggctcacatgatcacatgattatggaggctgactagttacaagatctgcagttggcaagctgaggagggttgttagcctttttgttttattcaaaacatcagttgattggatgaggcccatcccattaccctgaataatgtttgcccaaatgtctgggcaccttttggcccagtcaagttgatacataaaattaaccatcacaatgacctaccttaaagttcttagctggacattttgcatttctcatcaggaacctaggctaatttacaacctttgatattgatttcaaccacagtacagttaatgagttatcagtgatgacaaatcatgatcatttccaatacaaatattaactctgattatttgtaaatatgttatttttcccacattgttctagacagtgggacatagaggtaaagtaggtaaaggtgctcacctcctgtaacttatattccagtgggagtgacagataatgcccaataaacaaataaatgtatattaaaatgtcaggtagtgataagcataatgaaaaaataaaacacagtaaagaggtaccatttcagataggtttgttaggaaaagtcctgaatgggtgacatttgtacagagatgtgaataaagtgaaggaacaacttatgtataccttgataagcacatatctaactaacatttttggcatggtttaaggtctttctttcatatatctgtattttgcatactgtggtgctactcagatatcccttctatgaaagcttgttgccccaacttctgggaatacaatgggcaggtaccccacagctgtcagccccttcagggactctctcagctgcagggcgccaacttgactaactaaggtaaccctccttcccaggatggcccacagtcaatgactgattgctgtggaaatatagagtcctatctattttggcccagctagagataactctgaagggccattctaactccagagttccctgcgggatgagccaagactgttggtagatttggatgacagtttaactttttcctctgtccaaacctgtttcattcccctcccttttcataggtttgatcccaaaggtactccttaatatacctcctgctaatcttggtctagaggtctgcttcccagagaactcaccatttaatatgaagttttgtgaacctacagcttatttatgatcttatctcagtagtacttggcagctggttttatatcgggccacggtctgcttcctgacagaatcttacatgttaatatgaacctttcttttctgactctagcactctgaaaactgactttatacctaccacacagtttggaaattgttaaaaaggttatgattcccctaaccactttgatcttattatttcactgagagatattttagaagcattggtttatcttcactacctacaggagtctaatatattgttttatttaactagagtctggtcaacattaacctctttttcgtttataaagagaatgatacggctgggcgcagtggcccacgcctgtaatcccagcactttgggaggccgaggcggacaaatcatgagttcaggagatcaagaccatcctggccaacatggtgaaaccctgtctctactaaaaatacaaaaattagctgggcgtggtggcgcgtgcgtgtagtcccagttactcaggaggcggaggcaggagaatcgcttgaaccaggaagtcggaagttgcagtgagccgagatcgcgctactgcactcccgcctggcgacagtgagactccgtgtcaaaaaaaaaaaaaaaaaaaaacagctacaaattcatgtcaatgaatagggattttcaaattatcttcatgctgcaaaaggagagaaatcactttataacttataaccatgaagctatttccattaaatatttaagaaacgcaaaattcttggtaatggcaacaaagttaaacaagttaatatgggggatttttaaaagcaactatgtttaattatttcagggtttcatataacttttgaaaaattaatatatgatataaattcccatttactgtgtaattggtattatttatgaaagaacttcattcttcctgtatcaagaaacatagggattagatttgtaatttacataatctataagcatcatcatgaattcttttcaaacctgacaccaaaagtattttaagaaatctccataccaatatctgtcatggacatagatatacacattctttataaaattttagtatatgaaatacagaaatatatacagtgataataaatcatgatctagtagagaatatcccaagaatttaagattgattaaaatttgaaaatcagtgtaattaatcatattatcaggcttaaaattaaaaaccagccagatgctatgtcacagtgctttggaagattcagataggagaatcacttgaggccaggaatttgagatcagcctgggcaacatagggagactctgtctctacaatttttttttttaaataaattagctgggcatggtggaacatgcacctgtagtctctgctattggagaggctgaggtgggaagatcacttgagcccaggagctcaaggttgcaatgagctatgattgcatcactacactccagcttgggtgacagagcaagactctatctctaaaaaaagaaaaaccatatattcctttcaataaatacaggaaaagtggttgacaaaattcactatttgctcatgataaaaactcagaaatctagtattagaagggaacttaagattccctaccattgatgtgaatttgtgtcattctctttataaatgcaaattggaagggaactttagggatatctctgaaaaactttcagttaacattgtacttgatgaaagactgaatgctttctcccttagattggaaacaatgtaagaatgtccatgctcaccatttcaattcaacattatgctggtcctagccaatgtaataaaggaagaaaaataaataaaaggcagaatggaaggacataagtaaaatagtctttatctacagatgacgtgatcttctattagaaaattctaaggattatacaaaaatgctgctagaacaaataagtgagcttagcaaggtctcaggatacaagattaataaagaaaaatcaatcctatttctatatagtagcagcactcagaaatttccatttccaagtgttattttattaaaaaaaacaactcaaaatggatcgtagacttaaatataagcacaaaaaatgtgaaagttttagaataattcatagaggaataaaaagctggagttagccgggggcagtggttcacgcctgtaatcctagcactttgggaggccgagacagacctagatgtaaattccagacttgcacttgaatcacgttcttgctacatattatctatgcaatctctgttaaattatttagtttttcttagcctcactttcttacctataaaatggagataatatctgctaggaactgttaatgtaaggcagcggttctccaagtacggtgcctggaccagcagcattagcaccacctagaaatttgttagaaatggaattcagacctactgcttcaaaaactcagggtgggtcacagtaaattgtgttttgcctttcaggtgattctgatgctcaagttttagaaccattgatgtaaggattgtgtgtattgtgtgctgagtttcacagtgtttgctatgtactaggcacataattaattttaaaaacaaatgtctaccccagcaaaccttctattctcttcccttacactatttcttccagaaatgctttccccatttttctgaaccttaacattctttcaggacccaactcaaattccatctgcccccagaattcattccaaatcataataattctctatccccaaaacatagcacttaatagctagaactgttggtgctcactggtaaccactagccacatatagctattgagcacttgaaacatagctattatgcattgagatgtgctttaagcacatctcactggatttcaaaggcttactacaaaaaggggatatacagtcgactcttaagcaatgcaagagttaggggcacagacgttctacacagttgaaaatgtgtgtataacttttggctctttgaaaatttaactactactagcttactgttgacctccagccatactgataacataaacagttgattaacacatgttttgtaggttatatgtattacatactctattcttacaagagtaagctagagataagaaaatgttattaagaaagtcataaggacttataaggaaatgtatttactatccattaaatggaagtgcagcattataaaggtcttcatccagtgagttttatactttcatatgttttcatgttactaaccagcatccttttgtttcagcttgaagaactccctttagcatttgttgtaaggcaggtctagaggtgattaactattgtttgacaaaggcaccctgaatacacaatggaaaaaggatagtttttttcaaaaatgatgtcgtgaaaacttcatatccaccatgaaaataagagaaatcatattcttatcctacatcatatacaacaatcaactcaaaatggattaaatatttgagcatataacctgaaactgtgaaactcctagaagataacatagggaaaaatctccatgacattagttttggcagtgatttttaggatattacaccaaaagcacagacaataaaagtaagaataaacaagtgggactacactaaactaataggtttctgctaagcaaggaaatagcaaagtgaaaaggcaacctatggattggagaaatatttaaaaatcatgtatctgataaggaattaatataaaaaataagaaacctgtacaactcagtaaaaacaaaacaccaaagatgggcaaaggacctgaatagaaaactttccaaaggacacatacagatggccagtagttatattacaaggtgctcagtcatcagggaaatgcaaatcaaaaccacagtgagatatcactgcatacctgttagaatggctattataaagaagagacaaaagaaaacaagtgttggtgatgatgtggagaaaagggaaccttatacattgttgttgggaatgtaagttggtacagccattatggaaagaaaacagtatggaggttccttgagaaattaaaaatagaactcctatatgatccagcaatcccatttctggggactcatctgatggagatgaaatcagcacattgaaaatatatttgtacttccaggtttattgcagcattattaacaatagccaagatatggaaactactgaaatgtccattgatggatgagtgcatacagaaaatatgctatttatatgcagtggaatatcattcagcctttaaaaaaaaggaaatttctgttatttgtgacagtagtgaaatacattatgttaaatgaagtaatttaggcacataaggacaaatactgcaggatctcatttatatgtggaatctaaaacagttgatctcatagaaattttagagcatgcaatttagtatgtacagcatggaatagtgattgccggtggctgggtggggggaaaatgggaagctgttggtcaaagcatagaagctttaagttataaataaattttggagacctaatgtattgtatggtgactgtagttaataagaatgtacttgaaatttgctaagagaatagatcttaagttttccacacacacacacacacacacacacacacacacacacacacacggtaactatgtgagattacggatgtgctaattagtttgattgtggaaatcattctacaatgtaacatatatctaaacatttggtacaccttaaatatgtataatttttatttgtcaattatacgtcaataaagctataaaaacttttctgttctgaaggaaaacataaataaagattatattttagaagagtaataagaaataaattttcctggataatttcattgttttctctacaaagaaaggaagaaaataccttttccattaaaaacaaaaagaaaatatctgatgtgcttagtgattctgagaagtcatttatgataaacacagcaaaataatataaatattatgttacctctttatcatttagaatatttttgagtttggcattatacatagtctcaaactcctgacctcagatgatccacccgcctcagcctcccataactgctgggattacaggcgtgagccattccgcccagccgccctttaatctttataacaaatatgcatcataggtgttatctccttttatagatgaagaaaggcaaatgttaagaccaaaacaaaactagcaagtggcagagctaagattcaaacacagatatttctgactccaaaacctatgtttttaactgtactgcaccatagagaaaactggttttactcatctgttcctattttatggatggggaaatttccccatacttatatattttatgtagaaataagaattgtaaacaattttttaagctgtaaggtgacattattgatttgtattttttgcaatagtggtataatttcaatactcctgtaaagtttgaggctctactattttgagataaacagaatataaaggacaatatttaatcaaatctgtgaaatagtaaacagaatattttgtaacagttttcatatgcacagcatattacaagaaagtcttgagttacagattgaatattcccaatccaaaaatccaaaatctgaaatgcttccaaatctgaaagtttttgagcaccaacatgacactgtaagtagaaaatttcacatctgacttcatgtgaagggtcgcagtcaaaatgtaggcacacaacacaaagcatctgcaaaggaaaaataaaattgtctttaggctttgtttataaggtatacacataaaaaattaatgtattaagtgtttagacttgggtcccatccccaagatatctcattttatatatatgcaaatacgccaaaaatctgaaaaaaatcaaaattcaaaacacttctgtctcaagcattttggataagggatactcaacctgtagtaaggaagatgcctgtagttgataaaatattaagtttggtgggatttaatgaaataaaaatactgtgacatgattcatgcaaagtggtttgtcatttactaggattttgaccatttctaggtaaactctggctttcttacagagtagatgttcagaatatgaatttgcatttactgtttttaaggaatgatcactgctttcattacactataaaaacatgtaaatgataaactttttaatgtgaagaggtagttttttctgttattagttgtataaacaaatgcctgaagatatagttgtaagaaggttcccaaaccaatattcttatcttgattctgagcatagcatttgatttggcctgattcatacaactagaaaggggttaatgtttatatagggtgagagctctgcctataattgttacatatcttgcagatgaaccctgtatttttaatatacatatacccatatctttttagtcttaatgttttaaagtatcaactttcttttttctttttttgcttgagagggtggtaggatagagcttgtgtgtacctcagctccagctgctgccgaatgacttccaaccaacacctgtgggtgggagctggctggttttcctttcattgtcaagcctgggcatactaagggaaaatgcacctgccagagacctctttattttcgaaatgattatcagtggtatcggccgagagagaggcagctggtgggctcctgtaccctatctagccctctatatggatctttccttctatgttggaaaaacaaagttgaaatttaccacattttggcattacacttggcagttactgtgatgaagttgatcatattagagagtcattcaggatacctgaccttcctgccttccgctaccttaagtgaaaaatctcttctgttccctaatttactgtagcatatgcttcagtgtgttgtgttgggtagggcagatatccttagactaattctaatcctgagtgattcaagactattccagtggcaatggaattttacacctatttagtcatttggaacagagaggtatctgcttgtaataggccaagacaccttaattcctcatttatccattagctacctgtggggctttatctaagacacttcagtttcctcatccataaaataggaacagatgggtaaaaccagttttctctatggtgcagtatggttaaaagcataggttttggagtcagaaatatctgtgtttgaatcttagctctgccacttgctagttttgttttggtcttaacatttgcctttcttcatctataaaaggagatacacctataatgcatatttgctataaagattaaagggcggctgggcgcagtggctcatgcctgtaatcccagcaatttgggaggctgaggtgggtggatcatctgaggttaggagttcgggaccggcctgtccaacatggtgaaaccccatctctacaaaaaatacaaaattagctgggtgtagtggcacatgcccgtaatcccagctactcgggaggcggaggcaggagaattgcttgaacctgggaggcggaggttgcagggagccgagactgagccattgcactccagcctgggcaacaatagcaaaactccatctcagaaaaaaaaaaaaaaaaaaaaaaaaaaagattaaagggcatcatgtatgtaaagagtacagaggagggcacatagcaagcactcagtaccttataacttttattattctttttcagcttaaaaaattatatgtctacattgaattcatatttattcatgaatgaatacatacgatgttttctgtgtgccaggtcctgttctaagcatgtttcaaatattgtctttatttgatctgtatggtatcctgtaaggtgaggacttaaaatattcccaatgtgaaattgtgaaattgaggcacagacaatctaaaaacttgcccaaggtcacattgctggtaagccactaagccagatactttgaaaatagtattagcatttatattatataaaatctcttttagtttccctttttttcctaatagtgcaagtttattcaccatgtttttagtttttctcaggaagatttaaagaagtgttaggtggtggccttggtgcttcagtggctatcaggtcagccagaggtgactcgtttttgtcaccagggtgtgctgtgattccaccagtctgaacttactgcagctgctgtgaagctggatgggaatctctttattgtctttgctgctgcttagcgaccacaggtttttcagcttggcgctttaccatcacctgggcaactgcctgagatcccaagttattttctttttgtgttgtaccatcctttcctgctcatttgtgtcctcgtgtaaatgaaggagctagcatgtctggcttgttagcagagtgcctagatgcccgagctgtatgttgtcaagcattatgaagctgccaccacacttattattttgctacataagaaattagtatgtcaccaaattgattgctttaaaaaatttggtatcaatagcattttgttaaacttgccactgcctttagtacttgcatctttggtgctaagttcctgatgaatttggaattaatcattaaaaatgcacataggcttgataaacttctataaaatattaatattttctatagaatataaatttttcctatagccaaatactccgtcattatgaataaatgttatctgagattctgtttataaaggatcactttctattcatttgtggcttaaaagagatacttatgtctatgtagtaagaattatgaaaagagcatagattgatttaaagtcttaagagtgtgggtgtacatgcatgcacacacacgaaatataatagggcagcatctctggcagactaatcttgctttgtataattaagaaaacttttcatgtctttcatcattctttttttctaaaattgaagtcatctcttgatggttatcatcctagaaaatttgattagtaggaagcttaaacaaataaccaaaatgaatttattagcatggccatgtgatgttggctttgtacattgttttcaatatatgtattaatctgtagttttccttgaaagggtacttgtttctacatttttatagagagtttctcagaagcctgggctgtttagtgagaaatcttgggaaatgccttaccttactttagaaaagagacttatttctccagataacactgtctttaagcaaacagtgtttgtgtaaccaccttgtagcaacattcagcttgaagataatagccttcacatgcttgataaaatgatgaaatcactgaccagcaggatccgtcagtggagtcagcattttatcacaatgtgataattctgtttaatgtggaaatggttacaaaatcttctgatatgtgtggaattcctgtttgatgaccacttgcttggaggaaaaaaaaaacctgtgcaagaaggtttagtgtgtttatttcattgtaaagacatttctgaccattttctttaattgaatagcagaagtgtatgttggttcatacactttgaaatgtaaagtttctgctcaggccattgtggaatgagcatcttccattaatctcgcttcacactaaaatgagtaagagacttatgattttttgaactgcatgtttaaattgtaattttgctggaaaagttaccaaatgaaacatttctgaagaaattaagataattagacaagacttatgaaccacacagtgtcattatttttttaaaaatatatagatgaaagactggacaaagttcaattctgcattaaggttcctttcaaagtcaaaataattaaggtaatcaagcctcacactgggcaaaggtttttttccctcttttaatctgattgacttttttttctatctttgttttttatgaactcatattttttaggagattttagggagaaaaacccagtgcctagatagatgtgaatgatcatataccaatgaatgccattagcctgttttttcatgttctttacttgtgctcttggaaatttgagtgtcttaaataattggaatgcatataaagacatatttttttctatgctaaagaaaagcaaaaactttgaaattttttgataagtggaaatatagatattacaaagaatatattacacacttctaaatctaaatttgtcaatcaccgctttttataacttaagtttttggtagaagtatgttagcctttagttttgtactggaatatttttagggctatctgaccttctaggttttcttatcccctcagtctgaccttccacataacctgtttctgttcatttattgatctcctaccttttacatatggattgattcacttttcattcattcaactaatatttattacctgcatgtatttgcctggtccagaactggggtgagatattggccataggaaggtatgatcctattgtctgttcttacagcacttatggtctaaccagggaaagaaaaaacaaataattgaatttacagttaattataattttaagttctatagtattcttaagcagtcatttttttacatctccacacaagaggaaattgtgtattccttcagcgacctttagaagcagcctgcatttttttgtttgtgaggatagttgagggtggggagagactacactggtatgttatttgtatataatgcacagctttagtggtccataattatgggggtgttgcccattgtactgtatgaagtttttcacctccagactatgccttgcttctgtagatttctctcagggctcatcatgttcgccactctctatctcagttcgcagctccatttccactgcttgccttttctttaaagataatcatggttttgtccagggctttgccttatcctttggttgagaagatatcctctggatttccccaattcctccaggttttcctaccacatcttccctgtaaccatgagtgccttctcccttgtatagatacattaattatgaattactatatacctctacaaaaaaagcactgtatgtgtccctctgcgctaggcttaaagggaatttaagacaaaggtgaatagatttgtttcaccacagtttttttgtattaactaattaactttattttatttttgcctttttctacatgttctaaaccgccccacctcttttctcaaagaatttataacctcgtctagtgtttgtggtaggtataaataaatgttagttaacatcatgattatattttgtgtatgccccagcccacagttggagttcagaaaacattgattccattaatttgtgtttatttttcatagatttctaaataaatacaaatcttttagaaaatattgactcttccatttgtgatcattatgcttgaaatcactaggtagaagatatgtcctggggaatatcagaaacactagttttctagtgttttcttactggtaaagccctaggtaatagagctttaatagcatgaatctccagaaatctaaagctaactttaattcttttcactttctcaaaactatttgcttcaatagttgaataatatttacaaaatagttaactaatttgaaaactacacacaatattgctattctacttgtttctcacaattaaattctctattagaaatcctcatggagagtttgagcttcctaaagatttattgtaaatgtacaaattttccaaaacaaaaaggcaattaaatcttctgaaatttgaacagttaattaaaatcaatattaacgtaatgttaacataattgttttgtgcatattagtttattggaagtctgtttaatcactgcctgggagactattgttttatgtaaaccagtattctattgaacggttcctttttttgtaagactggttacagttttatcccctttaaagatttctgtaagtggccaggcgcggtggctcacgcctgtaatcccagcactttgggaggctgaggcgggcggatcacgaggtcagaagatcgagaccatcctggctaacacggtgaaaccctgtctctactaaaaatacaaaaaattagccgggcgtggtggcgcctgtagtcccagctactcagagaggctgaggcaggagaatggcgtgaacctgggaggcggagcttgcagtgagccgaggtggcgccactgcactccagcctgggcgacagagcgagacctccgcctcaggaaaaaaaaaacaaaaaacaaagatttctgtcagtatcgggttgctctgcgatttagtggttggccttgataagctgagtgcaaactgtaaatttgttttctagttctgccccttctccactggttgctgcttgtgtggatcaggtttccttctgttctagttagctgtaggcttgggtagaattcagcagttaattggagggagggagagagggacaagaagagaggctccacaatccagttgctggtgtatgtcactgtagaatccactgactgatattttatcctctggaaattataaaatcctactttaacacctacttttctctttgctgatggagaaatcagggaaatcgtggagaagtcttttagattgatgctaaaagatggattgatacttctttcatcctatcagccttttagattgataggatgaaggaaggttcatcaagtttttccagacatcaagaggttaaagtcccttgctggacgggaggtagagggtcaagtggctaagtagagaatgcttatagagcagtgcttctcaaacattgccatctatcacagtcacttggagagctaatagagaatacagtggcccaggcttcttgacataggccagggcttttgtatgtatatagtaagttccctaggtgagtctaagcttgagaactcctgggggtgagagtatctccagtcagcttttcctgtagtatggtgagtggtaaaagggaagccagggacagtgggatggaagaaggactaacatctgagggcttcttatgtactgggtaatgaggtaggtgctttcaggtgttatcacattgaatcttcacagcaacacaatgctgtagatattgcttcttttttatagatgagcaaactgaagttcagaatagataaatacatttcccaaggtggcatagtgtgtaataatcaggatttaaactcctttgattctatttgaattcaaagaccatgttctttccttgccattcattccttcagcaatagaagttgagcctcagttttcttatctgtaaaatgagattaataatagtaactcattgagttatgaaaattaaataatatatgctaagcacataaagcagtgccaggtacttctgtagtaagctcctaatgttaactatcatcattatttaaattatactctagttcttgctatgggacagttatgatgttaggggatggggatacaaagatgataagatattacttgacctcaggtagtttaacaatagtgggaagacccgacagttgaaagtagtatgttatttctttttggcatccattataaaatatgtgagtaaatttagatagaaaagcaaggaatgctgaaattcagagatggagcctgtagtggcgtgcatggacagactttccatgctcgagacttccatttagtaaaaattcaggcctgttgtggatcttcagatcatttgaaaaacagtcactgagcacttggggtttgctgtatttctttttattaaacctatttttagaaccctcatgctgatctcactcttttttctttttaatggaaatattatatgcaagtacagtgtctgaaaaaaaaagtgactttatgtatagtgaaaagcttcccttcaagttattagaaattttagatcttttgagtcttaataagaatttgattttttacctttttatgactcataagcaaattcaccagataagaaaaattgaatctgaaattagttaaattttactactcttggatattagaattaaggtaatagtagaaggataattgaatttcttagctaaattgagggcttgaaaagtttctgaatttcagtactaccactgactcatgtttgagttattatggattatctaccctttgtttatatgtgtggtctgtagatagcagcagggcctggcttagtgcttggcatgagcagatattcaggacgtatgtttgggaagaatgtatgaatgagagtaggtaagtagcaaagctggtgaataagcagttgaagaagatttttgtgatatcttaccatatttaataaattactttggaagacatttgtgtactgggatctgaagaacatgactgcataatttaatgattttgtaggatttattttattaggtcttttttggtgtcactgcctcagaatgttattgtattattttgatcttcttcacttgtcaggctctcagatttacttttgtcagtcttttacagtttctatacagtcaaggaagctgcactgttacatattctttcaagattaatgttttgggaccacattcttcatagtttcttttctgtcaaaccagtcatctttggtgagaagggtgttcatgtaagcagagaagctggtgttgtattatgcagaatgtcatttcctctcacttattttattttttacccagagcctttatcctctctcagctcctgaactgtggatagagatgcccacaatccagcaaatactttttgccttctggattctttgttcagggtctttgtgctcagtgtagcttccttcctaagtagttaataggtccctcttctgctgatctcttctctccccttcccccaattgccagtggtaagaagtatgaggttccttaacatagcacacttttctgctgttccaggtgcttctcctgctgttcctactcttcttcccctacctctctctgtacctagctcctgtttcagtcaccaaggtttggggtgcaactgattctgtcaacaagtatggagcatagtacccccaaattagtttttcaaccttgtcccttcccaaccttcctcatctagtagtccccaatgtctattgctgccatctttatatctataagtacccaatgtttttttttttttgagtacccaatgtttagctcccacttacaagtgagaacatggagtatttggctttctgttcctatgttaattcgcttaggataatggtttctagctatatccatgttgcttcaaagaacgtgatttcattcttttttatggacacacagtattccatggtatatatgtaccacattttctttatttaattcaccattggtgggcagctaggttgatttgctattgtgaatagggctgcagtgaatctacatatgtacatacattcagtggaaccatttattttctcttggatatatacccagtaatgagattggtgggtcaagtggtagttttaagttctttgagaaatctccaaactgctttccccagtggctgaactaatttacattctcattaacagtgtataagtgttctattttctccatagccttatagccaatgtgtgttgtttttgtctttttaatagtagccattctgactggtgtgagatggtatctcattgtggttttgatgtgcatttctctgataattagtgatgttgagcatttttgcatatgtttgttggccacttgtatgaaagtgaccagttttaaatgaatgtgtcaatataaagttttcctcctggttcacagtgtttttcttaagagtattgcctttttttcttgaaaaagagaataaaacttggtattttttttcccagacaaatcctaaaccttaagtttgggaaagcactgtggtcttctccttacattgtatttctgtattaagacatgaatgtattttgtctataaactgatttatttctctcatctatcaatagctaaacataatttctcttcttttatgtctctctctccccacctttcccccatcatcccttcttctacctcttcccttttctccctacttttctgcttctctcttaccatttttcttctctctttctctctcctggaccctctgattttctcacttgcccttcactaactatgctcaaagaagttaaaaactgaggtcggagatggtttttgtaaagactaataattctgatgcaggactaaattaaaaatagggttcttacatgaggtttgaattagaaagttgtgtggatattgtcatgtaacttcttctagtaacctgttctattgcttacatttaataaataaaagccaagctatgacttaaaaatcttatcccgtaatcaaagtaaagtctgtgctattgttatagtgagtgttatacaaaagcaagtcagtgttagtcatttacttttggaattattatctttcttctaaatgcaagcagtactttttccctcagcagactttaagtgtaaataactagagataatataaaaatattaggaagaagggattgattatctctcatttttgattagtacagatacagaattttatttttcttttttctttctgaattttcttcctcccttctggatttttatcttctttcggctttcttttaaagagaatacttctttgctggaatcaattcagataaaaaggtagtagttttttattggttagggaaatttagtaataaaaaagaagaatgggaaagagagagataagaaaaatgatgaggaatctagtcaattatgaatttaccagtacaggaaaatataatggtaacatggatatcttctgtttcagaagagcaggcaaggattgggggttacatgcctaatagtgattcctgcaagtcaacttttcaaaatagcaacatagtggagaattctgctgaatgatattcttaaaagcataaggccagtatttatcattcagcaccaaataattacagatagctttcttcccagaggaacagaagaagtaatgtgctagtaaatgcactaattctgtatctggcctgctgtctgtcacttcatgatagtagaagagttgtggaggaaagacgttaaatcatttgagatgtttttggtgctatcttgtatctactagtcaaattttacattacacattatgcacttaaagggcataagttttaaagatatttcaatgatgttctgcctagtgtagattttttttctgtattgtgtaagttcctgacttgaggttgtgaaaccttagcttgagggtgacaatgaggtgaagaagagatgtctatgaacctgattttgtgtgtatagtattttgtgtgttctactacagaaggtccataggttttattccaaaacctaataaaaatagaaacctgtgctatgagacccaggtaagaatttggcatggaaatgttagccaggcaaatagagaaaagatacattgttttcatagactcagccacaaaactgtgccttccccctctgatctcagccgcttactgtaaagaatgttacctataagtattgtattttgatttagattcccatgtttttgagtataattgtaaccaattttatggtaattatttttgaaagaaaaacaaaaacatggtctagttatatggcagttatccaaaagtattgtctccaaagctgattccaggataaaaaaattaactattttgaataatagctttaggatcactttgataattagaggtggtaattggccttgttgtattgtatcttttttttttttttttttttttttttttgagacggagtcttgctctgtcgcccaggctggagtgcagtggcacaatctcggctcactgcaagctctgccccccgggttcatgccattctcctgcctcagcctcccgaggagctgggattacaggcgcctgccaccacgcccggctaatattttgtatttttagtagagacagggtttcactgtgttagccaggatggtctcgatctcctgacctcatgatctgcccgcgtcagcctcccaaagtgctgggattacaggcgtgagccaccacgcccagcctgttgtcttgtatcttaacactcatttttaagtcattaattaactaagctacatactttatgtgtatttctccatgtttcagagatactttggcttaataaaaaatatttttaaagagtcttgtggttttcttttttaaaaatcaactaaaatatctgatctattaagcagaatttatcattctgttaacacaatctagtctatcatatttgacagtagtatttctctagtgctttgaataaattaaatcagtcaacaataattgcatttttagtattttaaaattctgttcctttttctcctctacattttttttttttttttgagatggagtctcgctctgttgcccaggctggagtgcagtggcatgatctcagctcactgcaacctccacttaccaggttcaagcaattctcctgcctcatcctcttgagtagctggaattacagatgtgcaccaccatgcccggctaatttttgtatttttagtagagatggggttttgctacgttggccaggcgggtttcgaactcctgacatcaggtgatccacccacctcggcctcccaaagtgctgggattacaggcatgagccatcgtgcccggcctcctctacaattttattttagtattatttattctcaattagtccaggtactgatgcttgtattatgaccattaatatataatcttggcaactcttgtgtttctgttggtaaaacattttcatggattctatcataatgtgatcatttttacctatcgttaagcagtttttcatcattgtatgcttacattaactttccattctgtgttgacaaccttttaatgttaaccaaacaactaaatttactttgatcataaatttaaattgggatgaatgggtagttatagataaaaaataaattaaatgttattatagatagatgtcaataatcaactcttcattttctgattgaattgaaatgtactgctaaggttatagttacgaaaaccaaggaaagtacattggggttttcttggtgccagcatagtgtttgagaagaaagttctaagaatagcaagaggaggagtgatgaatttagcaaatctttcattagtagtaaggtgtgattgcttgaaaagaaaacaatcttttcgagtgagaaataaaaacagtggcaggagtatatatagagaaaaatccaatgcaaaaccgtcctagtgggtgtcaggtaaccctacatgctttagtacaattaaaataggaatgttcaaagtgtaaagaaacagtggaaagagaagtccatctgggaacactgagagggaaagatgcccaaagtttcagctgttttgtggtccttggggccttctggggctactggttttacagttccaagagcatattaagatttttttcagatacaaccaatgttgcagctattaatgagaacaaaccatattaacattattattttgatcctcaaaggaaacaatacaaatgcctcagcaagtgctttctgattgtgtaaaactgaaaataattaactggaaaatgatcaaggagtgattttcaaaaaagatgtgatatatatgttctgtaattggcaaaagcgaaaataatcatattaagttgagaaaaaaagtccttgattaaaagacattcaccacgccatttaaaacattttgcaaaattttagttttatgtatgttatttttaaatcaggttcatataacaaaaagaagcaaatgttttaataatatatttatgtagtatcagaaaggaagaagactcctctcccatttatttttcctgctgactcttgttttaaattctaatttcaacaccctttgccagtttggagaaatgatttgtcagctgctctgtgaagaacactaaaatgcgataggaatattttaaatgcacaagtactgaaaggaaagtgcaggcgtttcccaagactttgaactgatgctatgttgtttcttaacagtgttagatctactaaatatttaaaaggcttttaaaagataaatggctttttttcattcctcatggtgctgatgacttggttgtgtctgatttttaactgatgtcatcagtattgacttgaaacatttcatgggtccttttctcattattcctgacgagtgtactgggcagcttttgttgctgaatgataattttttatctaaggagaataccagcaacaaagggaaattccatgggcgctgaaaatggaacctgctggagtaggttcagtatgtaatttagtaataccttttcttttctttttttttttttttgagacggagtcttgctctgtcacccaggctggagtccagtggcgcaatctcggatcattgcaagctccgcctcccggttcatgccattctcctgcctcagcctcccaagtagctgggacgacaggctcccgccactacgcccggctaatttttttttttttttttttttttttttttttttggatttttagtaaagacggggtttcaccatgttagccaggatggtctcgacctcttgacctcgtgatccgcccgcctcggcctcccaaagtgctgggattataggcgtgagccaccgcgcccagcctagtaatacctttttaaattttatcagtgagctctgctgtagttcctggaaattctggtgtcatattcctttgtgcctgtagctgttcatcttcccttgggccacaagcctgtataataactcatttcactctgatctttggaaacactgtgtgaatctctattttagcatttataatgcatgtcataattatttgtttacatgaaactctcccttgccagaatgtgagctccttaaggatgagaactaagtgcttttttctttgcatctcaccagcactcaacactgggtagaaagaagggagccttggggaggcctcttggatgtgtgtttcgtagttgaaatctctgttaatttgagttagagtaagagtactttgttttgacttgaaagtcctagtgagagtcattccttaatcaaaataactgatacatgtatatatacacacatatatataactcatatatacatgcatttatgtagacctttatttgaaatatatatgaaacataacataagtgaaatatataaatgtatatttgaaattgtaatcataaatatatctgtaataacattcaaattgaagaaagataattggctcaaaaatcagttaaaaatttcttccgagatttctacttttataagtcgtatcttttcatgtatattttactttttctgtacaattaaatgttgttataaataccttcccatcggtatgctatttcacgtatagattgattatctgtggtataaggaatgtcacaaatttcaaaacttacttttttgcctttttgaagtatttgactagggaatccacagacatgactgattaaaagggattatcagctttcacctaattcaactttaagcctttagtctggctttatttaaacaagtcaagataaatgtgttcctggcttttttaatcttaaaataggaaattcatttcctctttagtaatgcattttactatgttttattagttttttttctgttgtggttaaactcattttagaaaacttttaaaattcaggatacccttttctatgaaaacaagcagaattaatttctattattaataatcagcctataaaagttatctatcattttgttatcttaatatttaattataaatatcagtttttaatttacaatggctacattaattagctgggtgcagtggctcatgcctgtaatcccagcactttgggtggccaagccaggaggatagcttgagcctgggaatttgagaccagtctgggcagcatggcaaaatcctgtgtctacataaactacaaaaattagccaggcatggtggtacatgctcgtagtcccaattacttgggaggctgaggcaggaggattgcttcagcctggaaagctgaggctgcagtgatctgtgttcatgccactgcactccagcctgggcgacaaagtctcaaaaaaaataaaaaataaaaataaatcactatgccaatgtgggagttatgatcatctctgtttttaaaaattatctatgcaagcatggggcataacctttgttatagctctttcactgcattttttggctctatttcccaaataaaatagagaaacaatattttaaggaatgtattgtccccttagctttcttattttgccttttcaggaactatttgcgtttgcggtattgcttaactatgaaatgctagaattcataacccactatcttcatttcctccaggctagtagcttaataacatgaagaaaaattgattcttgtagtacctaaaatgacattttctgcctacataacctgttaatccagttttgagttcccattacattttcatcgtcagtggcaagccagattaatttatagtataatcattcaaaaagtttagtttacagattttaaagttgcttttcatatcaattttatttatgctgtttttatatttaaattgctttctatgtgagtcatccatgtaattttcatccaaactgaaattaacctttgcgtaatttctgctttcttgaaactactttttcttttgatgattaaatattgtatgattactggagttggtgattgctaactactgagagtcagtgtctaaagcacagtttctgactggcataaatgaaactactttgcaatagtcaatgtaatttcactgtaagggtcattgtgagcagatggttttccatcctgcaggattttaaatcttgaattctacagagtttgatattttgcacattaccaggagtttaccattaaagtcatggatttcaagtgatccaactcttctagctttaagagaatattaatttatgctgctttatgttccaattcttgaaagaaactggtatttagatgaaattaggtgattgacttttagactgggcaaaattaaactacaaaggatggcttaaaaaactgagaatggagcaagtgaggctccctattcatgctatgagagtctgtttttggactccttagagcaaggtatagtagcgctgaattctttcatgaatgccacctcctttttttctctttcatcctctttttcaaaattgatacataaaattatacatatttatggggcacatgcaaaatttcattacatgcatgaatgtgtaatgatcaagtcagggtgtttggggtatccatcatcttgagtatttatcatttgtatatgttgggaacctttcaagtcctctcttctagttacattgaaatatataacagattgttgctaactatagtcaccctactctacttttgaaaattagaacttgtaccctctaactaactgtatatttgtacccattaaccaacctctcttcatcccccctcccacccacacatccttctcatcctctggtatcttatcactttactctctaccttcatgagataaacttcatgagtaaagttcatgagataaattttttagctcccacatatgattgagaatatgtgatactagtttatctgtgcctggcttatttcacttaacataatgacctcctcttcaatccatgttgctgcaaaagacataatttcattctttgttatagccaaatactattccattgtgtatagccacattttctttatccattcatccattgatggacacttaggttgactccatatctttactcttgtgaatagtgctggaataaacatgagtgcaggtatgtcttcaacatatggatttattttcctttggataaatacccaatagtgggattgctggatcatatgatggttctattttttagatttttaacaaaaatctactattttccatagtggctagaccaatttaccttccatcaacagtgtataagagttcctttttctgtgtatccttgctagcatctgttctttctttgtctttttagtaatagccattctaattggggtaagatgataggtatctcattgtggttttgatttacatttccctgatgattagtgatgttgagcattttttcatatacttgttggtcatttgtatgtcttcttttgagaaatgcctattcagatcctttatccactttttaatgggattatttgtgtttctcaaactattgagttgtttgagttccttgtgtattatcttgcatattagttccttgttgaacgagtggtttgcaaatattttctcccattcatctgctgtctttttactcttgtttttcttgctgggtagaagctttttagtttcatgtagcttaatgtctctattttttgttgttgttatctgtgcttttgaggtcttaggcataaaatccttgcctagactaatgtcctgaagtattttccttatgttttcttctagtaattttatagttttgggtcttgagttgatttttgtatatgtatggtaagagataggggtccagtttcattgttttgtgtatggatatccagttttcccagcaccatttattgaagagggtgtcctttcccaaaagtatgttcttggtgcctttgtcaaaaatcagttggctgtaaatatgtggatttatttttggattatctattttgttccattgatcaatgtgttagtttttataccaataccatgctgttttggtttctatagccttttaatatatttctaagtcaggtagtgtgatacctccagctttgtcgtttttgctcaggattgctttggctacttgggctcttttttggttctatacaaattttaggattgctttttctatttctatgaaaaataacattggccaggcatggtggctcacgcctgtaatcccagcactttgggaagctgaggcaggtggattgcctgaggtcaggagtttgagaccagcctgaccaacatagtgaaactccatctctactaaaaatacaaaaaactagctgggtgtggtgatgggtgcctgtaatcccagctacttgggaggttgaggcaggagaatcacttgaactcaggagatggaggttgcaatgagcctagattgcaccattgcactccagcctgggcaacaagagtgaaactctgtctcaataaaaaagaaaaagaaaaaaacagaaaaataacattagtatttttgtaggcattgcattgaatttatagattgttttgggcattatggtcattttaacaatattaattcttcccatccaagagcataggatatctttccatttgtttatgttctcttgaatttctttcatagttttatagtttttcttacagagatctttcactttcttggttaaatttattcttaggtatttttttgtggctattgtaaatgagattgtcttcttgatttctttttcagctagtttgatatttatgtataaaaatgctactgatttttgcatgttgattttgtatcctgtaactttactgaaattatttatcaggtctaagagtttttttggtggagtctttaagtttttctagatataagattatatcataggcagagaggggcagtttgacttccttttttccaatttggatgtcttttctttgtttctcttgcctgattgctctggctaggatttccagtattgtgttaaatgggagtggtgaagtggacatccttgtcttgttctagttcttagagaaaaggctttctggttttcctcattgagtataatgttagctgtgtgtttgtcatatatgggctttatcatattgagttgtgttcttctatgcctagtttgctgagaatttttgtgatgaagtggtgctgatttttatcagatgcgttttctgcatgtgttgagattatcatgtggtttttgtcctttattctgttgatgtgatgtgtcatgtttattgatttgtatatgttgaactattcttgcatccctgggataaagcccacttgaacatgtatattgtttttttgatgtgctattggatgtgatttgctagtattaagatgaggacttttacctctatgttcattaaagatactgcctgtggttttctttttttgttgagtctttctccggttttggaatcaggataatgctgatcttatggaatgaattagagataattccctctgcttcagttatttggggtagtttgggggaaaattggtgttagttcttctttggaagtttggtagaattcggcattgaagccatttggtcccggacttttctttgttggaaaacttgttactactgactcaatctcattatctgtttttgtctgttcacattttctgtttcttcctcattcaatccaggtaggttgtatgtaccagaaatttattaatttatctcctctaggttttctggtttgttattatatagctgtttatagtagtctctgatgatcttttatatttctgtggtatcagttgtaatgtctcctttttcatttctgattttatttgggtctttgctcttcttttctgtgttagtatagcaagtagcttatcaattttgtttatctttccaaaaacaactaaatttccattttgttgatcttttatatgttttttagtttctgtttaagttctgctctgatttttattattttttcttctcctaattttgcgtttgttttttcctgcttttttagttccttcaggtgtattttcagattatgtatttgaaatctttatactttttaaaaatttttattttattttaaattcagagggtatgtgtgcaggtttcttatgtggatatattgcataacgtttgggtttgggcttctggtatttccatcacccacatagtgaacattgtacccaataggtaatttttaaaccttcacccccttacaccctctctccttttggagtccccactgtctattatttccatctttatgttcgtgcatacccattgtttagctcccacttataagtgaggacatgcaatatttgattttctgttcctgagttattttacttgggataatggccttaagttccattcatattactgcaaaggacatgatttcattcttttttttctttttctttttttttttttttgagatagagtcttgctctgtcaccagactggagtgcagtggcatgatctcggctcactgcaatctccgcctcttgggttcaagtgattcgcctgcctcagcctcctaagtagctgggattataggtgcacgccaccacacccagctaattttttgtatttttagtacagatggggtttcaccatgttggctaggatggtctcgatctcctgacctcatgatccgcccaccccgtgtcccaaagtgctgggattacaggcatgagccactgcgcccggccaatttcattctttttaatggatgcacagtattacatgatgtgtaggtaccacattttctttttccaatcagttgttgatagaccctttggttttttttttttttttcttgagacgatgtctcactctgtcgcccaggctgaagtgcagtggcgcgatcgcagctcactgcaacttccgcctcccaggttcaagcgattctcctgcctcagccttccatgtagctgggactacaggtacgcgccaccacaccaccacacccgttatttatagtctttgtttctttctttttagtagagacaaggtttaaccgtgttagccaggatagtctcgatctcctgacctcgtgatccacccacctcagctcccaaagtgctgggattacaggagtgagccactgtgcccagcctgatagacacttaagttgattcaatcactttgctattgtggatactgctgcaataaacatgagtgcaggtgtcttttttatatgatgataaactctttctacctttttgatgtaggtgtttattgctataatgaacttccctcttagcactgcttttgctgcatcccataggtttgatttgttgtgttttgatttttaattgttttaagaattttttttatttcatccttgaccgagtggtcattcagtagcacgttgtttaatttctatgtgtttgtatggtttcaaaagttcctcttgttattgatttatggttttattttgatgtggtctgagaaaatacttgatatgatttcatttttaaataattagttgagacttgttttgtgtcctaatgtatagtgtattctgctgagtgttccatgtgcttatgagaagaacatttattctgtaactgttggatgaaatgttttgaaatatctgttaggtccatgtggtctaatatgcactttaaatccaatgtttctttgcaaattttctatctagaggctaattctgagagtgggatgttgaagttcctaattattattatactgaagtctttctcactatttaggtctaatagtattttctttatatacctgggtgctccagtgttgggtggaaatatatttagaattgttatattctcttgtggaattgatctctttatcattttataatgatgacctttttttttctttttactgttttgacttaaaatctgttttatctaagtatagctactcctgcttttgcttcttattggcatggaatatattttttccattcctttcctttcagcctgtatgtgtctttacaggaaagatgagttacttataggcagcatatagttgggtcatgttttatttatttatttatttttaattctttgaacctgtctatattttttaagtggaatatttaatccatttacattcaaggttgctattgatatatgaggccttattcctgtcattttattaattgaagtcattgttatttatattctttgtttctttcattctctcttattgtttatctttgtggtttggtggttttctgtagaggtaatatttgagtctttttatttgtgtttgcttcaccagtggtttttatattttcatatgttttcatgagggtagatttcattcttttgcttctagatgtaggactcccttaagcctttattggaggatgggtctagtgatgatgaattttctcagcatttacttatctgggaaatactttagttctctttcatttatgaaggataaattttctgggtatagtatacatggctgtcagttttttttctttcagctcttgtgaatatatcatcctaaactcttttgacctgtaagctttctgtggagaaatctgctgttagtctgatggggattcctttataaatgattagatacttttttcttgctgtttttggaattttctctttgtctttgacttttgacagtttgactataatgtgctgtggagaagtcccttttgagttgtatctgtttggggatctgtgcacctcctgaatctggatgtctaaatctcttgctagggtagagaactttttatctattatttcactaaataggttttctgactctctcattttctcttcatcttctggaacaccaaaaatgcaaatatttggtcactttatggtatcctatgtcatctaggctttgctcattctttgtttttcttttttctttatttttgtctgactaggttatttcattagacctgtcttcaagttctgagattccgtcttctgcttgatttagtttactattgaagcttttgaatatattttgtatttcactggttgaattcttcagctccagaatttctgttttattcttttttatgatatgtttttggtaaatttctcatttatatcccaaatatctggcttatttgtattgtttttcagagttcttctgtatctcactgagtttctttagtatacatattttgaattatttttctgggattttgtaaatttctctttggggttgattgctagagaattactacattcttttggaggtggcatatttccttctttttcatgtttcatgtgtccttatgttgctctctgcacatcttgtgtaacagttgcttctttcaacttttttgagtttgctttataggggagaactttttttttttgaagatgtatcatggtattggttggatagggcacttggctttgattctgggtgtgtgcagtagtacagcttctatgtaatttctttggcgctaaacagcatcagtggtgtctgtgatttctttggtggcttagggtgtgattgttaatggaagctgtggtgaaattttgctggggactgggatgccaggtgggccagttttggggccccagtggtggcagcagtgagctgagtgtgcctgtccttgggccttagggtggtgtatgctggcactggcagtgggtccagaaaggcctattcttgagcctccaggtgacttgcttaggtgccaggaatggcagtgtgggtcaggcaggtaggcaggttctcggtcccctgggcggctggcatggagtgagtgatggcagtatcaatggtgggacaattgtctgggacaaaagtagtctgtgctggtgttggcagtggctgtgacaggctgggtgggcctgtctccagggccttaggagagtgtgtgggtgggtgccagctgtggtggtagcagcaggttgggtgggcctgaccgcaggctctgggaggagtacccgggtgccagtgatggtggacttaactgtttgatcaccaggtccttagatggcacgcttacttactggaggatgaatcttcaggtggggtttgacgcatctgtactacagccctgctactgaggagggcaagatgcctttcagtgggagcaactgtaagcaggcggctgggacgcatgcactttgctcatgctttggccttgcagtagcccatagtggcagtggctgtgggcatttgaatttgtccttggggtgtgtgaaaatgcatgacccttctgctgctggggtgaggttgctgccagtggctcctgcattggccctggcagaggctgctgcaggcagcgaatgtaaatggcactccagggatgtggggatgcaggggctgttgggacccagggaatgatgcagtctgatgggggctgagttctcaaaatggtgctgtgccatgcctgtttaggactcagggtttgtaggactcagtatgagctctctctggagcaatactattgcacagtctccaggcagctctctatgttggtctcagggcctgcaggggtcaagtcttttcctgtgtttctcctatgactaggattgcaggagttcacagtgggaacgtggactgctgggggatctcttacttatcatttccccacattagggagcctctccaggctcccagctgatctcagtcaagcaggctgacttgcttccctttcctttcttgctttaggtgtttctgtcacttccctgttgaatgccagtgttctttcttagaggatctattttaagtgtgattaactacttgctatttgggttcttctttgtggaagagaagagtaccagatgcatctagtcagccatcttgaacttgctaccttctactttcactgacattcaaattataaatctttagagaaataatggagatacttatactttttctttcctaacattgaaatgtgttttgattaaagacaacaatgccttgtatagcagggatatagcttatttatgtttgtcttcttagtgcctgccacagaatggctactcagtaatttagtgaataaaagagtaaatgcattgatggatgaatgaaaatccctcggttatcagtgtggaaatttttaatcattagctatgttatcctgcctgtttggccttttcaggaacctatctctactaggtaagtcctcactagggcattaggctctaaattctaatctctagtgttactgttaccatgattttcagaaaggaattaacttcctcccattttaatgaaacataaaatgctcttgcatatgttttaatagaattaacacagtatgatttctggttgaaataatcttttttcatttttgcttattaataaataatgtatcaatagtgaatgatttatcataagtaaatggtaaaatacaattcacacagattgtcccttgaggtctaatatcttttgtataaaaaaagtttttaaaaataaatattttgtgatggtcataggcttctgaagttattagaaagggatatatggattataggaaatattttcctgataatatggtagaataaaatttttctagtttttatggtgattctttactttccttttagacaattccgtgtgtgtatgtgtgtgtgtgtgttgtgtgtgtgtgttatacttgcatctgtttcttcatctgtgcccaaaaagtgggttctcaaattttcagttagctttctattcttatctctctgtagacagcttctcctttggaaaatagcatctattttcagggattcaaatattacttctttcaagttaattcaataatatttctctttagttttaatccacaactgagctccaattctaatatcatcaaattatgtaatgtacatttccacctggaggtctcccagacagtccaggttcagcatgtctgaaatcaatttttttcacttttatcattctccctagcttcagagacttgggctcaccttccatcccactctctgtatctccctccctgcagttttttcttttcttttcctgggaggtagcttttgtatcatttcccttctcattgttcctctcccaattcagccatttatcctattgtcccataatagatttccttatagctacttaacttttcttctagtctactcccacctccctgaacaaatataaactggatacaactgtttacttcagcatattgctttcctctaaataacttcccatgccttatatactctgtagttaatatctaaactcattagcctggaattcaaaatctgaattttgccccactctgcatttctggttttggttccagtccttcagcttctgaaatctacctcagcaggtcagcacatgtactctttaacatgtcttgattttctgttttttttctcatgtcccttttttatctcagttttcttttcatgaatctatcccatttcaggaagctaggtttttgttgttttggactcttctcagaattcctgtagcacttatataagccatttatttaatagttaattgttgacagtgtgacattttctatatttttgtcctatgttatttatttcaagttttctcatttttttcacatgattatatgcttcttcacaaactaactgtgaagtcctaaaatagtctttaagatcagagactatatataatatctttaaatattttttttgttttttttgagacggagttttgcttttgttgctcaggctggagtgcaatggcagggtcttggctcactgcaacctctgcctcctgggttcaaatgattctcctgcctcagctttccaagtagctggaattacaggcgcccaccaccatgcccagctaatttttgtgcttttttttttagtagagacagggtttcactatgttggccagcctggttgcgaactcctgacctcaggtgatccacccacctcggcctccaaagtgctgggattacaggcgtgagccaccgcacacggcctaaaatgtttttataatactgaagtaaaacctcaaaagacccataatttcttaattataattaagcttttattgagttatatcttttgtaatactttctatgtataaaatattatttcaaaaaacattgaaaactttacgaagactctcctgtgtgccaagaacaagtcttaggagctgctaactctgttcatctcaccccagtatagtactgtataaagcgtaataattggtaacattagttgataaagcaaaaaaattaactcatcagtcaaaagaaatatccaattaaagttgagtgggccctatttgtacatgttttagtgactgtactcatagtaatctataaaaataattccaggagtctccttcagagaggacattaatctattaagatattaagcttatacaatagatgattcataatctctaaatatgaaaataatgtaaacattttcaaaaaggagtaaaatgacatagaggaagttatacttgtaaaattatgagtgagtaagtgacctacaaacacataaatattttagcattaaatgactgaattaatgaatgaattagagaataaatgaaccaccatagagatattattgtcaattcaaagataccttctaagttgttgcagcattggaaggagaaatctagaaagagaaaataatggatgtcttttaaaaaatcaagacttttttttagagcagttttaagtttgcttaaacacttctgcttaatttttaaagaaaaatggagcagaaaacccagttttcatatttccccttacatacccctacacagaggtttccatgttattagcaccttgcattattgtagtacatttgttacaatattgaaccaatattgatgcattattattattaactaaagtccacagtttacattagggctccttccttgtgttgtacagttctatgggctttgccaaatacataatgttatgtatccactacagtattatacaggatagtttcactgccctaaaaaactcctttgcttcacctacttatctttcccccttgccttttaccaggtggattcacagctgaattctatcaaacattcaaagaagaattgataccaatcctattgacactattccacaagatagagaaagagggaatcctccctaaatcattctgtaaagccagtgtctccctaatacaaaaccaggaaaggacataacaaaaaaaggaaaactatggcccaatgtccctgatgaacatagatggaaaaatcctcaatgaaatactagctaaccaacttcaacagcatatcagaaagataatccaccatgattaagtgggtttcataccagggatgcagggatggtttaacatacacaagtcaataaatgtgatacaccgcataaacaggattaagaacaaaaatcccttgatcatctcaatagaagcagaaaaagcacttgacaaaatccagtatccctttatgacaaaaacctcagcaaaattggcatagaagagacatacataccttaactggaacatgacaggggaaacaaaagctctggttttcattgagtatttaaataattaaactttttctccaataaaaacttatcaattatacttttttttgggggggggcggtggacagagtttcactcttgttgcccagggtggagtgcaatggtgcgatcttggctcactgcaacctccgcctactgtgttcaagcgattcttctgcctcagcctcctgagtagctgggattacaggcatgtgccaccacgccaagctaattttgtatttttagtagagatggggtttctccatgttggtcaggctggtcttgaactcccaacctcaggtgatccgcctgcctcagcctcccaaagtgctgggattacaggtgtgagccactgcacctggccaattatacttcttttaaaaaattttctgatgcccagcgttggccatatacataaataacactatattgctttataagtagtgcaggtattcccaattcctgcctcccatcctttataatatttttgttattcattttacttatccataagctatagtcattgaatacattgttcctattattattttgaatacattgttgtctgtaacattcatcttttctttatataatccaagtttctaacctaagccattatcctctcttcttaagaggttcttaagaacctctgttaactttttttatccccccaagacagagtctcgctctgtcgcccaggctggagtgctgtggtgcaatcacggctcactgcaatctccacttcccaagttcaagcaattctcctgcctcagcctcctgaatagctgggattacaggcgcatgccaccatgcccagctaatttttgtatttttagtagagatggggtttcaccattttggccagactggtctcgaactcctgatctcatgatccacctaccttggcctcccaaagtgccgggattgcaggtgtgagccaccacacccggccaacacttctttcaagataaatttcctcatttatcagttctaggagctttttggaggagtctttagggttttcttggtatacaatcatatcatcagcaaacagcgacagtttgactaactctttaatgatttagatcccctttatttctttctgttgtctgatagctctggctaggacttccagtactatgttgaatataggtgatgagagtgggcatccttgtcttgttccagttctcaggggaaatgctttcaagttttccccattcagtataatgttggctgtgggtttgtcataggtagcttttattatgttaaggtatgtttcttctatgtcgattttgttgagggttttcatcataaagggatgctggattttgtcaggtgctttttctgcttctattgagatgatcatgggatttttgtttttaattctttttacatggtgtatcacatttattgagttgcatatgttaaaccatccctgcatccctggtatgaaacccacttaatcatggtggattatctttctgatatgctgttgaagttggttagctagtatttcgttgaggatttttgcatctatgttcattagggatattgggccttagttttcctttttttattatgtgcttttctggttttggtattagggagatactggcttcatagaatgatttagggaggattccctctttatcttgtgaagtagtgtcaataggattggtatcaattcttctttgaatgtttgatagaattcagctgtgaatccatcttgtcttgggctttttttgttggcaattttttaaaattaccatttcagtctcgctgcttattattggtctgttcagagtttctatttcttcctggtttaatccaggagtgttgtatatggccaggaatttgtccatcttttctaggttttctagtttatgcacataaaggtgttcatagtagccttgaatgactttttttgtatttctgtggtatcagttgtaatatctcccatttcatctctaattgagcttatttggatcttctctcttcttggttagtctcactaacgttattaagtttgttaattaattttcgaataaccagctttttgttttatttatcttttgtattactatttttgtttcaatttcatttacttctgctctgatatttgttatttcttttcttcttctggatttggatttggtttgttcttgtttctctagttccttgaggtatgaccttagattgactatttgtgctttctcagacttttagatgtgggctttagatggactttcctcctagtgccatttttgctgtatcccagaatgtgataggctgtgtcactattgttgttcagttcaaagaattttaaaagtttcatctgaattttattgattgttgactcaacaatcattcaggagcaggttatttaacttccatgcatttacatggttttgagtgttctttttggagttgatttccaactttattccactgtggtctgagagagttcttgatataatttcaattttctttattgagactcgttttgtgggctatcatgttgtctatcttggagaatgttccatgtgctgatgaatagaatgtatattctgcagttgttgggtagaatgttcagtaaatatctgttaagtccatttgttctaaggtatagattaaatccattgtttctttgttgactttctgtcttgatgacctgtctagtgctgtcagtagagtattaaagtcccacagtattattgtgttgctgtctatctcatttcttaggtctaatagtaattgttttataaattcgggagctgccgtgttaggtgtatatatatttaggattgtgatattttcctattggacaagttcttttatcattatataattttcctctttgtctttttaaactgctgttgctttgaagtatgctttgcctgatataggaataggtactcctgcttgcttttggtgtccatttgcatggaatatctttttccacccttttaccttaagtttatgtgagtcctttttgttaggtgagcctctgaaagacagcagatagttagttggtgagttcttatccattctgccattccgtacctttttttttttttttttttgagatggagtcttgctctgttgcccaggctggaatgcagtggcatgatctcggctcactgcaacttccacctcctgggtttaagcaattctcctgcctcagcctcctgagtaggttggataacaggtgcctgccaccacaccctgctaatttttgtatttttagtagagacggggttttgccatgttggccaggcaggtcttaaactcctgacctcaagtgatccacctgcctcggcctcccaaaatgctgggattataggcatgagccactgcacccagccagcattctgtatcttttatgtggattattttaggacattttcattcaacattagtattgagatgtgaggtactattctatatattatgcgattttttgcctgaataccttggtttttttcattgtgttttcgtcttataggtcctttgagatttatgctttaaggaggttctattttggtgtattttgaggatttgtttcaagatttggagctccttttagcagtgctggtttggtagtggtgaattctttcagcatttgtttgtgtgaaaaagactatctttccttcatttatgaagcttagtttcactggatagaaaattctttgctgatactgatttagtttaaggagactaaagataggaccccaatcacttctagcttgtagggtttctggtgggaaatctgctgttaatctggtaggttttcttttatagttacctgatgcttttgccttacagctcttaagattctttccttcatctttagataacctgatgactgtgtttctaggtgatgatctttttgcgataaattttccagattttctttgagcttcttgtatttggatgtccagatctctagcaaggccagggaaattttcctcgattatcccctcaaatatgttttccaaacttttagatttcttttcttccttgggaccaccaattattcttaggtttggtcattcaacttcttaaagtctttgttcatttttcttttcgtctttgttagattgaattaattcgaaagccctctctttgatctctgaagttctttcttctacttttttgatgttattgatgagactttctggtgtgttttgcatttctctaagtgtgtccttcatttcgagaagttgtgattattttttatttatgctatctattgcagtgaagatttttcacttcagatcttgtattatttttaaaattaaatttatttggacttcacctttctctggtttccctgattcacttagtataatcgaccttctgaattctttttctggcaattcagagatttttatcttggtttggatctattgctggtgagctagtgtggtcttttgggagtgttaaagaaccttgttttgtcatattaccagaattgtttttctagttccttctcatttgggtagactatgctagagggaagatctagggctcaagggctgctgttcagattctgctgtcccacagggtgctcccttgatgtggtgctttccctcttcccctaaggatgtggcttcctgagagccaaactgcagtgattgttatttctcttctggatctagccacccaagagagctacgaggctctgggctggtactggggagtgtctgcacagtgtcctgtgatatgtgaaccattttcaggtttctcaaccatggataccagcacctgctatgattgaggttccaagggattgaagtggactctgtgagggtccttggttgtgtttttgtgaagtgtactggttttgtgttggtttgcctccagtcaggaggtggtgctctcaagagtgtatcagctagggttgtatagggaggatacaagcttgccctagggttgccgttggataagtattcaggtttctcaggtggtgggcagagccctagagttcccaagggattatgtcctttgtctttggctaccagggctggtagacaaagatcatcaggttgggggaggattagacatgtctgatctcagactcttcttgggcgggtcttgctgtggctgctgtgggggatgaggatttggttctcaggctaatggagttatgttcctagggggattatggcttcctctgctgtaacatgcatgtttccagggaagtcagggaaagctagcagttataggcctcacccagctcccatacagcccaaaaggctggtctcactcccaccatgcccctccaacagcactgagtttatttccaggtagcaggtgaacagggctaagaacttgccccaggcctcccggctgagaaagcaagtggggctttcaagtttcatgcctccccacctgccatggcttctgtgctgtgtctatacacgtgatttgcccccttcccaaggttttgtccaggaagctttgtgtgcagttgaaattgttacaaagtttagctggaagtttccttcttcctatggtcttttcccagttcctttggcagcccttcccatggacccctgtgagacaaagtcagaaatggcttccctggggaccaagagtgcccacaggactctttctgctgcttcttctaccgttgtatttcactcagttctctaaatttgtctcagctccaggtaaggtcaaatccttttcctgtgatctggaacttcaagttcctcagtgagagtgtgtgttccagggcagatgattcccctttcacactttcacactctgggcactagcagtttttcagctgtctcttggggcctgcaacagcaatcttccttcttcaaagggtctctggattctcttggttttcctggtatgttcctgccatagttcttggaggaaaagttcataatgtgaatctccacatgctgctctgtccatctgagtgggagctgcaaggtagtcctgcctcctatctgtcattttttcccacatcttagcctacattttcttctactgctcttgtttatgtttcccctcttgtctttgggtttccctaaagactccttcttaaataggacctatgacttgcagttctttcagctgtaatccactgttattattcaggaacctaattgctgtgctaatgaagtgtggagggagggaaagtgttctgtgttcctatgattaggttttattttgtgctaatgaagtgtggagggagggaaagtgttctgtgatcctatgattaggttttattttgtatatgagtcggtttccccagtctgtaaccttcacaagtgcttctactccattgcccctcatgtgagacaggaagtctagaggtgtttgaagttaggcattcctcttcaccagtgtcaaagacacagggtgctagagttggatattttcctgcccccaagtgagttaggctctcataaatcacagatgagataatctctggcaaagtagtttctttttaatttgatttttattattaatatctgctgggaaaccgatcacaacttgttcaaattgttcctaaaatcagagcaagcagatattgggtgacagcttcaaaaactgtcttctgaattatgaatgtaaacttaataacataaactttgagacatttattaattatctttcagggttttggcatttggtggatgagattgccaacctaatgtcttataggcaaatgaggtttaatcttgttgtcctaatttttcatgcattacttattaaaattaagctccaaacaaatataaatatagttcagcattagtagggaatccagcgatatgtctcctgtaaatgttactaacggttgttagctgtatttgtaagtttacattgatcttggacttcccaatgccattacctaaaatgtagaatccagaatgaatctaacttgaacctatttttcttcctggtttattagagatgtttatctgagagattactatgaatcataggattgtgagattgcctgtggtgacagaaggcatttttccaaatgtagagcttctgcaagtcttcaaaataattaaaattcataaaacacatgtaacagatggcataagtgtttgaactaaatgtgtgtgactttttactacttagttttacataataatgtgtttgtgcagttaaggtggtgacctctcatgataacttctacagatacataaagtgaaatgtgctctctggagttgctaaaatgtgacaattttagaatagatatgaaagtacttttctaatgatttttctataagttcaccattgtaatatcaaattacaaactcctgtcatttggagtttcttttctttgatatttagtcctttccttcaccaaaatggcttgagagaattaactggcagttagtgctgtgttctatagcattcagtttttcctgttaaaccttaaaagccatgtgtatttgaaacttttaattatgttttaaatatctctttgaatataagaagaaatgttatgctcttcatttttatcttggttttgaggagctaaaatcagttcttatccatcaactatcccctttacctcaaaataatacaaccataattctgacttgattatctgtgggtaatggtagatttgtgttaactcatctgtttcgattatatattgctgtgtgagaaaccattcccaaatttaggagcttaaatcaataaccattcctgttgaaacaaagatcaaatccttaagaattagtttagtgagaaatatgcaaaacctgtactaggaaaaagtttaaatactccagaaacacataagtagagttgaaaaatagagacttcccctctttgtatacaaacactcaacattattaagatgttagttctccttactacattagtgtacaaacttaatgcaataccaacaaatgtcccaagaaactattttatggaattagatcctatatttgttgatcatgtatttgtattgttacaaacatgtaacaaaagttaggaaaaggccaaaaaagagaaaactacaagtgatggctagccctatcagacattaaaacctagtaaaataggagatatcttctttttttttttttttttgagaaggagttttgcttttgttgcccaggcttttgttgcccaggctggagtgcaatggcactatctcggctcactgctacctccacctcctgggttcaagcaattctcctgcctcagcctcccaagtagctgggattacaggtatgcaccaccacgcctggctaattttgtatttttagtagagacggggtttcttcttattggtcaggctggtctcgaacctccaacctcaggtgatctgcccgcctcggcctcccaaagtgctgggattgcaggtgtgagccaccacgtcaagccgagatttcttctataactaaaacaccgttatactcatgcttgtatcgaccaatgaccagtgaaataggatagaatgtccagaaataaattcaactacatctggaaatttagcatgtgataaatatagcatctcaaatgactgggctaaagacagacattttagtaaatggttctggaagaactagatcaccatttggaaaaagatattttataccatgtcttatattacacccaaaaataatgcactagggatctaaatgtaaaaaataaaaccatacaagcactagaagaaaataaaagtgcatttttctttaaattttgtatagggaaaggctttttaactctgacttaaaatcagaggcaataaaagagaagattgataaatttaacacataaaacattaaaaaaattttatgctcaaactactataaatgaagtcaaaagacaactgacaaagtgcaaggaaatattcacaacatctagggaaaaggctgatatctctaatacataaaggaaaaaggctgatatccctaatacataaaaaactcttaaaaatgaagaggcaaaagatcaaaaagtctaaagaaatcttctcaccacaaagaaatgataaatgcatgaggtgatggataaagtagctactctgattggatcattatactacatagatatgtattgaaatatcaaattttaacccataatcatgtacaatcataatgtaccaattaaaaaataataatttttaaaaatgaggaacatatctatgaatttatttggagtaatttctagaatattctgttatgaaaaaatagcaaagtgcaaaagaatgtctccagggcacttctttcatatgagaaagaaggagatattagaaagtacttttgtgttctgctcatttgtgagaaaaacatatacaggagttaataggtaagactctgaagaaattagttatgtacatggattgagtagaaatgggttggaataaaggagaataacagcagagtagtatggatgaggaaggcataccttttttgtacggctttgactcttagaatcatagtaatattttacacagaaaacaaagtaaataattgaaatcagccaagtcagctttttttttttttttttttttttgaccgtagtgaggagtcatctagaggtttgacttggatgtagagaaagtttggtctctcttccttgtcatgtagtctcacggccttttcagtaacttccccctttatctctgcagcaagatatcctgtacttcttacacgatggttccaaactccaagagtataagagcaaaagctaccaagcattcctaatgtctaggctcagaaatcccagaacatcatttcctccatattctattgtcaaagcagtcataggctagcaaaaaaccaaaggtgtggaggatgacttttacctctgggtgagagaatggtttgtgcatacaggagggaaggaattgatagtgactatctttggagtttagagatcattgactgatatcagactatgtctcatgatgtagcctgactgtagaagagggaagagccaaatgactcacaaaggagcatagtctcttgtgggatgtcatatttacttttttgaaaataactgagcagtcattagattatcaactgaaatctttctgattgtaagaagatatgttactatttctgagattttctttgtaactgaaagtagatagctagtattgcaactacatagtgtaacataataaatctttttacatggtaggtcatcataatgttgattattcttgtgcccttgctaagttttctatttttaatcttcatacttttcaactattcttcattttcattgttagcagataaatgtactattctgtctatctactgtggccattctccaatttgccattgattgattcactcatttatttacttaacaaacaaatatttgtttgattacattagaaacacaaagatgagtaagaaatcatttttgcatcaagattagtctaacaaaggggaaagactaattaaaacacaatagacatatgacacaaatatgttggaaataggcttgtttggggacgttttaccaaagatatgatatttgtgccagaatttgaaggatttattgttcttcaagtggtggaagtacagtagagcattttaaaaagactcagtagcccaggccttggctcaaaggtctgagagtatgtctgacaagatgggatgctcagactagatagtgtgtctagaatattagtgtaaaattagaaattgttttacattttaaaaaattgtagtaaatataaataagatataattttccattttagccattttaaagtgtataattcagtgaaattaactccatttacattgttgcataaccatcaccactttccatctccagaacttaccatcccaaaccaaaacgctgtacccattaaacaataactttctattaccccttcctcaacctctggcaaccaccattctgctttctatctctatggatcaaattagaaattgaaaatttctgttctctagactgttattgggtattacacagtaggtaagtagcagtcctagcgagggagaaaaaaaaaaggatggagagtttgttgcttattatagctgaatttctactgcttggatggaaacatatgacccccacaggtttaatgcagagagtgtgttttagaagataaacttctagttcattatgtaaatattttttgatacattccaggttaattcttgcttgatattctatggtgagtgcattgagatattactcccaaactggccacttggttaaactagaatagtatattatttagtggtataataaagagtataattgctgagattttcatctgtttttattcttttgttgcagttttcttttttaaaaacttatacgaattttttaaattgcctgaggtgttgttcaggcatttagattatctttcttttcagtctaagagtaattatgaagcaataaaactgccagagaaaagtaaaagttgaagtaattaatattttattattttcttttatcttatttttctgtttatgttagtttgaaatcattgatttatatatgagtgtagtgatcagtagtagaataaaagtgccactttgtttaattcttacaatatcttaaaagaatgttaatagtaaattgctcaaatattagacattgtgcaaagaaattacaatacaaatcaagtgtcttgtgtttcatattttaaagttattttttataaatatgtattataaagtagactagtaatttagtaaggatatatgtgttaatcatactttgacttggaagaaacatgtattcactatctgaaaatttatacagaaagattgcttatctttctatttcttttctgtagtttcagttaattaattttgttagtaaggttgttattctgtcattacattttttttttttttttagacagggtctctctctctgttgcccaggctggagtgcagtggtggtgatcttggctcagtgcagccctgacttcctgggctcaagtgatccatccacctcagcctcccaaatagatgagactacaggtgcacgccaccacacctggctaattttttattttttgttgaaatgggatctcattatgttgcccaggctggtctcaaactcctgggctcaagcattccttccgccttggcctcccaaagcactgtaattataggtgtgagccactgtgcctggccctctgtcatttcttgactatattatcctcacaatagagtgacgaaaatgatggggaaccatcattttgctaagcactgattattttttttgcttcagatttaaaaaaatcaagatacagttcacgtaccataaaacttacctctttaaagtatatattttgctggcttttagtgtatttataaatttgtgaagccatcaccactatctaattccggatctttttttttttccccagaaggaaatcctccacccctcaactttgtcacatcccatttcccctcctccagctcgtagcagtcactaatttacttttcatctctataaattggcctcttctggacatttcagataaatataatggaaatatataatctgtgacctttcgtgtctggcttcttttacctagcataatgctttgaagagtcatcaacattgtagcatgcatcagtacttcattctttttgatggccaaatactattctattatatggctataccaaaatttgtttatacattcatcagttgatagaaatttgagttgtttctattttctggctattgtgaataattcttctgtgaatatttgtttgcaagattttgtgtggatatcttttcagttctcttggttagatacccaggagtggaattgctgtcatgtgctaactctatgtttaaccttttgaagaactaccaaactttttcccacagaggctacaccattttacattcctaccagccatgtatgagggttccaatttcttttcattcctgctaacacttataattttccattaaaggaaaaacctatagccatcctagtgaagtagtattacactgtgtattttatttttattttccaaatgactaaggatgaagagcatcttttcatgtgcttactgatcagttgtctttggagaaatgtctattcaaattctttacccattttttgttgatttatttagtcttttttattattgagttgttaggttttttcatattataatactagacctttatcaggtatatgatttgtaaatatttttttccatcctttgggttgtcttttcactttcttgatagtgtcctttgaagcacagaacttattagttttgatgaagtccaatttatctatttttaagtgtggttgcctgtacctttgttgtatataagaaactattgcctaattcagggttatgaatatttacccttatgttttcttcttagagttatatagcatataaatgtagtgttttagctcttatatttaggtctttggtctgtcttgagttaaattttatatgtgatgaaggtccacaaatgttagtttttaaaaatactcttaagtgtgagatgaaaaagcacttacagtttgggagctttttttctcccgggtcactttctcctgtttctttagcttcaatagaaagactctggactcagtgcttgcactgccttttgcctggactgctcttttccaggccttttgcttgactggctccttctcatcattcacactgcagagtgttcttctctaacttttctagctagatcagctaaccctttcataccccaccgagtttaattcttcacaactaaatatatctagttaattttaactttaagttcagtggtgtgagtgcagtttgttgtctgtatgacaaacccccatgacacaagtttacctatgtaacctatttgttacataggtaaacttgtgtcatgggggtttgtcatacagattatttcatcacccgggtattaagcctaggcttaataaaattggttatttttcctgatcctctccctccttccactctcctccttctgataggccccagtgtgtgttgttcccctctatgggtccatatgttctcatcatttagctctcacttataagtgagaacatgctgtatttggttttctgttcctgtgttagtttgctaaggataatggcctttagctccatctatgtccttgtaaagcatgtgatcatgttgtttattgtagctgcatagtattccatggcatatatatactacattttctttatctagtctatcactgatggcatttaggttgattccatgtctttgctattatgaatagtgttgcaataaacagacacgtgcatgtgtctttataatagaaagatttatatatttttggggtatatacccagtactgggattgctgggttgaatggtagttctgtctttaggtcttggagcaatcacaaccacagtggttgaagtaattaatactcccatcctggacgtataaattatacagtgtataagcattcctttttctctacaaccacactagcatctgttattttgtgactttttaataatagtcattctgactggtgtggtatagtatctcattgtggttttgatttgcatttctctagtgatcagtgatgtggagcttttttcatatgattgttggctgcatatatgtcttcttctgaaaagtcctgttcatttcctttgccctctttgtaatggggttgtttactttttccttgtaaatttgtttaagttccttagagatgctggatattagacctttgtcagatgcatagtttgcaaaaattttctttcattctctaggttgtctgtttacttttttgatagtttcctttgctgtgcaggagttctttagtttaattagatctcatttgtcaatttttacttttgttacaatttggcatcttcgtcatgaaatctttgcttgtgcctgtgtcctgaattgtattgcatatgttttcttccagggttttgtagttttgggctttgcatttaagtctttaatccatcttgagttgaatttgtatgtggtgtaagtaaggggtctagtttcaatcttctgcatatggctagccagttatcccagcaccatttattgaatagggaattctttccccattgcttgtttttgtcagggttgaagatcaggtaactgtaggtgtgtggtcttatttctggtttctctattctgttgcattggtcaatgtgtctgtttttgtgccagtaccatgctgttttggttattgtagccctgtagtatagtttgaagtcaggtagtgtcatgccctcggctttgttctttttgcttaggattgcgtaggctatttggtttttttttttggttccatatgaattttaaaatagttttttttctagttctgtgaagaatgtccatggtagtttaataggaatagcattgaatctacaaattgctttgggcagtagggccattttcacgatattgattcttcctatccatgagcatggaatatttttctatttgtgttctctttgatttctttgagcagtggtttgtagttctccttgtagagatatttcaccttcctagttagctgtactcctaggtattttatactttttgcagcaattgtggataggattgcattcttgatttggctctcagcttgactgttgttggtgtataggaatgctagtgattgttgcacactgattttgtgtcctgagatttgctgaagttgtttataagcttaagaagcttttgggctgatactatgggttttcctagaatatatctagttaatttgtttacttgttgactattcattgcatttcactaggatataagcttcatgaatatagacatcttgtatatctataccccatacctagaactgtagggtgcctgaaacatagtagatgtgcctgaaactgtgtgtgtagatgctcaataatgatttgttgaatcaattcaatgcattgtagtacagggaagaatctagcatttaccccctttttatgagggagacctcttgaaatcataactttagtatctagaaatcagaaaaccatcaattaaagtagctatgctaatctggaaaagaagtgcttcattttcttaaagtttttatatgttctgacgcactctcagatattaaaatgcccttctttcatgttccttggaaggactatctacacctagggagagctacgtttctcctcagtgtgttcttggaaatcataaaggcaaacttaatcccaaatgttgtgcatttgctctaagatctaacattaatttaattatggatatgaccaacaattaattcaaggagtatttattgaaagttcattgtgtgtaatacactgctggatgctgaggatggaaaaataggtaatatgccattaaagcagagttataactatacatttcattaatctttaagatagtaaaaatataaaatataaagtaaaataatataaaatgcaaaggtctgtagtagagtaattcagaggatcaaatttaaggtcagaattactgaatgcaaatttcaactcagctacttgctagctttaagggcttagatgagctaatctttttaactttcagtcacctcctttgtaaatgataacaataatattacctgccacacagggcttttatgaagattaaatgagaaaatgtataaaaaccacttagcatacacatagtaagtgtgcaaaatactacattatataaatattagagtttcaaatctgcaggtattttttttgaaacttttaaaaacttccttacttagctggcttgctttcagagtgtatcccaatttactggcaagcctagtacataggcatgtgctatcttcttaccagcctttcttccccaggtgtatagctctatccctggcctttttgatgcccaacccagctagcttctgacagatgttttcaatactgactgctttcctgaatttccatagtgtgtatttataatacacatatacctaggttctatagagaataaaatgtgccttgaaggcattccctagtgaacacaaataaaattagttgttaccagattaacacaacttctatctttgcctatcatatcaatgtttttgccatttacttggtggttaaggaatgtggtacttctcaaaagaagacatacatgtggccaaaaaaatagatgaaaaaatgctcaacatcactaataattagagaaatgcaaatcaaaaccacattgatataccatctcacaccagtcagaatggctattattaaaaagaaaaaaacagatattggcaaaaatgcagagaagagggaacacttatatactgttgatgagaatgtaaatttgttcagccattgtggagagcggtttggtgatttctcaaagaacttagaactaccttttgacccagcaatcccattactgggtatatacccaaacgaaactaaatcattctgccaaaaaaagacattcactcatatgttcattgcagcactattacaatagcaaagacatggaatcaacctagatgcccatcaacagtggactggataaagaaaatatgttacatatacaccttggaatgctacgcagctatagaaaagaacaagatcatgtcctttggagccacatggatgcagctagaagccattttcctgagtgaactaacacagaaatagaaaacaaaataccacatgttctaatttataagtaggtgctaaacattatgtacacatggacataaagataggagcagtagacacagggcactggggactatttgagggcggagatgggaagggaggcaagcattgaaaaactaccggaagggtactgtgtttaccacctgggtgacagggtcattcttatactaagcctcagcagcgtacaatttacccatgtaacaaacctgcgcgtgtaccccgaacctaaactaaaagttgagaaagaatgcaaaagtttaaaaaaggaaaaaaaaaaaaaaaaaagaaatgtggtagatgtgttcatactttttagttgactattccagacctgaaagaatacaatgtaaattgaccataaaaaatagaaaattttgagaaagagacagattttgtgacattggtgtaaatgacattggagaatctattgaatcccagtaaaaccactgatacgtgaggatttgacagtttacaattgaagcagaaaaattatcaagggtaataatataatgatgcttcaaaaggaactgattggaagaacaaaggattaagagaaactatttggaaaccagataaacccttgaatatacctgttagaagatatctgttacagtcttctaggtgttaaatgtgaattgacagatactatatcagactatcatgaagtaatttcagaaaaatcaacaaaggacatataactggtttattctttgatctaaaagttagtccagagttataattacaactaaaattttgttaaatatgacataaagcagcttacttttatatttctccaagttccttttcaagatgaaatcgttaataagtggatcaagttaactttgtaaggaccaattagtcttagccaaagtagtatctctgtactactggttccttatttgcctgtgctcagcctatctgttgggatacttcacttaggattgctttgaatctgaggtctgtattaagcccaatgtctattaactatttttttgtatcccatgatccactggtctgtactaagctggactttaactggtctgtactcaaattgtgatattaatacaaaggattgaggaggttcagattcagactttgatactcagcacaaaggtaagatggaagtaatgagattcaagtgactgaatttggtagttcatcctatagaatatgattgaaaggtagagtaaaaccagattatgaaaaactttgtcaatctaaagggtatatgctttaacctacaggttagagtttctcaaattgtggtccacagaccacttgcgttgaaatcacttgtgatatatgttaaaaattcaaatttctgatccccatctatgaatcagaattctggggctaaatcctaggaatatccagttttgagatatctttatgtacctcttacgtacattatagttttagagttattgttaaacctaagtagtttgataaattttcccctgcattttattttttaagtgttgatgatggtgtaacttttgtcacaaaaaaacttagaagcgatgccatatttacctggaattttagcttcattaattgtttctttagataatattccaaagcttattctaaagataaatatgttttatatgataattctgtatatgaaatagtttaaagagagcattagcacttaattccatgctttcaggattttcttataaaaacaaattttctttgaaagtgatatctaaattttttcagtttccccacatggaaactcctgctgttatgcaacactgaaataacaacattgttttcacccattaagataccgctgcaagatattgtgaattggctcatttgccttaaattttttttaacaaataaggcagtgttttgagttatgccagatgtacaaatgagagatttgagtgtacttgtagaatttaaattggaatgctaatgagattctgacaggcagaaaaaacaacacagcctacattttcatctgttttattaaagtcattatttaactggaaaaacacattatttagagctatttatttatgtggcatttgtaattcagctcttaaattttatccaattaaagtgcttctcattctatttcacttaatgcagtagattgttttgtgcattcatctttttctctgtttcattcagtggtagagtggcagtaactcaattgaatgaatgaatgtgccttttttttaactaatgcttacatgtgctgcttcatgctgtgatgctacattgacatctttattttttgtttgcagtaattccattgaaatttaatggtacattattatacaagattgcttatggttatttcatgctttggttactttactaaaattcccaatatgtgaaagaaaaacataatgttaaaaaaactccacatttctgagaagataaattgatcttagagataattgaacataagacaccaagccttaaaagtacttatttcaacaaagatatacaatgccataccaaaaatattgctttttcaaaagacttttatttattatttatttgcatttttccatttgtatagttattttaaagaaaggctttttgtgaatgtttgagattgcttaattacagcagctttttggtttcctttatttatatttatctatctacctctcagatgaggtttaaattagagtttttaaggttataggggtttaaaattttatgtacatgtacaaaatctgtactagaggaagaaatactagtgcataatttcaagggatagcgtgaggctggctgaggtcagacccatgatggaatgcagaaattatgagagggtatagaagacaatgtgtttccttgaaaaggcaacttctgtgaagagagtgaaatatgtgagtccagaattgtacagatgtcatcatgaatgtcagatctctcaactgtattctatagtgggtttaggattcttatattgtaagaaggctttatatattttaaacagcctgatggtattcttatgaaaatctaaggtaaaagaagctcattggcatagaaactatttcagttaatgttcaatgaataaaatctctatattaactggaaattgaacatgtgactgttggtttcctgacatttacataaagcttcactcaagagggcgccattaagcagcattaaggaatttcatacacaactgtatatctctaaaacttccataagaggtaggctcttgaggtgacaaaaaggacagcaaactaggaatcaagaaactgagttctggttcagactctggcactcatgaactctgtggacctggatatgccactttacttctttaggctctaattcttcatctgcaaaatgaaaagtttggtgatggtttctaagagtactactaactctgtaactctgtgattttacagttcttttatttaccaatgagaagcccagacacaacatttaaatgatagattttatcacatctctatgccttcttaatatggtgtccagaattatttttgaagatacagtatttaggctgaatttcctaattagtgtttagaatacttacagaaaatagcttttgtaggtatagctaacttttgattatccatgctaacatgggataacatgtgtaattgaaatgtgtatgaagtcttcactcctcattttctcttcaaatttgtctccttttggtaaggagacaaatttgaataaagttgctgaaaaatatgggtttgagtttcattttcagcctgggcagaaaactgcctttagcatctttgtatagctttattttacccacaccactttgctgaggaaaagaaaagtattcattccatatatatatatatatatatatatattttttttttttttttttttttttttttttccagagtcttgttctgtcacccaggctggagtgcagtggtgcgatctcggctcactgcaagctccgcctcccaggttcatgccattctcctgcctcagcctcctgagtagctgggactataggcgcccgccactacgccgggctaatattttgtatttttagtagagacagggtttcaccgtgttagccaggatggtctcgatctcctgacctcatgatccgcccgcctcggcctcccaaagttctgggattacaggcgtgagccaccgcgcctggccataggattcattattaaaccataggaatgagcctcattttatcctggttggttttttaaatctcagaggcacattacattcgtgtgcatactgtccacatctactttacatcttgtgtacgtattgcttcatatatgtgcctcaggctcttgtgcctccatacctttacttgtgttcttcctgccatattttttactcctgttgccctcagacacagaagctctactcatcttataaagcccagctcctcagcccttgatattttccctaagcatgtgagccttattatccaacagattgattccagattctagtgttaaaattcactagctctctgatcctgagaaaattaccacagtctgaccatctgcaaaatgcaaacaattcccaaatctcaggatcgtttttaattttaaatggtatataatccggtcattcaataaatatttaagtagtgatatcacctatctgtagaacaaaatagaccaaaaactctgccctcacagaacctataccctcgtggagataggtaaatacataaaaacaaaatatatattttgagaaatagagaagggtagaggagagggagagtagagaatgcagaaagtggagaaactattttaaaataggatggtctgaaaaggacttcctgagaagatggcacttgagcagggacctggaagagccagggaatatttgaaggaagagtattccaggcagagggaactgcaagtacaaagtctctgaggtgtgtgtatgcttggcatgtgccaaaacagaaaagaggtcagttggctcatgcagagagagatgaggcagaaagaacaagccagatcatatagggtcttttaggtcaattttagtgaggactttgccctgaatgagatgaggagccatcagagggtttttgaagagataagtcacttgatctgacttacctttttaaaatactgtgtggcttctgtatagtttgtgggggagggggagggggaggggcaaagtaaatattgattaagctattggttgtaatataccaggtgagagctacacatcactacagagtctttcagaggatctagacactagtaggcattctataaatgttagtgccttcattctcactttctcttcttcatattcctagttggaagttttctcttcttctttgggattatctattatgacgcataccattttagaactagagttatctgtgtatttttttttgtttctcctactaacctaaacatttcttgaggataccttcttgaggctcagttttatctgtctttataaatggatcctatcccagctcaggatagggttatataagtagcaggttgagagtgtgtttgggacctgatgaacagcaacatccaagaggagaaggttagcaagtgtgggaggatagggaagtaacacttcaggagacacacgggaggtgtatcttaggatatattagcaaggaatagtgggatactttaagtaagatagatgtgggaagaggcactggtcctacactacatgtgggagatgccaggacagatctagttaggcatgctgtttagggactttggccatcttcatttgtgattcatgaagatgtgtagctggggtctgaggtgacatagtgaagtgcccaaacaggtggataatgcaggcaaaggagtctccccacaagggccacttgggagtatagataaactgctcgttgatctctgggccatctgtttatgcgtagtaatttcatagccttcacagggggattgaggtagatttggcaaattactggactgggaacttgtgatggtgctgtaccctttaggatttttgcttctgcaagtggcagattacccaactcaaaggagctgaagaaaaaatgatccttggtggctcatctgactgaacaattcatagggagttattgtcaaacagtttaacttgatccagctgcacaaataatgtcactaagggcctggattctttgtaattctctctgctttgcctttgcctaggagcatcctcatctaaatagggggctcctggcaccttcagcctgacatgttacaaatatcttatcttcaatacaatcttatctggtagaagaaagcctttttggccatcacacagaaactctggacttcagtctaattgaaccatcttaaagtgtgtacccattcttaaccattcatttctagtgagctaggattacattgatgaacacaggcttcagcctcttgcctaatccacagagccagggatagaagaagttaccccaaaatatgtgggctttgtattgtggatgtataaacctaactgaaaattagctgcttttattaagcactatatgaaatgggatgtggatttgggcccagcaaaacagtagatgtccactatgggtattatattatcagggccccagaaggaaacacagttcagcttagatagctcaaaagaagagactttaatgaagggactacttacaaaggaatgggcagggttaagggcacaaaacaatggctggtgagcctcctagagaccagtatcagtaggaaggtattaccaaccctaggacctagggatcaatgggaagaagtagtgttgcccgggtcaagtaagaacttgagtcctgcaggaggagctagagctgtagctgcggagtgcagctatagtcagagatgaaacattgattgaagcagggtgggaaagagaaaaaaataccctgacccttttctcttttcaactcctaatcgcctgctgtagtgcccattggctcaattggaacgaggcagaaatctctaggggtcagcctcctgagacacatagtggagcagaatatggatcttagttgaggccaaatggaaaataatgagcacagaaaacaaattagagtctcagtcttataatagggaaatatattgggaaggaagatagggatgaaaatttaggggacagaattttattggaagaaggtccaattgaaggagtgctaacctttcacacagcgcagattaagagagttaaattgttaaaggggttctgagctccaggtcagtctactggagggactgatttggttgtaactcctccttgtggtggggaataggtacctactcactcttaatgctccatatcagaatttgcctgggaactggaatgtggctgctcctgaagacatggatctcagaaggtctgtgggtgggtaagtggcttatgacgggaacagaacaaatgatacattgttgtgtatcaaggcagaaaccattactacaacatgtagctgccctgagttcagttgcttttgtttatgttcctgcccagccaagattgggatcacttcctgctgagacctgacttgaaaatgatgggcaaatcttggcccaaatagctaactagaagtgaatgagggtagccctaccagtcttcatctagaagccatgctatagggataggggataattgctctcaccagctgctgagacaaattcataagtgacactgtggcgaggggtcaaaaacaacccaggataaagcaggaagctcaaattgtggctaacagtgaggaggcacacaaataacacagctctaactccactgaagacagggtaagtgacagcttcccctgagtcagatggagcggggataagtgtgccttgatgcgaagtgggaaaccagaggaggacctgactgagcaataaaactcttggctgagactaaaatgatttcaaagcagaacaagggtgggactgtttggtagtggaaaagaaagcttggtttgatgcctagagagagaattacatgatatgaagaaaggtcattatttattacctaatcaagcagtgtaaacataccaacaagcttgagacagtctttatctagcattattagatgtgcaattcaggtgagagaatattaccaaatctaacctgcttatcaacacttgtgtaatgagaacataaaagtgaatgaaaatgtatctagtctgcaatgaagtggtaatataagagactcagaagatccttttttcctactttgtgggattgagcctaaatttaacttgaattatttttagaagggacttcttatttagcctttttaaaagaagaatttatctattaataggaaatatgcattttattattaaaatgagttttattttggagtagttgggaaatgtggaaaggagaaaccagttgcaaaaagggatataaaaagaaagttgtcaaaaatgtttaaagatagagtatagcacaccaaaccccacagccatctgcccaggaaactctccttgttgccttgttttctctttcatttgtgtgggctgttctctgcttaggtgcttggaatgtccctctgatacagaaatggggaagggaagtgctgggaagggaagggcatggtccctttcaatgatacggaaggggagaagggtgtggtccctggctagggctccgcctccaggcctgtgcccacaggtctagttgaggacaggcatttttgttttcctgcccaaaacatttcctaagaccaccttggtctgccacgcccgcatcctgtgcctataaaaacccccgagaccctagcaggcagacacacacacacaagcgactggacatcaagaagaacacatcagaagtagacagaagtggctggacattgagaggacattgaggggagcacgccggatgctagcaggctgccgactggcagagcatgcgaagtttggctggggcagttgagggagagccccggctgccaagcagctcgactctaggggaaaaccaatctcctttctggctcccccatctgctgagagctacttccactcaataaaaccttgcactcattcttcaagcccaggtgtgatccgattcttccaggacaccaaggccagaacctcgggatacagaaagccctctgtccctacgataaggcaggggtctaattgagctaacacaagacacctacagacagctaaactaaaagagcaccgtgtaacacacacccactggggcttcagctgtaaacattcacccctagacactgctgggggtcggatccccacagcctgcccgtctgtatgctcccctagaggtttgagcagtggggcactgaagaaatgagccacacccccatcacactgccctgtgagggggacaagggagtttttcctgtttcacctcctcccctctctccaggccaagtcttccttgtactttaagattttaggcaatttgactctcataccttctaatatcctcttcacttcaatgccaccccagatagatctgtgatatgcaaatccgtgttgtgatgcacttatcacagtgtactgacatgactttctgatctgtcttctccattagactgtcagccatttgagggactgaggcagtaaaagagtaggtatttatatggccagaattacattaaaattacgtttgttataatgaagtagaatatttctgtgctttgccctttccactcactatcagatggcttcacagcattcctctggaatgttctaaaaatagtctgacaccaaatattagtttgaactcttgattataagcaatagaaacccaattcaaaatagcctaaataaaagggagagtgtagaatatcttggtgtatatttcagcatgactgaggcatgatggaggcaggcatacagctaggctttggaaatacggctcacatgcttttgggactctggctattttttattttggcttcttcatctatttgggtctcctctttctctgtagaacagctttctaaattcagaaaatatggttgctgacagctcttagttttacataataaagctttgccactacagaaaaactagaaactgatttgagtttcctatctccaaagttcatgggtcctaggaaatgtaccagtttgggccctgcccaattatcagatgctctcattgtaatcagatggagagggtgagtagttcctgcagccaggcaaaatagtacatgctgtacacacggcatattagtattatgggagaattacatttagagggctctgtttgccaggacatatagttaagtccaggccatacatatttatgggagaagacaagtgctccaaacagttaaataaacttttattttggcatttgaaatgcataatatcattattcttatgggacatttaccatctttattatgttctctattggctagcattaagatgcattctttgcattcttaagcataaactaacaggagcatcaagaaggaaaagtagcctggataatgaaaaaagttgacttgggagcaaaactatgctgtggttaattgataaagcagaggagtttctgactaaccgaaaatatttttagtcttccaaaaggtattactaacatcttgcaagtgaatttttaaatataactttcaactgaaattttcttaccagcttactgtactgatccaagggtatgacagacattaaagtaaaagaaactggcatggttgctcatgcctgtaatcccagcactttgggaggccaaggcgggcagatcacctgaggttgggagttcgagaccagcctggccaacatggtgaaaccctgtctctactaaaatacaaaaattagccgggtgtggtggtgggcgcctgtaatcccagctacttgggaggctgagacaggacaattgcttgaacctggtaagtggaggttgcagtaagccgagattgcaccactgcattccagcctgggtgacagagccagactccatctcaaaaaaaaaagaaactggcatgtttgctactcttaacagagaagtaggaagtagatgtgtttaaagctaaacaaccttttaaaaacatcatgtttacagtgttaaaatttgtgtgcatgtgtatagcttatgtacgctaaaggccgatcttagatgtaaatcaaatgggtatgattttagaaatgacacattacattacaaaaaaaaggtaggtatgtaaaatgagcttaattattttcccttttgtacttcacagggtggggaatggtggagaatgctgagtggtgatttggggccataagtccaacattctgcctactttataacaactttattgcaggctggagggctgtgtgtttgtgtgtgcgtgagagagagaggggagaagcgagaaagagagagagaaggtaagagggagagagagagagggagaggaaaagagagagaagagagagcccttggtttagttattagggaagagcaaggagatgctggtaatttgatatctaatagtttactgacttttctctttgtatacacattttataggagtaaacaatggagaatgatgtgagatggattacatgaccaaacattgcttctaatttgaatctatgagcctttgaagccagatataagttgatgtatcaattatattagtccagagccaatgtataatttctgtatcaatcactgtgtttcttattattcggttagaaacttgattttaccgctttcagaatctaaaactctggttattcatcaaatggacacaaaatattaaaagaaatagaccttttccatagtctatgttaataaacccaggtcatcaatctttgttcgcatatattatgtagtcccctggtggacagtgtgttatttctgtttctggtttggtaacagacaataatcaatctctctcccttgcccccacctttttcctttccagtctctgatccttttcctccttttctttcctctctctttctcttcctctctccttaaaacatgcttatctgtaagtattcatgaagacaaagtaccctttgtattacctttgtaaataatctaaatgagcattttctgcagtgatggggattgctgacctcaaatataattgcttttatttcgacatcttaaagctaaaagatttcttttttatcatcataatgcaatttaaatttctctcttaccttctcgccttttctcttttttctatatgtctttctttttccctttcttgtcctccctcccttccttcctttcttccttcctttccccctcactactctttctttaaaaagcatgacatttgacctttggttggtactaaagcttatcttcagggagaatgtgactttgaaaattagttatcatacatagaatacatacagctttttgcctacataaaatgatggttctcttcaggaactcttgattccagtctgctaatattgcaaatctaactaaaatggacattgtctttgttgtacgtcggtgagtgacaagggttctgcacttagagcttttgctagaaaacctggagggcagccagccaagagctctgtaatagacttgaagaagttggaatctgtaaaaaatgtttcaggaagaaaatctttcagattagacagctgcatagttaacaatcagtagctccagagaactaataattagttctagtcaattaaaccaacttttagccttatgacagagaagatagcttgcatagctaaaatgcacagtatactcttaatttatgctacccaattccttaccaaaatatttttgatttttgtttgttttgtttcattgttaacattttgttgtagttcctgttgtgggttgtttggtaggttactatgtaccatgttatagtatttttctttttcatgtagtattctgttataagccatttccatgttcttaattttaaatgactgcatataattttacagtaataattatgtaccaggctaattattttacatatattaattattttagtctttataacagttttttgaggcaggtactattattatcctcatttaaaaatgaaaaacaaaaatgagatacagggaaggtaagtggactgttgaagattccagtgccaatacatggtagaggactgaatttgtgatggtttacttacttccttcttatccacctattcttagatattatgtagtttcttatggtatttattgtaaatatcataagaaccaatgtcatgattagtaaagtgtttcccaatagcaaagacattcttgcaaggcagaaattgagaattgaattattgtgtttttatcaataaattatagttagactcataaacctgcatattttggaatcaacctaaatgcccattaacgatagactggataaagaaaaatctggtacatatataccatggaatactatgcagccataataaacaacatgatcatgtcctttgcagggacattgatggagctggaggccattatccttagcaaactaacacaggaacagaaaaccaaatatagcatgttctcataagtgggagctaaattatgagaacacatggacccatagaggggaacaacacacactggggcctatcagagggaggaggttgggatgttgggatgagggagaggatcaggaataataaccaatgagtactacgcttaatacctgggtgatgaaataatctgtacaacaaacccccatgacacaagtttacctatgtaacaaacctggacatgtacccctgaacttaaacaaaaaacaaaaaacaaaaaaagatttcctcctctttaagagtatttccttaggataggttcctagaaataaaattactgaatcaaagttttaaaaaaatttaaggctgttgatacacagtcccttaatagctttcttaattgttggttacatttctgcaataatttatgtgtgcacagtttggtaaatcattgtcatctcttgattttatgtttttaaatctttgctaatgtgacagctaaacatggatttcttttacctttgttgtaatttgcttctttgtatttgaacttcctcttgtgtgaattattcatgcctttttgcctgtttttctcttaaagttctagtcttgcttttgtatctttgtataagtcctttaaccaagatactaatctttattatatttgctggtaatgtttttttttttttagcgatttgtctttttttggactattcctttttacctatgaaggatgtttttgtttatgttttttaaacacaattttacttcttttgtgattgctgctatttacaaaggcctttcatttatgagattaatgctaaattatctttttctctacttgcactacagatgttttccttttgtgttaaatttttaacgaatctggaatttattttttatggcatcagttatgtatcagaattacaagttagtagaaaaatgtttcaagttacattcttctctttcaatgaattgattaaaacttggaagaaaggccttggataatctataaactatgcaatcagcttcttaaatattcttttctctttgaaaggcagaaattgagaattgaattattgtgtttttatcaataaattatagttaggctcataaacctgcatattttgtgctttaaaattataatattttgtcttttgctttcataaagaaatcttacaaagggaaactagaatctagccttccttgttctttgaggttctatgtgcctcactgatgatagtttattatctctggacttctgcctgttatttaaaactgagaacaagacaggcgtggtggctcacgtctgtaataccagcaccttgggaggccgaggtgggtggctcacgaggtcaggagttaaagaccagcctggccaagatggtgaaactccgtctctactaaaaatacaaaaattagccaggcgtggtggtgggcacctgtaatcccagctacttgggaggctgaggcagagaattgcttgagcccaggaggtggaggttgcaatgagctgagactgcgccactgcactccagcctggtgacagagtgagattccatctcaaaaaaaaaaaaaaatcaatatgtattaggaacaaatattaaaatctaaaagtgggatggatatatatatatgcatgtcacatataacaatatataatatatattgctaataatatgtaatttaatatttcaagaaaagcctgaccatataaaagtgttaaaatattggactataatactgagactcctaaataatatgtaactactatttccaagatgatataaataggagtcttttatcttctggaataattcttcttttcgtcattttactactaattatttgataacccttatttgtgttttagctgcatattaaaatgagtggcaaattaatatagatataatgatttggcagtgttgaataaggctttttcttttcttcacccaaagtgattgtatttaaaatgcatgttaatcaaaattcagtgactcatctttgaggtttgtttattacctagattcattggtgtcaaaactgtttgcttaagatttgatccacacccaatttgtacagtgtcttttgaaatacaggaatttggaaattttattagattagaagaaacacttctgttttatagcctactttccttctactttagttatttttactccatgagaatttttcattaaaaaataattgcagtccttgacacatcaaagacaacataattactgaatgaatctccataattatgtctcttttgtaacttacttttgcttatttatttttattgttcaaaagagcacactacttagaagggaggcagaacctctaaatcagaagtaaacaagaatataagaagaaaagaagtgctataataatgtaggtattctacagactacctagttgcagaaagcaatggattcttagttcttgaggagctaatggaagagatctaaaggaggtagaaattctcaaacatctgggcatttgttagaacttcctttaaacaagggtagtactttgggagaccaaggtgggtggatcacttgaggtcaggagtttgagaccagcctgaccaacatagtgaaaccccgtctctattaaaaatacaaaattacccggatgtggtggcacatgcctgtaatccagctacttgggagactgaggcaggagaatcacttaaacccatgaggtggaggttgcagtgagctgagatcgtgtcattgcactccagcctgagcaacaagagcaaaactccatcttagaaaaaaaaaaaaggcactaactctattaaattatttattttttctttttgttgtgtgtgtgactgtgttatttcaaagattgtcttcaagttcagaaatttcttctgcttgatcttgtctactgttgaagctcaattgtattttttaatttcattcattgaattcctcagttttaggatttctaatgggttcttttaaacatctatctctttattgaatttcttattcagattgtgaattgttttcctgatgtctttgcattatttatctgtgttctcttgtatctgagttcctttaacatcattattttgaattccttttcaggaatttcatagatttttttttctttgggttctgttgctggagaattattgtgtttctttggaggtatcatgttttcttgcttttttgtgtttcttgtgtccttctgttgatacctgtgcatctgatgtaacatttatttcttccaatttcatggattggccttcactgagaaagatttttttctataatcatatccatagtgtttgttgggtagggtgctttggttttgattctgggtaagcacagtagtgtagtcttcatatgatttctttagctgtaatcagtgtcaatggtgtgagttccttagaggcttaggctgtggttgttagtggaggctgtggtgaggctttactggggacaggaatgccaggtgggctggtccttaggcacccatggtggcagtctgggcatgccagtcctcaagcccttgggcacccatgtaggtggcagtggtggcaggtccaggtgggccagtccttgggcctccaggtgatgtgcttgggtgctggtggtggcagggtgggctaggcgggcaggtccttttgcccagtggtggcagggtgggttaggcgggcaggtccttttgcccctgggcagtgtgtgtggcatcagtggtggtggtagctatggcagcttaacccttgggcccctgagtggtacatgtaggtgccagcaatggagggactgtcctaaggcccagggatggtgtacagttggactagtccccaggcttcctgaaggtgcatggcagacctgccactggagggggtggggttgctgtcaatagcagtggccctggtgggcaagtagctctcaggctctggagaatgcatgcttcaacttcctttgtcccaggggcaggctccctggtgtcctgcaccagctgttctcttgagtatcggatactgtgtgggctagagttctagggacccacatcactgtgtctagctggtgttgaagcctgcagatttggggtaaatgtgaggggatgtcagcagtgctccagagatgtggagatgcaggagctgttgggtcctagagcaggacgtagtctggtgggggctgagctcttaaaatggtgctgtaccatagctgcttctgtctgggtatgtgtgtgtgacccagtgtgaactcctctctgaaacaatgccatcatgtggactccaggaagctccttatactagtctcagggcccatgagggccaataagggtctgcaatgggaatgtggactgcttgggaatctctcacataccctttcctcatagtggaaagctccttctggctctgaactgatcccggccaggccagctgtttcacatccctttcctaccatgtctcagaggtttcttgtcacttctgtgctgaattccagtgttctgtcttagaagctttattcaaaatggggttatctactcactgttttggtccttctttgtgtaggaggcaagtgcctggaacttctagtcagcctcttgaacccttacctcaattattattatcattttttaaagaactgtagagtctcataaggcgtagaagtgacacaggacctagtactctacataactatggattagagagaggaatttcttcaagaagtagaaatgatagagaaggctgtagagagaggaaatgctgtaactagctacatatatattctggacttaaaaaactgtttcagatttcaaaaatctcagggaaaagatagatttgatcaaatatctggaacaggaaccctgattggaacaggaatctgtattgtggcattatttatttctctggtgcccatagaagacattatttaagtgacctcaataatctctcatttttcctgaaaacatctctggaatccttcttaagataatactctaggtagttactactgatgcaggatgttttgctcctcagctcagctaggtttggtttcttgtctcatgaccaggaagaaataggcaagtggacattgaagaatgagtggagtagaatgtattaagcacaaaggaaacccctcagccgaaagaggagttctgaaagcaggttgccggttgccccccttcacagttgagtaccaatactttgttataaaagctgatggggctgggttccctatttgtataaggtgcaaattcctggtggctccaccccacccttccggtgcgcatgcgggcccttagtctgacccacttcacattgatttatttcccttactgtgcttgtgttaagggacagaattttttactgcaggcatatttaggcaagcctcctgtgctaatgaacttggtgggttggaggttctcctgggaccctgccctatctgcctaggagagttctctgcctcctgtctctgtcactaccatttgattgtctttgcaggaagtggagcctgacaccctagtgtaggagaaaaatagctcaaaatgatacagctttgaatggcttgcctctctgctatagatctattcatcaacactcttggatccaatagttaaatagatacaaagccttctaattcttttattattgagcccatatttttattttatccatgaggaaagcttgagaaatgttgtataatgttcagttaaaatctagatgacagtgcttataggagtaactaggtctgttagtttagtaaaccacccaaaaaggtaatctgtgtaatgtgtagcattggttctccatcaggggcaattttgtccccctaggggatttagcaatgtcggggggtgggagtggggttgtatgctattgacattcagtggacagagcatagggatattgcaaagtatcttacaatacataggatggcccctcacaacaaagaattatccagtctaaaatgtcagtcataccgcagtttagaaattctgatctagatcactggttcttgactgggaacttgttagaaatgcaaactattgcattccgctgtggaactgatggggcagaaactctagaggagagtctcagcattttatcttttaaccaacccatcaggtgattctgatgtaccttaaagtttgaagaccagttgtgggaccattttggcatataaaaacgttcaggaaatatttattgagcatcaagcttggaccacgtgcttctctaagtgctcaaaaaacagtcttttcatagtttgcttttgccatcttacctatgatcttgttatttcttgtagttctcaaattcttctgttgtctaacatgttgtttgatatgtttgttaaattgtattaaatcgaattggtagctggtctttttcatcccaccatcccatgaggcttttttttttttttaagtcagttacttgcttgaagatgtagtcgtcatggttatcaatgttttaggcctcataaagatggtagggattggatgatagaggcaatctttgattcttaatagactagcaataacatggtcatatttctaagttccaaaattcccattatatcaattttaccaagcatttcctacttgctaatcagaattaggaacatatttcttaactgagtacattgcatacaagaagagatttttaaaatttgtcgaattgaatcaaagacaactcctaggtaacttggaagaatgatagtgataataatagaaaaaggaaatttaagagaaagatgggcaatatgctgagttattttgtacttagcgaatatcagatggtgatacacactaaagtaaatatattcatccatcaatggaatcaaaagcacaggtagaagggacacttttttttttttgagatggagtcttgctctgtcactcaggctggagtgcaatttcagctcactgcaacctctgcctcccaggttcaagcgattctcctgccttagcctcccgagtagctgggattacaggcacatgcccctacgcccagctaatttttgtggttttttttagtagagacggggtttcaccatgttggccaggatggtctcgatctcttgacctcgtggtccgcccgtcttggcctcccaaagtgctgggattacaggcgtgagccactgtgcccggccagaaatgacacttcttgactgacgagggaagaataaaaggaaagtgacataccaatacaaataaattttgttgtaggaagcagttagaggaacttttaaataatggtttcagttgtttctggaatactttggcacgtcagtatctgctacattgccaaacttccttagcttatatgagaattctgtgaggaattccttgtgaaaactcgactgagggtaaaaaattacagataactcagaaagctattcggttatgaggcagaaaagaactgctacaccatcacaacccctatcaacagtgacagcgaagaacattaaataagagaaaaactttgaagacatataactttaggcagtaagtctcattatccacttagcctggaaggagagatagccgtgggtcatacaattccaaggtttgggttacccctctgggcaaaaaccttatcaggaagcattttttgaatgcaaatgcaaggtacatgtagtgagtcctggaggaaggaattttcaaatgccagccaaggtagaaatacagccttattttctatttgcatttgtttattgctaataattgtcttcttttttcctttttaaaataggagttgaagtgaaaacaatttctctgttggaaattgatatgttgatagtgtgtggttactgctgaactagaggaattctgaacacttcttgaggattctggacttgaagaagagtaggtccatgatgttgatcctggatgtagttgttgaaggtgatttggggtcagcttcctttggggagagtagtgattatattgtagttgtagtggaatagatggattacagggtcttgggtatattgaatcatctccctttgtggggagtgattatattgttcttgtagctagatagttggattgtgacatctttggatatacaggaaatagtggatgttcatatatggggcaaggccaggggttggcatgttgtgggtacctttctgggatagtgctcagtgcatggccattttctttctctaggacttttccctgaaacccagggtggagttcagttggccgttagcaccatatagctacaactcagttgtcacaactgaagaacccaagagttcagaacagattaaagctgcactactcagactctcatgtggaaatctgaaattgatagtagtgttacagagagtaggttcccaaactacactgtagagtttcctatagctgatttggcttctgttttaacaaaagtagttgttgatctctttgtgcatttccatcgagactgcccagtgttctatcaataaagttccctgtttgtgctgattagagttggttttctgtttcttcctaccaagagtcttaacttaagctggtcatatgaggtggtatgagcctcaaaaagggctgaatacttgaattatgacagtagactgtagatacagaagtggcagcaaggagcaagatacatgttgatccattctcctaaaagtagaagaaaaaatgccttttattggagagagtggggagggatatggctcattttttaaaagacagttttctcgtactatgagaagaaagaagtagtgtgttaaactcaggctgaggatgttagctagtgtgctcctaagagatttatgatttctggaggaattgagtaaggattatatagcaaatgttctgtaaatatttgatgaatgtggaaacaaataaattgaggagaatgatcccttctcattataacctcagtaaagaatgctgtgtgccacaattggcctgggcttcccaaattatagcttacttgcataatcatttccatggtaaaattgccaaagctgccattctctctgggttcatgttcttttccctgccactcatttttggtcaatacagtactattttagtattgaagtttagttagaggaatttgagtaacttttacttttagggagaagagtttcaaggcctctatctcttccctctcagaagctccaggagacaggcaattttttttcatgatttcaccaacaaatagcaagccctctctctaagaaatgtcaatgatgctggaaaaaaaataaagttccattttcatgtgatataacatgtgatattaattagggtaatactagccatgaaaagaatagacttcaaaatataaaatggcttaaaaccaataatttatttcctgctcattacagggaaggtaagcagattactaggtggcccttcttgtgggtcatttagggactcagatagggaagcctaccataatcagaatgtggtttccaaggttaccctaggtactgtagggcatccgagccagacataagaggaatgagcatggggggttttgtctagagtggaacatagcacttctcttaactttcagttgactagaattcagtctcatagccacttagtcgcaagggaggcttggaaatgtagtccactttgtgcccaggaaaatggaatatatactgtatttggatggtcaactaacaatttttatctttgtggctactcactattattcagacctcactttccagaaattctgataaatacaagtttactgtattttgaaaaaaagaaaaagttggtaaacttgcctttcttcacagtttctgtaaattccatgacttaaaaataaagctcatattgagggaagaaaattaatagatttgaattagctaaattatatacatatgtcttttgccacatgtactgagaatcgctaaacacatttttcatattcaggccttgttatcaagctgtaaaattctaagctaacaaaaaccatccttcataaaacaattctaggaccaggaaggataagtcaaactgggatttgcagattgtgagtaagtacttaagtgaattggactagagaaaataccaggaagctagcagctggggtaatgtcagaggtagaatccacatgtgcagctaaaagtaggaacctatgtcggcacccaaggtgagagacagttggaggctggatgccttatttatagggactttgaatacacttcctgctgggcagcagtgaagcccatggtgtggacagctgacagagaagaaaagcaggtagataggctcacctagatgaaggcaggtttgaagagatggaggccctacacagcagtcctgagaagaattttttttactaattcaggattagcaaattgttttcctggtggtttttggttttgaattactatgttgcaaagttggtaatcttagtgagaatacaagaaaacataaggttattcacattcaggtttattttgttttgtatccactgtgatgattaaaattgggattaaatattcaagtgtacaaatacaattaaaattgtaacctgtgcccaataagagtggtaaaagtgtaactcagtcaaaagaaaagaagctctaagctttggtgctgtgtatcacctatgaattaaaagatatttttcagatgattggctgattggcgactctggaactgggaacaagttaacgctgagaacaccaagtacagtgcgtcatgtaaggggagggagacgcttaggattacatggttagctaagaccatatgcattgaggtttcaagtctacaagcatgatacttttctttcagagtttgttgatactgtgtaagggtgtcaatcattggtacattcataccagattgcatggttttacaagatgaggaattatacagcaaatgaggtaaacgtatacattgtggattcctttataatactgttctatcaggaaagtaattgggcaaagaagagtggttagcaattgaggttctagagtcagaactgggctcagatcctgatgttttcatttcctagctttgtgaccttggacaagttatttcacctttgtaagcctttgtcatctttaaaatagagataataactatattcaaagcctctgaaaatcaaaagttttttttttaactcatttggcagcaaaacttgatgtggaataatgacaatttatttgttgtctttatctcatttaatgtgcatctttatacattttgtggcagaaatattgatatatttgattaatgtatgctactccagaatctactcagggaaaatgctagatagctttcatttatacctccagattcactgtccacctttctccatctagctatgtgtccaggagtctgatagtatagattgtaagtatgcagtctgtgtttacaggctctctgctatctgctttcccattagctctggccgatggaagtcactggcgagatattggagtgaggcagcagagtgagagaggtatttaattcacctagttctcttcatgagtggtcaccgtagtgtgtctctagactgaaggtctcagcatgtgaaaggtaccacccctcacaaggcctcttagtcttcagctttcagtaacagctcccttcctttacccattatgacccagaggtggtaatagtcactacagtgctagcttcaggttatcaagctatcctttgtggtttctctacaccttagcaaatagtgcctttattaaattttcctcaatttatcctaagttgaccatgtacctacttacttctcagaccctaaaagatgcatagtactgtttaatttatgaaatatttactaaattactgtctgaatacatacacatgcagaggcacaaacatacacacctgaaacacatcttgcttcaagggttttggatgaaggattgtagatctgtattctaattatattagcataggaattttactgtattttataaattattactgttcaaaaaattatattaatgttcagttaaacacagagcatgtaaatggcctacaggtaacaccaccaacatctcagttctaaaaatatgaaaaatgtcattgagctaccaatttaaataaatctcctaaagtgagtatagtatatggagcgcagtttcacaattataaacttgcctttgttacttaagaggaaaaaagcagcagcaagattagaccttaattccacttgatcacttgttcatcaacaaatggtcttctcacaaattccaagacgccttaagaagagatgcccagccggtagcattaacataactttatctaaattatttcgccttctctcagtgcttcaacaggaataaattcagcttctgaatttttgccagtgtatgacaatgtattttctagttagctgttgggtggtggaaagaatgtagaatttggagtcaaggaagctagtttgggtctcaacattgataccgttcttgagtcactgtgagcttgatttctgtagtccctgtctctaaaattggggtaaaaccacatacctgtcaggatcatgaggattaaacagagtaaatataaattatctagtatggagctcagctcatagtaagagcttgagtgtttctcaaacttgaatcagtttgtgaacatagccactcaatagaggaaggtttgttcctggggctgatccatgactgcagctgtgtgactgctgttgtggcatttggactgttcatggatggaccagaacctccagattctacatgtgataaccgtggctgagtaaaggctgttgtcagtatacatcacgcaacaacagaatgagtgtggggtagtatttgtgtaatttgccagagaagtgaggaactgaacagaatgagttttttcttgtttgtaaccacacatttagtttatgcttccattaattcataagtattatatttagcactgtaatatttaatattgatgttaccaaatgtgggtcaacatttaaagtctataaaaacatgcatacagtcttgatatttttaaaactcactatagtaagcttcacttttttctaatgaaattcactaaccagtttaagaaaatggtaaggttagtgtgaagaattccatgccataatactatagaattgctagagatgggccacatagttgattttgagcttctagtggcaaaaaaaaaaaaaaaaaaaaaaaaaggccaattataagatccctagagtcttagttgctttttggtaccaagatctgagagggcttcataaagtggcatacaagattgagaatttacacaagcagttttgaatagaataacagagactttagtaacaaatttaaacccaagcatagcaagcaaccttgttgaaccaaatagttctgtgagagttggcaaatcttaccgggatatagcttcaatagtgatgatggaatgataagaaataattgcctttttgttaaattttttatttgttaaaattagtaatcaactctctatggactgggagagctcaggaacaatatagctttaaaaagtttttcttcggcagtcaaaataaaatattacatttaaaattaattgaatctgtgaatatgattattaagataaaatgttatttccaaattaaattaaaagttttctttattttttactatcattcttctcctcaaattaatattccatctgagaagcctgaaaagagaagattaaaaggagtcattaataaaaggaagtgcatttaatgggaatatgattatcatgtagttcaaagaaaatttcattgtgcctcatactaattgctattttgtgcacctacttgccttgcttatcttaagatggttttggctttaggggaagtataaaaaattaaggtatacatatattatttaaagtagaccaaagttaaggcataaataaatagttaataattgaagcatgtgagtcagttaactttaaaactgtacttattaaagtctttgttacttttaagaagactatcctacgctttgagaaattgctgagtcatggtcatgatcacatctgtgttgtagttgtagcccccctgtatgggaactatgattcctgccttcaggctaaaaggcattaaaagaaaacaaaaacaaaaacagagagaccatgtagtgccatccccttctttcaagtgtgaactccagctcaatttccccctgctcatgtaaattatttagagctttcaaatagttgttttaaaatttttcttcagagtttgtagttgttatgtattgaacacaatggaagtgggcataatcttttctctgcctaaactctttaaagtttttgaaatgaagacatttaatttttttaacatttaacctgatataattttaactgtttctacctgagaagttatccagcaatgttcttttttttttttttttaaggttttttttttcccataagttataggggtacaggtggtatttggttacatgagtaagttctttagtggtgatttgtgagattttggtgcacccgtcacccgagcagcatatactgcaccatatttgtagtcttctatccctcgctcccatcccactctttcccccaagtacccagagtccattgcatcattcttatgcttttgtgtcctcatagcttagctcccacatatcagtgagaacatatgatgtttggttttccattcctgagttacttcacttagaaaaatagtctccagtctcattcaggtcactgcaaatgctgttaattcattcctttttatggctgcctagtgttccattatatatatatatattccatcatatacatatatgtttatatatattccatcatatatatgtgtgtgtacatatattccatcatatatatatattccatcatatatctattccatcatatatatctattccatcatatatatctattccatcatatatatattccatcatatatatatattccatcatatatgttccatcatatatatattttccatcatatatattccatcatatatatattccatcatatatatattttccatcatatatatattccatcatatatgtatattccatcatatatatatgttctatcatatatgttccatcatatatatatgttccatcatatatatctatgccatcatatatacacacacacacacacacacacacacacacacacacacacacaccacagtttctttagctacttgttgattgatgggcatttgatttggttccacggttttgcaattgcgaattgtgctgctataaacatacatgtttaagtatctttttcgaataatgacttattttcctctgggtaggtacccccccagtaatgggattgctggatcaaatggtagttctgcttttacttctctaagggatctccacagtgttttccatagcggctgtactagtttattttcccaccagcagtgtagaagtgttccctgttcactgcatccatgccagcatctactgttttgtgatttttttgattatgtccattcttgcaggagtgaggtgctatcgcattgtggttttgatttgcatttccctgatcattagtgatgttgagcattttttcatatgtttgttggccatttgtatatcttcttttgagaattgtctattcatgtccttagcccactttttgatgggattgtttgtttttttcttactgatttgagttcattggatattagactggatatcagtcctttgtcagatgtatagactgtaaagattttctcccaccctgagttgtctgtttactctgctgactgttccttttgctgtgcaaaagctctttagtttaattaagtcccagctatttatctttttttttattgcatttgcttttgggttcttggtcatgaaatcgtaagccaatgtctagacaggtttttccagtgttcttttctagaatgttaatagtttcaggtcttaggtttaagtcctcaattcatcttgagttgatttttgtataaggtgagagatgaggatccagtttcattctcctacaggtggctagccaattattccaccaccatttgttgaaaagggtgtcctttccccactttatgtttttgtttgctttcttgaagatcacttggctgtaagtatttgggtttatttctgggctctctattctgtttcattggtctatgtgcctgcatttgtaccagtaccacactgtttggtgactatggccttatagtatagtttgaaatcaggttgtgtgatgccttcagatttgttctttttgcttagtcttgctttggctatgcaggctcttttttggtttcataagaattttagaattgttttttttaattctgtgaagaatgatggtggtattttgatggggattgcactaaatttgtagattgcttttggcagtatggtcattttcacaatattgatttcacccatccatgagcatgggatgtgtttccatttgtttgtgtcgtctatgatttctttcagcagtgttttgtaggtttccttgtagaggtctttcgactccttggttaggtatattcctaagtattttatttttttgtttgcagctattgtaaaaggggttgagttcttgacttgattatctgcatggtcactgttggtgtatagaagagctactgatttgtgtacattaatctcgtatctggaaaatttgctgaattcttttatcagttctaagagctttctggaggagtccttagggttttcaaggtaaacaatcatattgtcataaaaaatgacagttttatttcctatttaccaatttggatgccttttattctttctcttgtctgactgctctggctaggacttccagtactatgttgaagaggagtggtgagagtgggcatccttgtgttgttccagttctgagagggaatgctttcaatttttccccattcggtattttgttggctgtgggtttgtcatagatggcttttattgcattaaggtatgtcccttgtatgccgatttcactgagagtttcaatcataaagcaatgttggattttgttgaatgctttttctgcatctattgaaatgatcatgtgatttttgtttttatttctgtttatgtggtgtgtcacatttattgacttgcatatgttaaaccattcctgcatccctggtatgaaacccacttgatcatggtggattacctttttgatatgttgttagattcggttagcaagtattttgttaaggattttagcatctaagttcatcaaggatattggtctgtagttttctttttttggttatgtcctttcctggttttggtattagggtgatgctggcttagtagaatgaattagggaggtttccttctttctatatcttgtggaatagtttcaaaaggattggtaccaattcttttttgaatgtctggtagaattctgctgtgaatccgtctggtcctgaacttttttttgttggtaatttttaaattaccatttcaatctcactgcttgttattggtctgttcagggtatctaattcctcctgacttaagctaggagggttgtatttttccaggaacttatctgtgtcctctaggttttctagtttatgtgtgtaaaggtgttcatagtagccttgaatgatctttcatatttcagtggtgtcagctgtaatatctcctgtttcatttcttagtgaggttatttggattttctctcttcttttcttggttaatcttgccttttatggcctatcatatggtctatcttggagaaagttccacgcgctgttgaatagaatgtgtattctgcggttgttggatgaaaatgttccctatatatctgttaagtccatttgttccaagatatagtttaaatccattgtttcttttttgactttctgtcttgatgacctgtctagtgctgtcagtggaatattgaagtcccccaatattattgtgttgctatctcatttcttaggtctattagtaattgtcttataaatttgggagccccagtgttaggtgcatatatgtttagaattgtgatattttcctgttggacaaggccttttactgttatataatgtccctctttgtctcttttaactactgttgctttaaagtttgttttgtctgatataagaatagctacccctgctcacttttggtgtccattttcatgaaatgcctttttccattcctttaagtttatgtcagttcttatgtgctatgtgagtctcctgaaggaagcagatagttggttggtgagttcttatccattctgcagttctgtatctcttaagtggagcatttaggccatttacattcaatgttagtattgaaatgtgaggtaccattgcattcatcatgatctttgttgcctgtgtactttggttttttgtttttttgtgtgtttgctttttaacttgtatttttgttttataggtcctgtgtgatttatgctttaaagaggctctgttttcacatgtttccaggatttgtttcaagatttagagcaacttttagcagttcttgtagtggtggcttggtaatggcaaattctctcagcatttgtttgtctgaaaagactgtgtcttttcttcatatatgatggttagtttccctggatacaaaattcttggctgataattgttttgtttgaggaggctgaagataagtccccaattgcttttagcctgtagggtttctgctgggaaatctgctgttaatctgataggtgtttctttataggttacctggtccttctgtctcatggctcttaagattctttccttcaccttaacattggataacctgatgacgaagtgcctaggcaaagatctttttgtgatgaatttcctgggtgttctttgtgcttcatgtgtttggatgtctaggtctctagcaaggccagagaagttttccttgattattcccccaaatatgttttccgagcttttagaattctcctcttcctcaggaacactgattatttttaggtttgattgtttaacataatcccagacttcttggaggctttgttcatattttattattcttttttctttgtctttgttagcttgggttaatttgaagacctagtcttcgagctctgaatttctttcttctacttgttcaattatattgctgagaccttccagagcatttcttattgttaaaagtgtgtccaaagtttcctgaatttttttttttctttaagctatctatttccttgaatatttctcccttcacttcttgtatcatattttggattttcttacattgggcttcgcctttctttggtccctccccaattagcttaataactaacctcctgaattatttttcgagtaaagcagggatttcttcttggatccattgctgatgaactagtgtgattttttgggtttgttgaagagccttgttttgtcatattaccagggttggttttctggtgccttctcatttgggtaggctctgtcagagggaaggtctagggccgaaggctgttgttcagattcttttttcccacagggtgttcccttgatgtagtactctcccccttttcctgtggatgtggcttcatgtgagccaaactgcagtgattgctctctcttctgggtctggccacccagagagtctgcctggctctgggctggtattggcacttgtctgcacagagtcctgtgataccaaccatctgtgggtctctcagccatggttaccagtgcctgttccggtggaggtggcggggtggggggtgcaatggactctgtgaggcttcttagcattgatggtttaatattctatttttgtgctggttggcttcctgccaggaggtggcactttccagagagcatcagctgtggtattatggggaggaaccagtggtgggtggggcctagaacaaccaagtttatataccctttgtcttccactaccagggtgggtaggaaaggaccatcagctgggagtggaactaggtgtgtctgagctcagactgtccttgggcgggtcttgctgcggctgctgttggggggtggaggtgagattcccaggtcaggggagttgtttacctaggaggattatggctgtctctgctgagtcatgcaggttgtcagggaagttgggggaaagggggcagtcacaggcctcacccaactcccatgcaaatgaaagggctggtctcactcccccagtgcacctcccaacaccctccagagcatttccaggctgagagcagtaagggcttgaaaacctgccccaggctgtatgcctcctagctttgaaagataagagcttggttcttcccctgcctgtggagtctgcacactgaatttgcaccctccttccagttctggccaggaggcttctcatctcgttcaaatggttacaaagttcagctagagatttccttctccctgtgtagttttaccctctgctcttctcccattggatccctggggtgccaggcaggaatggcctgctagggtacccagcgagctcccagggcctttctgctgcatcctctacccctgtattttgcttggctctccagattgactcagctccaggtaaagttggaaacttctcctgcaaacagaccttcggcttctccagtggggctgtgtgttcaggagaggagggtctccctctcccacttccgcaggtggggcactcgcagttttgggattgtctcctggttcctgcaggagcagtctgcttttttcagagggtctgtgggtcctctcaggatggctggtttgttttgcagtcgatctgatgctaaaattcacagtgcgaggtgccgcccactgctctgtccagagctgcaatctagtcctgcctcctgtctaccatgattgaccttaaaaactatccagcagtgttctgataacaatttgaattcatttacatgctgtcaacattattgctttaggatatattttgtttagctgccaagccacaacagtaacttctttattctttgcatcctttgctgagaataaaacctgttttgttataaatttacttatcttggggtatgaatgggctttggaatgagagagtcttgagtctaatcccactctgccatgtaaacttaaaattgttcccagcttaagttttctcatttgtaaaacagggtaacaagccttacattattgtggtattttgaaatcaagcatgttggggggctgacacaagtgctttgcaaacaataaatgccctgtgaaggataggtattaccccctgcagaaaaatgaaactggatccctatctctcattatatacaaaaaccaactcaagacagattaaagacttaaatgtaagacctgaaatgataaaaatactagaagaaaacctagggaaaactcctgtggacattgctgtaggcaaggaactcatgactaagacctcaaaggcagaagcaacaaaaacaaaaatagacaaatgagctttaagtaaactaaaaaggttttccacagcaaaagaagtgatcaccataatgaacagacaaccacagaatgagagaaagtatttgcaaactacgcatcccacaggagactaatatccagaatttataaggaagtcaacttaacaataacaaaaactaaccctattaaaaggtgggcaaaggacatgaatagacatttttcaaaagcagacatacaaatggacaacaagcatacaaaaaatattcaactcactaatcataagagaaatgcaaattaaaaccacaatgagatatcatcttataccagtcagaatggctattgttaaaagtaaaacaaacaaaacaaaacagatgttggtgaggatgcagagaaaggggaatgcttatacactattggtaggaatgtaaatgagtgcaacctctatggaaatcagtatggggatttcttaaagaactaaaattagaaccatcattcaatctagcaatcccactatggtgtatctactcaaaggaaaataaatcattatatcaaaaagatacctgcatttttatacttatcacagcacaatattcacaatagcaaagatatagaatcaacctaagtgtccattaacatatgatttaataaagaaaaggtagtatctatacacaatggaatactattcagctataaaaaagaatgaaataatctcttttgtagcgacatggatagaactagaggccattgtcttaagctaaacaactcagacacagaaagacaaataccttgtgtccttacttataagtgagacctaaataatgtgtatatatggacgtagaatttagaatgatatgcaatggacactaggaagtgtgaggggatgggaggagggtggatgactgggagttacttaatgggtacattatttgggtgatggataccctaaaaaccctgatttcaccactatgcatgcagtccatgtatataataaaattgcacttatacctcatacatttatacaaatttttaaaaaggcaaatataagcccattttcttttaaaaaaagtaaaataaaaggtggatattattgttagatgcgattattgttagatgctactttctgacttattcccagttcttagattgggggaactcgatttttgactctacagttcacagttcaacctttggatttctgaaaaaaaaaaaaaaaaaaaaaaaaaaaaagaattgagaagcattttgtagaacagattggagtttatctttaaataatcaaattaagcctttgtaatgggaacaagactaaattcagctctctaaattagccacaggaaagaaacaagaaggacaagtgatattattttaggtgctcagatatttgtataggctttgcttgctcacataaggaattgaggagagtatatcagcactgagctggtgctgtagtcccagctactggggagactgaggtaggaagatcactggagtccagaagttctgggctgtagtgtgctatcccttttgggtgtccacactgtttggcatcaatatactgacctcccaggagtgggggactactagtttgcctaatgaggggtgaagcagcccaggtctgaaatagaagaggtcaaaactcccatgctgatctgtatatcagcaatgtatacagtcttgaggaatcacacaggacagaaagtacctgaatcttaatctcagatatgtctaaaagggattgttaattttctgctgtgtgtcaggccctatctagtcatggtgtgaaagacaaagatgaagaaggcaaggctcttatgcaattgatggatagctccaggaaagacatcctggtgagcaggactgtgtgaaatagggaagcagctcctctaaattctttttttttttttttttttgagacggagtctcaccctgttgcccaggctggagtgcagtggtgcaatctcggctcactgcaacctctgcctcccgggttcaaatgattctcctgcctcagcctcccaagtagctgggattacagacgcccgccaccatgcccagccaatttttgtatttttagtagagacagggttttactatgttggccaggctggtctcgaccttgtgatctgcctgcctcagcctcccaaagtgctgggagtacaggcgtgagccaccgcgcctggcctctacattcttcatattgggactgtattagttagggttctccagagaaacagagctaacaggatgtatatatagaaagaggcttattgatggctcacatgattgtggaagcttgacaaatccaaaatcttcagggtgggccagcaggctggagacctgagaaagagttgcagttttagtccgaaggtgatccgttggcagaattccctctgcctcaggggcggtgagtcattttctgttaagacctttaattgattggatgaggctcacccatattatggagggtaagctgttttactccaagtcaactgatttaatatcaatcacatctaaaaaacactttcacagaaacatactatttgatcaaatatctgagtacagtggtctaggcaagttgacacataaaactatcacaggaacttgtttttggaatctgccttgtaccccatagcagattcaatcttatatagtatcccagccctaggccttaagcctccatcacttagttccatcctttgtttatgactgtgcttcaagcctactttgattgatggcactgctaagaccgtgtgcctttctgatcataccattagcttcagtcttgtcaacatttttatctgttgcagactgctgcctgggcctggcctcttcctataaccctaagctccactttgatcccagcctacttcagtcttctgcacagttgatttggcctacagactgctgaactgaggcaggatactcatagctcttagggggccattagtgtcctgacaatgtcatatcttccccttagctttgtatactatctagaagttacgtggcttcctgggattcttattacaaacttcagatccttcttgtttagaggtcatttattgtgaggctgctcctgccctctttgttctctcatcatgttttgtagggaggagaaattattaaatatactgccattttttaaataattgaatgcatatggtatttatgacctgcataccagtactgttatttcgctccattatgacttttattctcagaggcctatggttttcaaatgccactgttgtgaatagctgtctgtagaattgctaccatggtgcttgaatccttatacactagccattctacctgataccgtattccagtgagcactgtgcttgctgcccagcatttcagattggatctgatttcctgggattaaattccagacgttattttccaatttgtcatctgcctgtttgggggaagtttctttcaggttgtaggtcagatgggtgttcactgacatctttagatcctatttattgggtcttcttgttggtatttttttctataatggcagaataatttgttttcctcttcagaataattgcaaggtgaaaacaaataattctagcttaaaaatgatatcaaatgacttcattggttatattttagtagcttggaatattacagaaaagaagtacatattttcttctgctttgaaaggggaaatttaaatcaggatacttttagtctgtaaacatgactactttttaaaaacatatatgagaaatattggaacaataaaatctgattcatctaatagctttccttgatactttttatttttaactatgatagatatgtattaacatgtagttattctctttgaaaaagtatattcattttctaaaatgtacttagcttttcaaatatgattctcacagtgtcctgtgtattgttaaaaataattactgaaacagtttcactttgaagtacagtacttgaaatcttcagatcaatatcgccttttaaacctttaatacaaccttatgccaatcaagtcgcaagtgtagtttgctaaggtagaaacttcttgatttcagtacaattataactgaccaatctatatttcaaaatagaggcttttataatgagattccatatggatattgatttcaattttctgtgttaatataaaagtgcaagtggtctcaagcttaggtgatccaaaatatttttttaaggtagttgtttgaaacttagaatgttttttctaaagaactagtgttatacatgacaggtttccaggcccacccacaaaaggctgctcaaaccatagtgtaagctgaaaatagtgtcctaatggtggctgtaacttcttacttccctgaaaccactctaagtcctgattttctttgtgttcctagtatttgagtgtgagagggaagttggtagaagcaggtaggttgtatctggttagggtaaaagtgagaaaaagggttgttgatcagttcaggtggggtttaggtatagaagcttcatgaattagtgagttgctaaatatcagggaatgtaaagggcaaagttttggcctctggggtctagcaatagcaggaatggtgcccctgtctttagcagaggacctcagtgtttccatagggtctgtgatggcgcagtaagggtgtggcccttagcagaggtattggcactggtagctgtttgtatacataggattttcgcaactgtttataaggattgaatgctggtgagaggtgacagcatgctggcagtcctcacagccttcgctcgctctcggcgcctcctctgcctgggctcccactttggcggcacttgaggagcacttcagcccaccgctgcactgtgtgagcccctttctgggctggccaagactggagccggctccctcagcttgcagggagatgtgtagggaggcgcgagcgggaaccggggctgcgcgcggcgcttgcgggccagctggagttccgggtgggcgtgggcttggcgggccgcgcactcggagcagccggccggccctgccagcccgggcaatgaggggcttagcacccgggccagcggctgcggagggtgtactgggtcccccagcagtgccagcccaccggcgctgtgctcgatttctcgccgggccttagctgccttcccgcggggcagggctcgggacctgcagcccgccatgcctgagcctcccacccactccgtgggctcctgtgcggccaagcctccccgatgagcgccgccccctgctccacggcgcccagtcccatcgaccacccaagggctgaggagtgcgggcgcacagcgcgggactggcaggcatctccacctgcagccccagtgcaggatccactgggcgaagccagctgggctcctgagtctggtgaggacgtggagaacctttatgtctagctcagggattgtaaatacaccaattggcactctgtatctagctcaaggtttgtaaacacaccaatcagcaccctgtgtctagctcagggtttgtgaatgcaccaatctatactctgtatctagctactctggtggggccttggagaacctttgtgtctagctcagggattgtaaaggcaccaatcagcgccctgtggaagcagaccacttggctctaccaatcagcaggatgtgggtggggccagataagagaataaaagcaggctgccggagccagcagtggcaacaggctcgggtcccctttcacatggtggaagctttgttcttttgctctttgcaataaatcttggtactgttctctctttgggtccacgctacctttatgagatgtaacactcaccacaaaggtctgcagcttcactcctgaagccagcgagaccacgcacccaccgggaggaacgaacaactccagatgcgccgccttaagagctgtaacactcgccgccaaggtctgcagcttcactcctgagccagcgagaccatgcacccaccagaaggaagaaactccgaacgcatctgaacatcagaaggaacaaactccggacacgctgcctttaagaactgtaacaccgcgagggtccgcggcttcattcttgaagtcagtgagaccaaggacccaccaattccggatacactgggatttagatgccaactttactttttttagggtctgctgggctgagcctttaaaatttccctttgcttttagaaattaatttatggaccatacttgtatttgacccattatcccaagaaaattcttaaagcaaacataaaatacatggtccaggatttaatctagttgtcatatcattttaggttttcttaatctgtaacagctgttcagtctctctttgtctttcatgacaataccattttaaaaaattaatagactttatttttaagagcaattttaggtttacagtacaattgggcaagataatagtattatgtcaatgtaaattttctgattttgatagttatacatggttctgtaaaaaactggcttgtttttaagaaataaactgaagtgcttagggaaaagagcatcattctgcaatttactcttaaaaactatatatatagttttttctatgtatatatatagagagagagagagagagagagtgtgtgtgtgcgtgtgtagacaataaagcaagtgaagtaaaatgttaacaattagggaatctggaagtctgtgttctatatatctttatatccaataattttacttaaaataatgttttaaggaaatggtcataaatatttttctttttttttttttttttgagatggagtctctctctgtcacccaggctggagtgcagtggcgtgatctcggctcactgcaagctccatctcccgggttcacgccattctcctgcctcagcctcccgagtagctgggactacgggcatgtgccaccatgcccagctaatttttgtattttagtatagtcttaactgtaatagcaaaaggttagaaaagacctaaatggctatcaatgaagaattgcttacataagttagatttttacttaatggaatattatgtatgtatccatgaaaatgatgtaaaaacgtatagtccttgatttaggaagatgtctgaaatattttcttaaataaaaattgtcacagaaaaaaagacattaatttcggccagctgaggtggctcatgcctgtaatcccagcactttcagaggccaacgggtggtttacttgaggccaggagttcgagtttagcctgggcaacatggcgaaaccccatctctactaaaaataacaaaaattagctgggtgtggtggcacacgcccataatcccagctactcaggaggttgaggcacaagaattgcttgaacctgggaggcagcagaggttgcagtgagccaggatcatgccacagcacaccagactctgtctcaaaaaaaaaaaaaagaaaagaaaaaagacattaaatgcaaagaacagtgtcagtattgctaggatgtctgttctttccaactatatgttcaacatatcccaaaagtaagttgcaaaactataaaactttaggagataacataggacaaaatataggtgatcgtagtttgctgatgagcttcttttagatacaacaccaaaaacactgtacatgagagaagaaattggcaagtgagacttcattacataaaaaatttctgctttgtgaaagacactgttaagagaacgaaaagacaagccacaggctgggagaaaactttgtaaatatatatccatctgataaaagactggtatctaaaatatacaaataattcttaaaacccaacaataagaaaacaactcaagtaaaaagtaagggaaagatttgaacagatacttcactaaataagatgtacagatggcaaataagcacatgaaaagatgctcagtattatatgtcattaaagaattgcaagttaaaataacaattagctatcataatagctaaacccaaaactctgataacattgaatgctgacaaggacgtggaacaacagtaactctcattcattgctggtgggaatgcaaaatggtacagctgctttggaagacaggttggtaggttcttacaaagctaaacttagtcttactgtatgatccagcacacatgcttctagtatttaccctgagttgaagactgtccacacaaaaacttttacatgaatatttttagctactttatcataattggaccaaagtagaagcaaccaagatgtccttcagtggaaaaatgcatagacaaactatggtacacagatataatggaatacagatataatgcggagacactgcagttttggtttcagaccaccacaataaattgagtatagcaataaagtgagtcacagaaattgtttgctttcctaatgcaaataaaattatgtttatactatactttagtctattatttgatagcattatatctaaaaacatgtacataccttaatttaaaaatacttaattgctaaatattgctaatgatcatctgagtcttcagtgagttacagtctttttgctgatagagggtcttggctcattgttgatcagggtgatggttgctgaaggttagggtggctgtggcaatttcttgaagtaagacaacagggaagtttggtgtggttaacttatcctttcaatttctctgtagcacgggatgctgtttgatagcattgtacacacagtagaatttctttcaaaattgggttcagtcctctcaaacagtaccgctgctttatcaactaaatttgtgggatattctaatcctttgtagtcatttcaacagtctacatagcattttcaaaaggagtagtttccatctcaagaaaccactttctttgctcatccttaagaagtaactcctcatctgttcaagttttgttgtgagactgcagcaatttagttatgtctttagggttcacttctaattctagttctcttgctatttttaccacatctgcagtgatttccttcactgaagtcttgaagccctcaaattcatccaccaggcttggaatcaacttcttccaaactctcattcatgtttatatatatatatatatatatataacacaggctgggcctatatatatatatatatatatatatatatatgggcccagcctatgttataatttgacctccttttacaaatcatgaatgttcttaatggcatctagaatggtgaatccttttaagaaggtttagaattactatctgtggcagttatagccctattaaatgtatttcttacaagaaggcttgaaagttgaaattagtccttgatccatggactactgaagggatgttgtgttagcaggtgtgaaaaaaacattcatcttgtagatcagagcttttgggtggccaggagcattgtcaatgagcagtaatattttgaaaggaatcttttttttttttctgagcagtaagtctcaatagtaatcttaaaatattcagtagaccatgttgtaaacaaatgtgctgtcatccaagctttgttgttccatttatagagcacaggcagagtgcatttagcatcattctttttttttcttttttttttaaattatactttaagttttagggtacatgtgcacaatgtgcaggttagttacatatgtatacatgtgccatgttggtgtgctgcacccattaactcgtcatttaacattaggtatatctcctaatgctatccctccccactgcccccaccccaaaacaggccccagagtgtgatgttccccttcctgtgtccatgtgttctcattgttcaattcccacctatgagtgagaatgtgcggtgtttggtttttttgtccttgcgatagtttgctgagaatgatggtttccagcttcatccatgtccccacaaaggacatgaactcatccttttttatggctgcatagtattccatggtgtatatgtgccacattttcttaatccagtctatcattgttggacatttgggttggttccaagtctttgctattgtgagtagtgccgcaataaacatacgtgtgcatgtgtctttatagcagcatgatttataatcctttgggtatatacccagtaatgggatggctgggttaaatggtctttctagttctagatccctgaggaatcgccacactgacttccacaatggttgaactagtttacagtcccatcaacagtgtaaaagtgttcctgtttctccacatcctctccagcccctgttgtttcctgactttttaatgattgccattctaactggtgtgagatggtatctcattgtggttttgatttgcatttctctgatggccagtgatgatgagcattttttcatgtgtcttttggctgcataaatgtcttcctttgagaagtgtctgttcatgtccttctcccacttgttgatggggttgtttgttttttttcttgtaaatttgtttgagttcattgtagattctggatgttagccctttgtcagatgagtagattgcaaaaattttctcccattctataggttgcctgttcactctgatggtagtttcttttgctgtgcagaagctcttgaatttaattagatcccatttgtcaattttggcttttgttgccattgcttttggtgttttagacatgaagtccttgcccagcctattcttaatggccctacgatatttagaatgttaaacaagcattggcctcaaactaaagttacaagctgctgtagctcttaacaagagagttagcctgtcttttgactcttcgaagctaagtattgacttctcccctctggctatgaaaatcccagatagtgtcatcttccaaaataaggctgttttgcctacacaggaaatctcttgtttagtatagccaccttcatcagttatcttagctagatctagataacttgctgaaccttctacatcagcacttgctacttcatctttcacttttatgttatggagatggcttctttccttaaacctcaggaacctacctccgctagctcccagcttttcttctgcagcttcctcacctctgtcagccttcatagaattgaagagacttcgggctttgttctggattaggctttggtttaagggaatattgtggttggtttgatgttctatccagattgctcaaattttctccacatcagcaatagggctgttgcactttcttatcaaatgtgtgttcactgaagtggcactttcagtttccttcaagaaattttcctttgcatttacaattcagccaactgtttggcacatgaggcctagctttcagcttgtcttggcttttgacgtgtcctcctcactaagcttaatcatttctagcttttgatcgaaagtgagacacatgtgactctttctttcagttgaacacttagaggccattgtaggtttattaattggcctaattccaatcttgttgtgtctcagggaatagggaggctggaggagagggagagatatggataatggctggtcagtggagcagtcagagcacacacatttatagattaagttcattgtcttatatgggtgtggttcatggtgccccaagacaattacagttataacatcaaagatcactgatcacagatcaccataagagataaaataataatggaaatgtctgaaatgtaagaatcaccaaaacctgacacagagacactaagtgagcacatccgcttgggaaaatggtaccgatagatgtgcttgatgcagcgttgccacagaccttcaatttgtaaaacattcaatatctgtgaagcacaataagtaaagcataataaaatgaggtatgcctgacttatttagtgatataaagaaatgagctggccgggcgcggtggctcacgcctgtaatcccagcactttgggaggccaaggtgggaggatcacgaggtcaggagattgagactgtcctggctaacatggtgaaaccccgtctctactaaaaaaaaaaaaaattagccaggtggggtgtggtggcgggtgcctgtagtcccagctactcgggaggctgaggcaggagaatggcctgaacccgggaggcagagcttgcagtgagccgagattgtgccactgcactcccgcctgggcgacagagcgagactccgtctcacaaaaaaaaaaaaaaagaaaagaaaagaaaagaaatgaactaacaagtcatgaaaagacatggaggtaccttaaatgcctattactaagtgaaagatagccagtcttaaaagcctttatatactgcctgatgccaactatatgacattatggaaaaggcaaaactatagagacaataaaaagatcagtggttgataggagttgagtaggaggagtgaataggttgagcatatggcagttttagggccgtgaaactattctgtatgatactctaaaggtaaatatatgatattacggatttgcaaaacccgcagagctgtacaagaatgaaccctcatgtaatctctggactttaataaataataatgtatcaatattggtaaatcagttgtaacaaatgtaccacagtgatgcaagatgttaataatagggccaactttggacaggggagagagggtatatggggactctgtactttatgaccaatttttgtcaaaacttaaaactgcactactaaaaataaaagcaataataaaactcactaaaaatgcatcaatttaaaaaaagttaaaaaaccatgtattctattgattgttcatatatccttttccataattctccagtgacttaatatttgaatttaaacaatttaaaaatgatattcatataattccaaggttttccacacattttttatggactctcaattgttcttgggtgtaccttagttattcttagttcatctgttattttcctgtaagtacatatttcctgaaggtatatggttatactttgaaacaaaattagaaatgatcttacattaaatattatcctatttaaactattttaatagttttagatgatttaagttctcagcatgctttttctatcttctgtgctatatatgctctatttttatatcctttgtttctttgcagatgaaatggtttctattgttctagttctttctgtcttttgccaatagcccacctcatatctctgtacatgcacacccatcacaaacagacagacacacacatgcatacagacttttgaaccttagagttaagctgcattcttgtcaaaaagatctagcactccaagagtggatgcctctccctttctttgggagatcagcattactcatcacctcaaatattcttgcttcactatttgctcattgttttggatatacagagcacttaaatatttgctattttagtgcatcattaatgaaccgtttattatgttttcaaagtcaaatatgggtcaaagtaatttttttaactaagttttactcttcaggttcttttttaatgtgaaaaaaagaggcccacactgtttctgtctatttataggtggtaattggaagttggtacaagagtagtctaaacagaggagtcatattgctccaggcagattaaaaaaggtatctagttatataagcctacataaagccacatctccagactaatattttcaaacgtgaaggggataaaatttatattatgaacagctgtagatttaactttgtaaagcctaaaattatagtagaaaatatttcaattatagttcttaaaatatgaaagagatgttgattgtacattgaaatattttgcataatgacatctatttttcacacacatgcatacatacacacacattcccattttgtagattataaaacagaggcacacagtagttaagaggcttgtataagcttacacagctagcagggagaccatgattcaaacatcaggcagtagaactcctgagtaccctctctgaactgctaagctatgttacctctcatcttaactaacatgactcattttttgcccttaaaatgccttgaaaaatactatgaagaaatacctcatccagctgtagaggaacaaccaactacatttatttttagaaatgataaaggaattgttttgctctgtacatagacttctacaactagagcagttgcataacgtggtctgtgtagattacacttttttcacgattcatttaactacttgaatttgatatcatttcctttcaaactgaagcacatctgatgcagatttactgggacattcgcactccattttggttttaaaagttgcagacctcatttacaagagcatgaacaacatagctatttgaaattatcccatcttttataaggtttcacttttcttctggaaaggcaaataatacgtggaaaaacatacttaatagtattactgtttttttaattataactgacatactgctcatggactagttgccagttaacccactgatgtgtaaatgtcctaaactgagaggcttgactgaagaaaaataaccaagttacttagcctatatgacgaagtttcctaaaaacccctccatacacatttggaaatattcatattatatgtttttttaaatctctaaatgggaaattcatgtgtatttttgaaatcaaatccagactgctttgatttgcttgtgcttacgtcctataatttcaatgtcaagatgcaaaattgtactagtcattccttggagtggttaaaaatgaaacagtagtttgatttcatattcatgatcgattaagtgagaaatcaactgtgcagtagaacttttccagtttatgtaattcttgaagctttatgagctttagaatcaaaacgctttcatgatctttgcttaagacattatagtagtgttgcttagaagacaaagcaaataaaaatacttttatactcttcgcttaataccttgtagtagtcttgcttacttaaaaaaaaagcaaaaaaaactacatctgccaccttgcatttaatatttagaaaatacgaaaatgaaagaatcaaattaacaaacatttatttactcaacataaataattaacatttttggttttttgcttaatatattttattaaaaatttgacgtcaaagataaggttgaagtccactctgttacttctttagttccagcaaccgccctctcttttcagaggctactgcatttatgaatttggtgtatattcatttagttcatacttttgtccattgcctctactagtttaatgctttaaattcaatctgccttcttgtatcaaccatcatgtttagcattttagatacaccatattttaaactatttccaatcaaaatgtcagttattaaaaaaatcagtgtttattataaatttctatgataaatatttttcttggatctaattccttctttattgccaaaatttgtttttaatgagtgtaacaaactgttaatttttgtatgtctgaaaatttctttattttatccttactcttcaataacttagattcaagtatagaatcctgggtatagaattcctgctggatggttagtcttcttcaataattagaagataatatttcataatctagtagcatttgttgttgctgatgagaagtgttagtataattgctacctctataacaagctctcatatctctctgatagctttaaatattttctttttgtctttgttgttatggaatttcattacaattatgaatacctgtcgatttatgtgtgtatatataaatacaatctcccatttcttcaatctgatgattcttttttttgttagagaatatcagccacatactttgtatatattatcatctctgcacattctctttttttcctcacttagtgggactcctatgagacaaatgattcatcttttcattcttatacctcaaatcaatttctctttcatagtttttatcttttttctttccatattgtgtatctgcctcatatatctctttagctaagtctaatttatagttctattaattctttatttatttattttattattattattatactttaagttttagggtacatgtgcacagtgtgcaggttagttacatatgtatacatgtgccatgctggtgtgctgcacccattaacttgtcatttagcattaggtatatctcctaatgctatccctctcccctcccccccaccccaaaacaggccccagagtgtgatgttcccctttctgtgtccatgtgttctcattgttcaattcccacctatgagtgagaacgtgcggtgtttggtttttttgtccttgcgataatttgctgagaatgatggtttccagcttcatccatgtccccacaaaggacatgaactcatccttttttatggctgcatagtattccatggtgtatatgtgccacattttcttaatccagtctatcattgttggacctttgggttggttccaagtctttgctattgtgaatagtgccacaataaacatacgtgtgcatgtgtctttatagcagcatgatttataatcctttgtgtatatacccagtaatgggatggctgggtcaaatggtctttctagttctagatccctgaggaattgccacactgacttccacaatggttgaactagtttacagtcccaccaacagtgcaaaagtattcctatttcaaaagctaatccaccacgatcttgtaggctgtatccctgggatgcaaagttcatttaacaaatgcaaatcaataaatgttatttattacataaacagaactcaaaagaaaaaaacacatgattatattattatcttaattaatgtagaaaaaccttttaatgaaattcaacatccattcaggttagaaatactcaacacaccaggcgttgaaggaacataattcaaaataataagaactatgtatgaaaaacccacaaacaacattttactaatgagcaaaagctgcaagcatcccccttgaaaattggaacaagacaaggatgcccattctcaccactcctattcaacatagtattggaagtcctggccagaacagtcaggcaagagaaagatataaaaggcatccacattggaagagaggatgtcaaactattcctttttgcagacaatatcattctattcctggaaaatcccacagtctctacccaaaagctccttgagctgataaacgacttcagcaatcaggatacaaaatcagtgtacaaaaatcagcagccttctgaccaggcccagtggctcatgcctgtaatcccagcactttgggaggccgaggcgggcggatcattaggtcaggagttcaagaccagcctggccaatatggtaaaacctcgtctctaataaaaatacaaaaattagccagacacagtggcatgaacctgtagtcccagctacttgagaggctgaggcaggagaatcgcttgaacctgggaggcagaggttgcagtgagccaagattgcgccactgcactccagcctgggcgacagagtgagactccgtctcaaaaaaaaaaaaaaaaaaaaaaaaaaaatcagcagccttcctatacaccagcaacatccaagttgggaccccaatgaagaatacaatctcattctcaataggcaaaagagaataaagtacttaggaatacagttaactatagaggttaaaggtctctacagtgagaattacaaaacactgctgaaagaaatcagagataacagaaacaaatggaaaaacatttcatactcatggataggaagaatcaatattgttaacatggctgtactgcccaaagcaatttacagattcaatgctattaatatcaagttaccaatgacattcttcaacgaattagagaaactgttttaaaattcatatggaacaacaacaaaaagcttcaataaccaaggcaatcctaagcaaaaagaaatgctggagacattttctacctatctttaaactattctacaaggctggagtaactgaaacggcatgatactgtcacagacacacagacaaatggagcagaatagagagacctgaaataatgccatatacctacaaccatctgatcatcaaaaatgttgacaaaaacaaccaatggagaaaggactcattcaataaatggtggatatgcactagaccccttccttacaccatatacaaaaatcaactcaagatggattaaagtcttaaatgtaaaacctgaaactataaaaaccatggaaggtaatctaggaaataccattctggacacaggccctaaagatttcatgacgtagatgccaaaagcggttgcaataaaaacaaaaattgacaaatgggacctaattaaactaaagagcttctgcagagcaaaagaaactattagcacagtaaagagactacctacagaatgggagaaaatatttgtaagctgcacatctgacaaggctcttatatccggaatctataaagaacttaaacaaattaacaagcaaatgaaccccaaacaacttcatgaaaaagtgggcaatggacgtgaataaatacttttctaaagaagacttacatgtggttaagaagaacatgaaaaaatgctcaacatcacgaatcattagagaaacaataatcaacaaccacaatgagataccatcttataccagtcagaatggctgtcattaaaaagtcaaaaaaataacacatgctggcaaggttgtagagtaaagggaatgcttatacgctactggtgggaatgtaaattagttcagccattgtgaaaagcagtttaatgatttccaaaataacttaaaacagaactatgattcaactcagcaattccattattgggtatatactgaaaaggaaaataaatcattatgcaaaaaagaaaatgcacttgtatgtttatttcagtactctccataattgcaaagacatggaattaacataaatgcccatcagtggtagactggatacagaaaacatggtacatatacactatggaatactatacagccccccaaaatggatgagatcatgtcctttgcagcaatatggatggagctggagttcagtatcctaagcaaagtaacataggaacagaagaccaaatactgcgtgttctcacttataagtgggagctaaacactgaatagacatggacacaaagaaaagaacaaaagatacccaggcctacttgagggcagaaggagggaggacatgaggatcaaaagctacttaagaggtactatgcctattacctgggtgactgaataatcagtacactaaatgctcatgacatgcaacttacctatatgataaacctgcacatgtatccagaacctaaaataaaagttttggctgggcgtggcggctcttgcctgtaatctcagcactttgggaggccgaggtgggtggatcatgaggtcaggaattcaagatcagcctgaccaacatggtgaaaccccctctctactaaaaatacaaaaaatagctgggtgtggtggcacgtgcctgtaatcccagctattcaggagaatcacctgaacccgggaggcggaggttgcagtgagccgagattgcatcactgcacttcagcctgggtgacagagtgagactccgtctcaaaaaaaaaaagtttttaagaaataaatacaaaagaacacgaagaagtatttgctaacgcatatttttcttttggagcttagtatattaataggtatgtgatgcatattaactagcataatctgagatatttataaaggaaaatatcatcttgctaagtggttatatctcagccaaaaataaatttacatttgttataaaaactgaaaatttatgtggtttatgtgtagaaggcttatagaatcagtatgattttcattcagattggtgtgtgattttttttatcagtagaaaattttatgataacaacatgaaccactgctgggaattcaatggaccgtaaacataggcacataacagacatggaaacacgtacattgtgaaggataagtagatatttatcaaattatatatatatgatacatatacatataagcatatatgtatatatatgtaaaacattgtaaccatggccaccacctttagtaaaggtacatggtgatatgagtgcttataatagggaattaccttgtcagggaagttaaggaaggctttcctgaacaactgatgcttgaactccaacctgtgggatgatgtgttagaactggctagtgagtgggaatatccttacaaggaggggccctgtagcagaaggaaaagcagatgaaaatattgtcttcatacttagaatttaattttaaattttactgatgtttgtgttaatatccttgtctaatactattcttttacataagctttaatggagaccacccaattggttccttcagaaaatgtatgttaattaatgctagggacctatagtagatgtcataaaccttatgattaaacattacaactgtgtaaaattacatcttagtaacctcagtcatttgtattatattaaaatgagaaaatgcacagtgatagaagtcagattaaaggtcatgtaactaaaattgtatgctgaatgttgaggaaagaaaatttggatgttctctgttcatttgggttattcaaaataacatgtagtcctgcatacatttaaaaaattaaattagacaatttatcagttgtctaatttaaaatgtttggattcatcttcctatctgataacaattttttgtttttatattcagtactttgaaaaatcacagacttcacgttaacacttaagcattctaaaaaggcacaaaagcatgtgaatatagaatttaagttttgaggattgttcttgtcatttcctgcacacacagtatttgaaaaatgcatatgaccttgcatttaggtaatattagatcagaatgatctttccacatagaatattcatatgccagcagaagtatacatatctactttagagatagtaaacataggtcaaatagtgactgtggaccacatatattcacagcataaagaaattctcacattgaggaaattttatttatttgaatttttaaattgttccattggatgacagataacatttaggtgttaattacccaattattttcctttaaaagtaataaatgtatgtaatttctgtgaaaaggaaaaccagaaaacaggcatctgtttattctcatgtactgctaacttaaattttatgtaatttcaaagtccaaagccaaattatacaccttttctattgcaagcaaataaaaacaatgtaaaaattactttaaattcaagaaacacgagcttatacagttttcattatgatcacatccctaatgttcagagcctttcagaaaaaaggattttcatccattattctaaactattttattaatttgttaaattaaacagatactatcacgtaaaagtaacctcttcccatcttgttttcactaattactttcaccaagatcataataccttcttaaactgaagaaactattcatgtccccaaatacagtgcattggccttcacacacagttattgtatgttttggctcatcatgggccctctttggagatatgcttgaggactcccctttacctctaatgtctacagattcagcttttcagttcattgtgttaactgagttttacatacagactataaactgtctgctgaatctattgagataaaatttgtcagcttttgtgctcttttgcatagggtgaatactaatcttcatattcttatacatttagtttgaaacaaagtgaaattaactggtagtttaatacttcattgccttatgcctttttagctgaccatttgactgtttctctccagtcttgctttttcatctacaagtttactacaaagactctacaaatggttaatttgattgaaaatatctgcctaaactatgtcagtaaagcatttttccccttttttggctagatgccattattccatatatataattatttcattattttctcttctttatatcagattaagattcatgatacacattcttgtattgcctgtacggaaaacacagctccgttattcactttggctaagagccccttgggatttctgacattgggtaaattatagatatagtagacaaactgttaactcaggagtagtgaagaacttaactctttaatgggtagcttatcccaattcaccgctttcatgggaaaccaaggctgttttgaacaacatatgatagaaagtggcaagacatattctgtcatttgacacctgacaatatattatatatctcttttccttagtgtacatgttaggaaaattagcaagcatttataagctcatggaaactctgaaattccatataagttgttttatcaagtcgtagcagtcagttctatcacagcatatgctagacagggccagggcaaaaactacatctacctagacatgttgctggctacacatcttattgaagaccaaattagacagtaaggaggtggtgagtccttactggaacatctaaagataatcatcaaagacatgtactgaatattgttatgtctaggcttctttctaagtgcattttaggtgccagctcatttacttttcacagttctttgaaatactgatattgtctccattttgtagctggggaaactgagtcagagagaaaggttaggaagcattgctcaaggtaacatagaagaatgacagagctaggatttgattgcagatattctggcccatggcacctcttaacctttgtgttatgttgcttctcaggctgacagtgagctcagacgctggaatgttggtcaaaatgaggggacttgaaagtgaacttcaaaattatccagttattttctggggtgatgctaaaaaaaaaaacccatattcagtagtgagcaaaagaggtgtcatgaagaatgtttatttagtggtcagtatgtagatggccaactctagaaggaggtgtgacattgtggtgtccaggctgcatgttatgaatagatttggaacctggcatgaagatccatagcagcccatgggtggatctatacagaacaaaggccctaacccaagaactagtatgtcctttttctggcctccttttaaaacaacttcttggtatgggtatataatgtgggcagaggtgttctgttctctaaagcaggtacaaatgatggccgctgagcgctggagcctccagggccatcacatttttaacagataaattacttaaagcttgaataaatggaatcttgtccatgctgtgatattacttggctctttgtgggtcctcagtaaacatgaaataaccctgaccttttaggaaaagattaatctggttactagccgtaagtgttaatgtaatattcttgtagcaaataaaaccctaagcacacagttgttgtttggtaaacattttgtttattgagcctgattttcctgctttcagccatagagaaatttaagcttcatatattattctttcatgggtaaattgtacctgctttttgagggtgagtagactgaaactaagactacggaagctaacagtttcatatgcctaggccgggcgtagtggctcatgcctgtaatcccagcactttgggaggctgaggtgggcagatcatgaggtcaggagatcgagaccatcctggctaacaaggtgaaaccccgtctctactaaaaatacacaaatcagccgggcgtggtggcgggcacctgtagtcccagctacttgggaggctgaggtaggagaatggcgtgaacctgggaggtggagcttgcagtgagccgagattgtgccactgcactccagcctgggtgacagagctagacttcgtctcaaaaaaaaaaaaaaaaaattcgtatgcttttgctaggcattataacatttaatcctcacatcaaccatggaaattaaaatatattcattcccattcttcagtggagaaacttgaagctcagagaggatgagtaacttgcacagagttgcatagttagtaagcattaaatccagcatagaactcaggtctgaggaactcccaatccattgcttatgttacttcatccacaagtattgtgaaatatacaactttaacatttcaaagagcagaattaaagaatctgccagcttccttttgaataggagaggggtattccaaggtcattagagaactggcctggagctcttaatgctataactcctaccaacactaaaggagagagtgggatcattgtcctgttcccattgccatcacctctacccctaaagcatgcagacatactttatccagagagttgaaaattcacagacaccattcctctcattccttccaagctgctgtggcttagatccaagcaagctccccatgtttcccttaattccaagggctattatctcaggttctgcacatcttacaaagtagatgtagtattgcaagtattgttttatctcaggctaacctatccatttaaagctctggacagtcatgttggtatagtttatgaatgtaaaattcttccttaaacataaattctagcttgaaattattcctaaccaccatctactccaaggccacatgaaattaatcttttacatatgatttttctggaaagtaagtttttgcttctacctgaaggagtacatctttatctgttcagggctcattaatgtttcctctaagatcccacagcagccatttgtaacacttcatggtgcttctcatgcaggcaggcatggatttgctctgaggacaatcaggatatcatcatcatcttcattgtagtgacttctatccctttctgtagtactttgatgtagtattggagtattagatcaggataatacgggatgaaatcctcccaaaataaatcatgcttgactctccgccgaggaaattcctccctctatttaataacggagaaaaatccagtcatctctgagtctagctcaagtatctccattgtgtgaagcttttcctaattcctcatttaaattagtctgtttttcctcttctttgtatagactacaccatgctgcctcctagttctgcttctgattccttttctaggtagtctcaaccttccggaatgagagatattaaggatacaagggtgaaacaggtagaagaagatgtgattttataatttcctttatttactctggttcttaccaaacaacaggtttatcagaatcagaatttttgtagcattcagacccagtttaaccctttttaaaatataacaaacttctttatcctgttgtaaaaacccctcccaaactcttattcagccttccctcaaggtgaagctccatttgccgctacaaagtacttgattcatatctgttatttcatattataatataattatcaaaagttaggggcctcatttccatggcaaccagggtgaaattttgtctttatgacagtcttaaccctacttgattgaattccagaatatccttttgtctcctctcatttttgtgattgaaagcatacaaaatgtctacagttcacctgtctgctgctcccagttttttctgtctaaccataaacgaatctgtgcattcataactaaatcactaactttggcctccagattattttgatagttttagaaataagtgtatataaatatataaataaattattaacaatagagaagcaaatctacaggattgaagtaatatacacaaggtgtgacatcacatacagacagatccaaaacttggacctgatcttcaggatttccagtgcgaggctccttccactaatagatggaagggtggaaagatgccttcttatgccagcgctaacaaaacatgttatgcattgtcattgtcaacatctcactggttgttgtggttatgtggacttttgcagtgtttatattcagaatatggctacgtaagaattagatgaaatataaggaatgactcaaagttggttgtaatatttgaagtcatttcctttattttatttagcatagccacatgttatttggagatagagttttaaatatattgttttacaggttgggtgtccctaatctgaaaatgtgaaattcaaaatgttccaaaatccaaaactttttgagtgccgacgtgatgccacaagtgggtagtgaagatgacgtttttaacactgcagaagaagtgcctataagtgacatggtgaaaatgtgtgatgggattattgaaggaatagagcagcacacattcataacagaacaagaaatcatgtcagtttataaaatcaaaggaaggtttctaagacaaaaaaattcatgaggcagatgactctgaggggaacatttgaaaatcgtatccagcagaattcctcctcatccctataggacccatttccactgcttcttatgttttttcttacctaaaaaaaatgctgtttacagtagccttttaatcaaaacacagcatcataggtggagactgaaagcctgctgctgtttgttgttgctgtggtctaacagctgctataggtatctggtgatgcaactgtgctgcttagctacacttaacacattactttttcactgtattaatgatacgccatattttttttactgttaagtacttatatctgactaaatataagaaaatgattgcttatcagtagcatataaattcagagtcaggaataagctcatgccaagcaaccacagattgtccgtatgggtggctgagatagtgacacctttgctttctaactatttaacgtacacagactttgtctcatgcacaaaattatttaaaatattgtatatggccaggcacagtggctcagcctgtaagctcagcactttgggagccgaggcaggtggatcacctgagatcaagagttcgagaccagcctgatcaacatagtgaaacgctgtctctactaaaaatacaaaattagccgggtgtggtggcacatgcctgtaatcccagctactctggaggcggaggcaggagaatcgcttgaacccggcaggcggaggttgcagtgagccaagattatgccattgcattccagcctgggtgacagagcgagactctgtctcaaaataataataataataataaataaaatattgtgtaaaattaccctcaggctatgtgcataaaatgcatataaagcataaatagattttgggtttagacttatatcccatctccaggatatctcattatgtatatgcagatattccaaaaatcagaaaaaaatcccaaatctgaaacacttttggtcccatgcatttcacctaagggatactcaacccatattggcatataatttttttttgtatatattcttcttcataatatattcaataagataatccataacttttttcgatatgagattagatttttaaaaatacattgtctctagtttcattggtcacttaggaaacaatagactacactgtgtcatttaaatagcactgattagccaaatggccattttaaattccaattcttactctgatttaatagccaatagaagaagtttttctagaggcaagatcttgtcagaaacaattaatgggttgccctttgtggcttctttgttctttttagggtattcttttctatgatttcaaaggttttttttttttttttttttttggtagatgacacagaaacttctcagtttattcccctgtgtcatctaaaatactataatttgccacagaaatttgctctgatgcagtcccctgaaatcattctaccaccctcaattgtggcaggaaatatgtttaaaatgttgtctcagtataatgcaaaagccagagttaagagtgatatggaaaagtgatccgatgaggtggagaggcaagaatagtagcatgaatctcagttgtgtatattttgacaagaaataggaaggggcaaaaccaaggagaaggtggcagggatggagaaaagagggtggctttccaagagataggcttcgtcttggttctgcctgcatagttgcagcacttgagggttggagagggaccacagggggtcacagagctatgtctccagcatcaaaattagagggcccaaagacataattcagaagtttgggatgcaaacttttttgaagttctctcatgagatctgccatcaagatcctgactgttgtcatattgagtttgttttcatagcaagatttattgttatcaagttctatcgtaccttgtaaagctttttttaaaaaaaacttcagagtgattttgagctatagtatggcaaaatttataccctgctacctttctggagccatacaatatactacgacagaaaatataaggtggcacgttgtatataatacaagtgataatggaggaactgaataattggaagtactctaaaactacacccagacacgggggtgggggatagcagtataaaatgttcatcaaccaaagtcaaagtataaaaggagaagcaggactttggagcaggagtgtaagatctcagggactcatgggtggggtgagggtggatatgggagaataactttacaaaatattgagggtaataattacaaagtttggcctacccagaaagactagatagggatgctgaaaaaggtgaaagcgctcacctttttccagccaagactgactatacgtaggtggcttcattctgaaaaaaaaaaataactgatttggacctcctctgggctgtatgtgggcgcagttgagaggatgtactgtcccacctttctgataaaggaactatgtaaataattgctttgttgccaattttaaggaatgacatgtctgtattgtatttctcctcacctccccacccccagcctgctcatttacatttcttttagttctttgaaaaatagaaatcatcactggaatacatgataaccattattaatttcttttgactttcattttctaagaataatgaatacttacctactaccctccatgctactaccgaaaagtggattggaaaataccctttgaaccagagtcttcagtagagtgtctaggtcaggagtgccctgtttgagccattgtgtcctttagaaaatggcagtttatctggcaaattcttgattggggaattgtagatggatcaggcattgtctgattcccttattttcttttacgcatataatttgccatcttataccttttcaaatatattgaattgtccttagtatatgtaatttatttccatagagtctctagcttgttgtactaataaagtgataataataacagtaatgacaataataataataatgtcaacctttttgccaaagaattatttgaatctgaaaaaatgcaataataggtataactgaaagtatgactctatgaagtgatcttaccttatttaagccagtaattgcattgctatttaaagatttttttttgttatggttcctcatggaacagaaaagttctaattgattgtcagcaaatactgtgactaaaattaatatttattacctaactggaaaataatattttataatagtttgatgacattttaaacagattttgaaatctaaacatatttttattgctggcacttctagattcataaaattaagtgacagatgaattcgaatgtgtttgaggacctatgtactatcagatcacaacaaaacttcctaactgccatacaccaaaaaatagacttagggactaaaccttgtcttactgcactgtacagtgtacttttttctgttttctaattgcatatcctctttttctcttggaaaacgttcgataaaagtactttaagaaagaaacttgaagttgagctcctgctattggaaaatgttctgtgtactcttaatgaattgtttgtatatttgtcattaaaacatttaattatattcttacattacagtctttgttttatctaaacttgtgtttccaagggtatatctgagtaagatttaactgaacacaccacactttcagattggatattttactcaaataagacatgattatattacagatggaatacagtcaattataatatttctacatatgttagaagagcaaaggtgaaacagcgaaaactcattaaggatttaataaaaggagccaaaatattaccactagcatttgttaatctaagtgctaaaaatgtctgcctctgaagccagcagaaaacaattatttaagcaagtggaaaatagacaatgaggaaaatggtgctttcaaatatcttcactatgtttgtctatgcaatgacatgataggaagtagaaaagactgttgaagtgtaaagtgtaccaaacttagacaaatactagaaaaaggtctagaatggttaaaaaccaaaggagtttaaggaagctgaatttccttaagaccatgtatctattaatttaccttcttgggaacttcatctgcccaaatttgcactagttttttcttgaggtttaatttaaatctacagtactcactttaaaaaaatccttaatttggttgtaagcaataatatctgtaaataaaagtgtaaaattttagcactgtctaccacttaatcttttatgtgtcccactatggacacactgccttggggaagatgttaaatatatcggagggtaactgtttctataaagatgagaagtaagaaatggaggaagaaatctagagagctaaatacagaattgcataattaccagaggcaggagaaaattgcacaaatctatgctaagtttatccaaatcaggtctctccaattatattgtgagtgggtgatgtgagcctatctggagacttttctgtttcccagtcactgttcccccctaataattatcctgactatatgggatcagaaaaattttggagtgggctttggttggccacctttccctcatctagaggatttgctgctattcttttattctttcactgtataaaaaccccaaagaggagtctctgttaaaatctactgatttttttctatttattctatgtatccctactttaatattcacatattctatgtattatttatatattttttggtctctttcccctcacttgtatatagcttcatgaagacaagaatttgtgtgttttgtttactgccatattttgaactcctagaacagaatctggcacacaccaaatgttcaataaatatttgctgaatgaatgaatgatgaatgattttagctttgaatattatctcatgttcttgttatttcttgtcccctgtcttgataacaaatttcctctcacccagcatttaaaatggattttttcttcttgcattgtttagtctcttccttttatttaggctgcagcttttaaagctacattttatttagttgtagtattaatttatagctgaagctccaaaaatgttttatttttcttttatcatggtaaaattaatcctttaattttattctcccttgtcattgatcatttctagcataagattaaaattatatacttcattaattttcctcacactgcaaaatttagttttacagtatggtatgaaccctgttgttttgagtgttgttatacttcttgtgctttaaacttttgtcatttgatagaaatggtacatttcgaagggtacatgtaaatggtatatttttaattttgttttctttttagcactcaaggagattctgacagaaaatggtatattttatgagtagtgattttgtgaaaagcatttcagagcttccatttcccctcttgctttgataaataccttttacttcagataacatggtagttttggtctgttgttagtaaatatagtcttatggttttcaaaagaaatgttttaacataacttatttttacttcttcactttatatttctttaatgcttaaagtatgttctcaacaaataactgaggcagaacataggtgattaatcaatatgactagagtgtgtttttatcttcgctaagatatgtatgtgaaagatgatatagtatgttttccccaaatatactaatttctcctactttggatattttctaagattttaaactatatttttagattgttaatattttcataaaagctactttaaaaataatgtccatatatgtttgaattgttattacctccaagcctgttcttattctctacacttccttgcaattgaaatcaagtacaatgcttttgatctacaattagaatgtttatcatcaaggggtgagaatctgaactttttcaaacctctggatttgaaattctgtgtgttttctgagtcaaaggatgagtacatctttgaacttcataggccgtaatgcaaggcagacagcaagaaatacaaatactttcccttcttgtttactgtgagatacagacgtgcatttatttgtttcatatgcccctcactttttcagtctaaaccaatgggtgcaattaaattagaataaatgtaaaacaaaaaattaaagtaaaacatcatttagaaaattcagggactgtcaaatgggaaaagcaaatagatttctaaatgcctgataatttaaaacaaaattaatacaaaaattaacaaatagagcattaaaaaaagatagatatgcaaatatattaacatggaggacatttgtttttctgaaagaatatgtaaatctgcaatctttatgaaacgaatttatttaatacatttattagtgaattattattcaggcctgaattttgtggtatattgaggattttactattatcattttgcttttcagttattttccattgtcctaattctctcaaaaatatttggaaactattttttcaatcaaattttcaatattcaaaaatttgacattggttttaagaactgctaagaatatacacttgaatgtatctacatgattagcactgaagtgtcatttttaataatttagtgaaaaaaaagataaagattgtgtcttagtgtgtggtaatataaaattaagatacaaatagggcctagttttccatatatgttaaaatattttattttatttttatcaggtaaaattgagtctttaattatattctctttagtcatttattatttatttctagtaaaataaggagagttaccttttatctaaaagaaattcagctagttttccctacgaaatactaaacatttccacgaaatagttttttaccagtgttgctaagaagttgcagtaaataattttgttctatccatattttagtgattatgctatagctagccctcttttctaaaaatggaattaaaaagaagtgtaaggttaatattgttatgtgtgaatttgatcctgtcattatgatgttagctggttattttgctcgttagttgatgcagtttcttcctagcctcgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgagttgaaaattctttaagaatgttgaatattggcccccactctgttctggcttgtagagtttctgctgagagatccgctgttagtctgatgggcttccctttgtgggtaacccgacctttctctctggctgcccttaacaatattaaccttaaatgtaaatgggctaaatgctccaattaaaagacacagactggcaaattggataaagagtcaagacccatcagggtgcaaagcaaagagttggaaccaagccaaatgtccaacaatgataggctggattaagaaaatgtggcacatatataccatggaatactatgcagccataaaaaaggatgagttcatgtcctttgtagggacatggatgaagctggaaaccatcattctcagcaaactatcgcagggacaaaaaaaccaaacaccgcatgttctcactcataggtgggaattgaacaatgagaacacatggacacaggaaggggaacatcacacaccggggcctgttgtggggtgggggcaggggggagggatagcattaggagatgtacctaatgctaaatgatgagttaatgggtgcaacacaccaacatggcacatgtatacatatgtaactaacctgcacattgtgcacatgtaccctaatacttaaaagtataataaataaataaataaataaataaataaataaataaataaaaaagaaaatgtcattccattgtcttctgtctcattccaggaagtcagctgtaactctcattgtagctctttgaaagtaatatgtctctgaatcacattctccctctctctcttttcacctctttaaaacattttttgtctttgtttttcagcagttttacttttatgaagggcctagatgttgtttttttcttttctttttgcagtatttcatagtgcctattaaatctgtggcttcatattttcaattttgaagagttctctgcctttatttgtttagattagttttttcccattttgtctgtcccccaagccctttctttaaatttagttgctcacatctaggacttttttcctaagggtctcttagatttattctctgtattttctttttgcctttttatgcctaaatctgtccgtattctagttttgctattcagtttttagctgcatctaatcagctgcttatcccgtacttgggttcttattttcacttatactttttctagaatttttatttgtttttctttttgtggtgtctatttatcttctgatataaccaacttttaaagaaattcctcacgcatattgatcataattatttcaaagttcatgactgataactctattatatgaattcttgtgagttattttattgtagtatttttctcttagtttttgactatgtcttattttcatgaatacatgattattgatttatattagacatttttttgttttaaaatttagcaaaatgttgaggctctgaaacatgttatattcccttagagaagatttacttttgtttctggcaagtaattggcctgggaatggcagtattccatgattaccttaatgccatcaaaacttgagattattggaagcttgccttcatttcttgagatgctagcctatttaagaccttgcactcttcctaaggtctcctaatggaaagtttcttgtgtctagtctttcctatttgttaggccataaactttcatttttatcccgtttaagccccagaatcttttggaagatctgttcaattttctaacttctcagctcccactgcagattctagatatttggcttagctatctgggatttactctactaccttcatcctttcacatttctttctgctttggtatttctctgatggcttctaataattgtttttatattttcccatgatcttctaattgttttcattattatgttttgtgttacacattctagttcaccactggcagaagtagaagcaaagatctggtttggttctatgcttcttagtcccagcctctcatgcataccaaagacattacaagggagacaatatttgtcaccaaaaacaaaataaaacaaaaaacaaatacaaaaaaattcaccatagcactagtggtctttaccctgcaccaataaggtacattcagatgcaagagagacttgttaatgtaaacctcccatgacgatgatgattggtacatgagtggtcaaaatttaaatcagagcttctcttctcttggctaggcaccaaggtctagaggaataataatattagatatcatcttcctgaggaaaaaaccattaattctttatatagatgtcagaattttaagatgcagattactttaaatttgttttacctatttttactccttttagttttttaccttcattttaaacctaaaagtggataatttttaaggtttatatatagttaccaggtttttttaaagtacagtaaaagaaaaagtatagtatagctttatgttgtatgaaaactctaaaagggaattttttcactatagatgaaatcttttaaacataatacttattttctgttaagattacttaaaaatctgaggtaccccacatggtggcctcataacccaattaagattacttaaaaatataaagagagacaaaatgtatgcataacttttaaaatttatttttatatgaaggagttctgtaatttagtgatgatttataaatcaacttgcctgtcctttatttatttatttaaatagtttttggggaacagatggtttttagtcacatggataagttctttagtggtaattaccgagcttttggtgcacgcatcatctgcgcagcatacactgtagccagtgtgtagtcttgtattccttgcccccttcttcactttccccagcatccccaaagtctgttttgtcattcttatgcctttgcatcctcatagcttggctcccatttaaaattgagaacatataagatttggttttccatttttgagttgctgcacttagaataatggtctccaattccacccaggttgctgtgaatgccattattttgttcctttttatggctgagtagtattctatgatgtatatatgccacattttctttatccactcattggttgttgggcatttgggttggttccatatttttacaattgtgaattgtgctgctataaacatgcatgtgcaagtgtcttttttcatataatgacttcttttcctctgggtagatgcccagtagtgggattgctgggtcaaatggtagtcctacttttagttctttaaagaatctccatactggttgtactagtttacattcccaccagtagtgtaaaagtgttcccttttcaccacatccttgccaacatctattatttttttattatggccattcttgcaggagtaagttggtatctcattgtggttttaatttgcatttctctgataattagtgatgctgagcatattttcatatgttttttggctatttgtatatcttcttttgagaattgtctattcatatcatttgcccactttttgatgggattttttttcttgccaatttatttgagctccctgtagattctggatattagtcctttgtcagatgcatagcttgcgaatattttctcccattgtgtgggttgtctgtttactctgctaattgtttcttttgctgtgcagaagctttttagtttaattaggtcccatcgattcatttttgtttttgttgcatttgcttttgggttctttgtcatgaactctccctaagccaacgtctagaagagttttacctatgttatcttctagattctttagtgtttcagatcttagatttaagtctttgatccatcttgagttgatttttgtataaggtaagagatgaggatccagtttcattcttctaatttttaaaattagttaatttattaatttgttttttcccagacagagtcttgctctgttacccaggctggagtgcagtagcatgatctcagctcactgcaacctctgcctcccgggttcaagcaattcccctgcctcagccttctgagtagctgggattacagccatgtaccaccatgcccagctaatttttgtatttttagtagagacggtgtttcaccatgttggccaggctgatcttgaactcctgaccgtgtgatccacccgccttggcctcccaaagtgctgggattacaggcaaaagatttctttaatgtcacctcccttaacttgagcagttagaatggtttgaaaaaaatgagaaatattttgaaccttgtaaatttacaaattcatatataaacttagggtgctaaaacaaatagttctttccttttaaattttataatttgattttaatactctttctgtgtcaattatgtatattagcccaagttctatcctttgggagctattttgctttgtttctgtagctcatacttaccctcagcttttcattctgtgaaagtatgctatttactgcaagggattgtgaatttagtttcaatgtaactggtaaaaacaaaaaaacagaaagatgagctgtttatgtaccattagtcaaatatttattaagcagctgctatgttttaagcactgtgctaggtgctggggacccaaaaatgaatgaaacagccttttcttcagggagctgctggcctaatggggatgcagacaagaagaaagagagttatttatggtgtgataagtgcaactgtagaattaatggagtatactatggaatcacattcttttctaacagttgctgaacagtgtcttggtatgtagagaagtagtagcctctgctgtctatcctttgtttatgggatatagaggggaggcggggaaaactcatgaatcaatcagttgttacagaacagcattccaatgagttgtgtaaaagaattggaaacagattgaagttccttaattcatgaatctctaaaagtggttggggacaagtgtgctttgctcttgccaaagtgtagtgcatgaaagatagtgtgtcattttactgacccatatccaccctcaaattaagttactcattgtgctctcatcagattttaaaagagaaatgcaaaacatggatattagtagaaatgccacaaaatacaataatcagataaaacagtcttaagaagaacactgttttgtgtgtgtgtttgtgtgtagaagtatgagtacatatgtgtttgtatttttgcatggacatacatttatttgtgtatagtgagtatttatatgaaggtacataacaaaatgaactatggttaaacatatttatgccactagtgggtagtgttagtggagactgtcagaattaacttcataggatttctcagtgcaaaaaaatgtcatgataatgtcatgtctgcctttctcaaagataaaggtactttgattaaccctaagctccctttttttgttttaagagacaggatctggttttatcacccaggctggagtgcagtggtgcaatcatagctcatttcagttacggactcctggcctcaagggatcctcccaccttggcctcacaaaatgctgggattacaggcatgagccaccacacccagcccctaagctccttttaaagaggcaatgtgatgtagtggcttaggacacagtctggacagactgcctgagtttaaatcatatatctatcatttgttatatttgacacattccttaactttttagtgtcctggtttatttgtctataaaacattttaataatccctatcttatatgctcttgtgagcattaaatgatatatgtaaagttcttaggtgaataatgggtatgcagtaaggaatacataagtataacaaacactgatggttacactttatgtggaaggcctattccatactgagaattggttatggcagacagatttgtggtattctttctttgctctccatttccttcaatggcttaagagtacttgggacaggatttagggagatctacagagtaccatcataataagatgtaaattacatgcaaatcagtaggtacatattatttgtccagcatgtacttgatgttaaaagaaaatttggatacatagtgaaaacaagtataattcctcagagattgtttggagtccttccaagtgtttttagtgatcagaaaatactgaggtgtttagctgatgagaaaataaagagaaaaaaaggggaagctattgtcaagtaaaatagagacagtcactttggaacatcagtaagtgaagtttttttatttcattgtagaaatgaggaagcatgttgaaaaattaatttgggttagtaacaaaatcccttttgttgtgatgtttgtattcttaaccaaaaatctatcttttttctactttcgcatttaatgtgacttttttcctatacttattttgaactcactgaaaatatactttatatcatctcttttgttttaacagttatagttcagagtaggtgaaaaataagaataatatattagtttcattatcactacatctgttatctacacatgtgtgtgtatgtgtgcgggtgtgtgtaatctgaaaaaacatagaattgaaaatcaagaaacctatattccagccatagtttatctcacctataagatgtgtgtatgttgaatgagaacgttatatatgcaaatgatttattcgttccttcccctgttcatttatttaatttattgaatgtcttttatgtgtcagatactgacagtacaaaggtgagtaactcatagactctgtctacaatatactttacatatagtagaagactaattcacagtagagcatgtgacccaagccatgtaatcaaagtcttcttgggaatttttgtgggagtcttggagaaacgtgattttttttttccttttgattttgtgctagaaggacatgataaggataaagatgctagtgaccatctcttagaccatagtgttttggaaaatgaggtcaagataaaagaaagcaaagctaaaagctggagaggagacaatatgtttctttggtgatagagatgcaagaaagggaaggctttaccaggtagaggaggcaccacaaacaaggacatggagagatataaaacaatataatgttctaaatgaaatgtaagatgtgcagaggggttgaaggaatggagggaaagttaggcagaggctaagtataaaagatcttttaatcttgcaggtagtggggagccattgaagtactttaaaaataatctggcaataaagtaaggagagagaatctacatgatgtggtaaatgacctaattgggaaggtgagagaataggtggaatgtaggttggcttcaaggtttcttctgatttgggtgtctgattgcattgtgttattattcaaaaagataagaaattcaaaaggagaataaggagaaaagataattactgttcttttggaaataatgaatttgaagttcatttggaagatctacctggaagtgtcttgactaaagttcggcagagggctctcttagttgaccatccgattacagctatcaacacagatgtgatagtggaaaccatgaaagtgaatgtaattacttggaaagagcaagtagttctagaagagaagaaagatggaggcagaactttgggtaggtgaaagaacatgaaaggagactaaaagggagaggtaggagagggagtggtgtcatggaggctagggaaagaaaaggtttaataagaaggcctgctcaataatcaactgcacagagaagtcaaacagcattactgaaaacaatctattggattttgcaattaagaggatatttatattcatccaagagcaatcttttttgagaatagagtgaggaggtaggccaaggtatgattgtagtggattgaagagtaaagagaaaataaaagaaaagagtgatagtagttctagaataacgtaggattgaggaagtttggtttagtttggattgtaagatggaaaaccacttaaatagattttgaagaagaggtcagtagagaggcacagattgaaaataaaggagatggagaaagtgaattatcagtgaatttctggagaatatatcaaggaaccatgtggagggtgacttttcgttaggaatgcacctttttttgatactagaggaaggaagggagaggatacatatggacatggataggcatatcagtcaagttataactatccccaaaagaagccacttaaagtgtttaaaagagaaggaatttaatgcaaataatttgttaataggtcatggaagaattggaaagctaaatagggaattgtaaaccaacccaataattaacaagagcatgaagccaataagctggagggacaaaaaaggaggtagcattactaggagtggaagctagaaccatgccatcctgtctgttaccctttgaaggaaacaagctctggtagagataccatcagaggcagagggtaggggagaggaatgtcctagcttctctccactttctccctttcagtctcctgctggtgccccccagacatccagcatgaagcctccagggtcaagctttgtgccatcttaagcagagccaggaaaaagaacaaaaggctctgagctcaaacaggcccatgactattataatagggttggaagtgtgtgagagaggaaagaaaataagaaacgaagaaaagccaggcatggtggctcatgcttgtaatcgcagcactttgggaggccaaggtgagtggatcagttgagcccaggaggttgagaccagtctgggaaacatggtgaaatcccgactccacacacacacacacacaacaaaaagttagctgggcgtggtggcctgctaacttttactcccagttacttgggaagctgcagcaggaggatcacctgagcccaggaggtcacggctgcagtaagccatgattgtaccacttcactccagcctgggtgacagagcaagaccctatctaaacacacacacacacacacacacacacacacacacacacacacacacacacacacaacacaagtgaaggaaaaagatggtaggagtatgtgcatgaaaattggtaaagctactatgaagaatggttgaaggaaccgagcaggcatatataatacacaatgcaatttggctgatgatccatttcatttctagacaagaagttgctatagcaccaatttgcactactggacgtaccaggaatacatgtccacaggaccagagaagcttctctgagatccaagtaaatatattgtaagtaaacaagtgagaaagcttacaggagaaagagcaactgtgagagactagtatgttgtcatttaagattttggaaggggaacagttctaagtactaggaagttccatgaaaacataagcaggggtgatttctgtgttgcagagagggtaaaataacttgcatactaggtaattgagagctattgacatgggtgttgaagtcagcagtgattataacattttttagggtaaaaaggaagaccaagtcaggtgtccaaatcttcagggaattaagtgatcatctggaaaagacaaggatgataacagtaaagagtagaaagtgatacacttgatatgtgtctctaagagcagagggttttgagataaggttgggaaagtaatggtataaatatggtgattaagagagtgctacccatggccctgtgtcacgtgaggagagaatgaggaatttccttatgagaaggccaggatctagttgaaggaagaaggcttagaagtgttctggaattaggtctaaaatggcaggtaattacaacaaaatgagaatttgagagcaaaatgggtagaggccagtagagctgtaggaagaaaatggcagcttggggaataacactgtttagacaattgatagatgagactgaattttgttgaggggcaaataataaccagaatgcaaaagactggttggatcagctggcttcaaaattcctggtctaggaaggctgaagtccttgtaggttttggagggcccctgtgtttagtagcctttgctcagtgctgatgtttcatgtgctgcttctgttcctccctctgctgttcattcaaatatattacacttggaaagtagttcttgtctcttcattccagcataaccttagggtccagtttttagaagtttgaatgtttacactgggttatcattattcactacagatgcatttccaagtatcacagtgaacagatgatcagctgattctttctacattagcatagaaaagagtccccaggtgtgagaatgggtcctggtaagggttgtatgatggactttcttattttcacagaggaggtattcagtaaaatgtttctgaagatgatcttgatcagaggatggggaggaggaagagaaagaaaataaagggggtaataaattaatgaagtggctaatgaccatcatgtggctgactcaatatacactcttatccatgtaccaaatttcactgaatctaagggacttttttttcacattttttacaataaatttttacaatagtttttttcacattttaatatttgtgaaatgttaatgacattacaattagaattggttatatcttttcttttgtgtcagtccatacaacactctcatggatttagcaaaatctgatgtgtgtttattttcattcttatttgcccctactatatctcacattttaaaaacgcttgttttctttgtgcttattttccttaagttctttaactctactcaaattcaacctgttccccgccttgtccttttttttttttttttttgagacagagtctcgctctgctacccaggctggagtgcagtggcgtgatctgggctcactgcaagctccgccttccgggttcacgccattctcctgcctcagcctcccaagtagctgggactacaggcgcatgccaccacgcctggctaattttttgtatttttagtagagacggggtttcaccgtgttagccaggatggtctcaatctcctgacctcgtgatctgcctgccttggcctcccaaagtgctgggattataggcgtgagccatcactcctggcctcccttgtactttttattgcaacttcatttttcttttggcttgtagttttcagaatattgttttttctccaaatcctcagctttaagaagatagaatataatacacattctctaggcctaactcttttgttaagtatcacatggctcttgggcaagcaattcaacctctttgggccataattttcttatatataaaatgaggggttaagtctaatgataccaatagtctctttctgttttgaaaatttggggtttcttgatcatcagagggctgaaaaatccctactctaagcctttgagaggaatcagggcagaggataaggatatagagaactctgcctcttttcttagactcattccttaaacctgcatattctacatattctctgatctacatattctctgacttttgttgctgccaagctactctggctcaaggtttttatgtctgggcatagacatctagcaacatcatcttcatttatatagatctactagataaaaaaatagcatatgtccctctcttcaagtttagtaaaaagagtcaatattttttataatacataatttggatttttaattttttcctgggaagttattgttttctgttgtctctagcacaaattgaagattaagtctcagaatggaaagtttagaagagactatttgctgtggattactgttatatgtatatgtatttgtatttgtatgtataaagtataccataaaataaggtagcttgctagaagtcagatcattagttatcaggtcacccagaaagtggggattgttttattgcctgttggaattgaaatggtgtttctgtagaacatattgtaatcagtattttttagcatggataaatactggaaaataaactcagttggaagtgaaaatagttgaactccaagttctttttatttgccaagtgatgactttgggctagctaaaatatctattaatttttaagggaaaattaatggtagtgtcaggtcttaattacagagtagatactacattagattatcactagaaaggacaaatgatccaagagaagttatgttagtggccctatatgtaaggaaactagctcggaaggaagctaatagttccttacgatttcctagggaaattgctttaaataatctgtagtttggtagatattcatatcccaaaagtcacttaatgacagcacaggttaagactacaacagtgctgcaaggaagtgtatatagttcatttaggggaataatttaatatgagggctagaatataaaacaaaatgtagagttaacaattgtctagcaaattcaagaatgttggtagggaagcactgacttaaccaatgacgtatacaattattagagagttactttggtcagttaaagcaaatgcaaaaataacaacaaaaactaatctttctcaagtatctattaacattctagatattctctattttaaatttcaagaagggcttagagatagggtgaacatgtaatttatcattcaaaccagggcaataagcataaactaagcttattcctggaaatcaagggtataaagttgctctagttaggtcttaccatgtgtctactctcatttctgattattgctaaaaatgttaagaaatgaactagttaacatgccaactgaagagaaagagacaaaaatctttctcagtaagcctctaatctgttgattctaaccttttggggagaactgatgtcttggaaagtgatgacatggactctctccaatagaagtgaattgaaaatgaaatatgagggattcatagacccctgaaaaccattcatgggcaagaatcttagcttaaagccagaaaaaagaaataggatatcaattttttattatggtaaaagagctacccacaagcaccaccactactcaaacacattttgatgaactgtaacataattaacatttcttattataaataattcaaatatatacaaaaatagaaagaatattataatgaaaccccatataactatcatgtgaactcaagattgcataagatttgtccatacttgtttcacctattcccttttttagttgtggttgtttctgaagcatttttaaacaaatcccagattcatataatttctcccctctatactttagcttagcagaatgtcattatcacaactaacaaaactgacactgattcttcagtatcatctgatactctattcatattcaaattttatcagttgtgtcaaaaatgttattttccattggatttacttgaattggtatccaaacaaatatcacgctttgccttttaatttttatagtccctctactgccataacctttctccctttttgaagcaaactggtgcagttgtgtcatattatggatttgattcttaatcccctatatttcttgtaaacaagaagtgagttgttaggcttgcttagattcagattagatttattttcctttttccaggaaaatttccatagatgatggtatatatttcataggttatgctctataaactgatattttaggaattgctgaatcagaaattagaatcttacgaccaaaagaaacaccaggactaattcttttttctcactttccaaaagtatctgtggtccatccaatgttctttcagccatcaaaatattaactattcatatgaaatatttataaaaagtgacgtcaactatatttccctttaatattcattttaaattattacagtgagcatgtacttttcattcttgtcccttctcttttctggtttcctttatcccattcttttaaaaacaagctatcagttcccatagcagcctttaccaaggtagataaatatcaacatcatggttgaaataccaaagctcagtgccagcaattatcctacaatttgtgtgttggcgtaataacacacagggacttgagcacattactaatagccattgaggggagcaagctagtctctaaacatattaaaatgcctcagaggactttttcagcactacataatcaagatttggtgatacgagctgctttgttaggacttgtgaattttgcattgccttattgtgtgtgtggaaattagtgccgaccttcataaattggcttagataatacacagatcaaccaacaggagacagaactagccaaataaagcatatggcaaatcactggaaaaagagcgtattatgtagtgacttttaatttggaaatgagaatgtaagaatatctccaatttaattggggcttgtctgaaaaatgcgttgatatctgtcatttcagaattgaaatgttttgatttgctgaagttttatttgctttgctgaggacaaggatactaccaggaatggggtctgacaaaaataaattattaagttgggttattcttatttttattctttttcaagatagtattggcaaaatctatcttgttattcttagcaacataaataagaagtattttgggggtaaagagcatattagaaagaagtttaaaaattttctgtcttttgttatatttgattttcaggaaaataaggtgaaaaaacatctattttcatacaatttctttggatttaattatacaaatagtcattaataaagtaagaataatgcatggtttactggataaaatttgaaggatttctgttaacactgaagccattctttaaacatgctggaatttggaagtcagattttcttcagcgtctttgataaacttgtgggttttttttttatcatgttgatttttaaagagtgtttttggatttgtatctccctttatttatagtttattgtgttaaaaccctcctaattgccactcctcatcctaaccctgggaaaaattcttgttattggttactcccattccttagggatattatataagcttttttacctactactccaagaaatctgcattatatgggcattattatgtattatattcaataaagaaattatagggcaaggcagctgccacatgaaaaatgacttgtttggtattgtctgtttttttagagaggggcatggaataaaattaaaaatatataaggctcataaagctttaatggtgtgtatatatattaatttctctcaaaaacaacatatgaaagtgtctatatgcacacaaacatatatacacacacatatatgtctacatacgtgtgtgtgtgtataaaaggagtgattccattgcaaggtggatctaattattagactatgtcctctcaaccgggcacagtggcttatgcctataatcccagcattttgggaggctgaggtgggcggatcacgaggtcaggacattgagatgaacctggccaatatgttgaaaccctgtctctactaaaacacaaaaattagctggttgtggtggtgcatgcctgtagtccgagctccctgggaggctgaagcaggagaattgcttgaacccgggaggctcaggttgcagtgagccaagatcgtgccacagcactccagcctggcaacagagtgagactccatctcaaaaaaaaaaaaaaaaggttttcaagacaagtaccatgtctctcaacctcttttttcaagaccaaatgtcttgcattttctcaactcaactttttttcctatgtcatcctttcaagacacttcaggtgagagagccaagatggccgaataggaacagctctggtctacagctcccagcgtgagtgacgcagaagacgggtgatttctgcatttctatctgaggcttaaaaaatggcgcaccaggagattatatcacacacctggctcagagggtcctacgcccacagaatctcactgattgctagcacagcagtctgagatcaaactgcaaggccgcagcgaggctgggggaggagcgcccgccattgcccaggcttgcttaggtaaacaaagcagccaggaagttctaactgggtggagcccaccacagctcaaggaggcctgcctgcctctgtaggctccacctctggggacagggcacagacaaacaaaaagacagcagtaacctctgcagacttacatgtccctgtctgacaggtttgaagagagcagtgattctcccagcacacagctggagatctgagaacgggcagactgcctcctcaagtgggtccctgacccctgacccccgagcagcctaactgggaggcaccccccagtaggggcagactgacacctcacacggccaggtactcctctgagacaaaacttccagaggaacgatcagacagcagcatttgcaattcatgaaaatctgctgttctgcagccaccgctgctgatacccagacaaacagggtctggagtggacctctagcaaactccaatagacctgcagctgagggtcctgtctgttagaagaaaaactaacaaacagaaaggacatccacaccaaaaacccatctgcacatcaccatcgtcaaagagcaaaagtggataaaaccacaaagatggggaaaaaacagagcagaaaaactggaaactctaaaaaacagagcgcctttcctcctccaaaggaatgcagttcctcaccagcaacggaacaaagctgaatggagaatgactttgacgagttgagagaagaaggcttcagatgatcaaactactccgagctacaggaggaaattcaaaccaaaggcaaagaagttaaaaactttgaaaaaaatttagacaaatgtataactagaataaccaatacagagaagtgcttaaaggagctgatggagctgaaaaccaaggctcgagaactacgtgaagaacacagaagcctcaggagctgatgcaatcaactggaagaaagggtatcagtgatggaagatgaaatgaatgaaaagaagtgagaagggaagtttagagaaaaaagaataaaaagaaacgaacaaagcctccaagaaatatgggactatgtgaaaagaccaaatctacatctgattggtgtacctgaaagtgatggggagaatggaaccaagttggaaaacactctgcagggtattatccgagagaacttccccaatctagtaaggcaggccaacattcagattcaggaaatacagagaatgccacaaagatactcctcgagaagagcaactccaagaaacataattgtgagattcaccaaagttgaaatgaaggaaaaaatgttaaaggcagccagagagaaaggtcgggttacccacaaagggaagcccatcagactaacagctgatctctcggcagaaactctacaagccagaagacagtggagggcaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccactgcaaaaacatgccaaattgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactggcaaattggataaagagtcaagacccatcagtgtgttgtattcaggaaacccatctcacatgcagagacacacataagctcaaaataaaaggatggaggaagatctaccaagcaaatgtaaaacaaaaaaggcaggggttgcaatcctagtctctgataaaacagactttaaaccaacaaagatcaaaagagacaaggaaggccattacataatggtaaagggatcaattcaacaagaagagctaactatcctaaatatatatgcacccaatacaggagcacccagattcataaagcaagtcctgagtgacctacaaagagacttagactcctacacaataataatgggagactttaacaccccactgtcaacattagacagatcaatgagacagaaagttaacaagaatacccaggaattgaactcagctctgcaccaagcggatctaatagacatctacagaactctccaccccaaatcaacagaatgtacatttttttcagcaccacaccacatgtattccaaaattgaccacatagttggatgtaaagctctcctcagcaaatttaaaagaacagaaattataacaaactgtctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaattcaggagctggttttttgaaaggatcaacacaattgatagaccgctagcaagactcataaagaagaaaagagagaagaatcaaatagatgcaataaaaaatgataaaggggatatcaccaccgatcccacagaaacacaaactaccatcagagaatactacaaacacctctacgcaaataaactagaaaatctagaagaaatggataaattcctcgacacatacaccctcccaagactaaaccaggaagaagttgaatctctgaatagaccaataacaggctctggaattgtggcaataatcaatagcttaccaaccaaaaagagtccaggaccagatggattcacagccgaattctaccagaggtacaaagaggaactggtaccattccttctgaaactattccaatcaatagaagaagagggaatcctccctaactcattttatgaggccagcatcatcctgataccaaagctgggcagagacatagccaaaaaagagaattttagaccaatatccttgatgaacattgatgcaaaaatcctcaataaaatactggcacaccgaatccagcagcacatcaaaaagcttatccaccatgatcaagtgggcttcatccctgggatgcaaggctggttcgatatacgcaaatcaataaatgtaatccagcatataaacagaacgaaagacaaaaaccacatgattatctcaatagatgcagaaaaggcctttgacaaaattcaacaacccttcatgctaaaaactctcaataaattaggtattgatgggatgtatctcaaaataataagagctactctatgacaaacccacagccaatatcatactgaatgggcaaaaactggaagcattccctttgaaaactggcacaagacagggatgccctctctcaccactcctattcaacatagtgttggaagttctggtcagggcaatcaggcaggagaaggaaataaagtgtattcaattaggaaaagaggaagtcaaattgtccctgtttgcagatgacatgattgtatatgtagaaaaccccattgtctcagcccaaaatctccttaagctgataagcaatttcagcaaagtctcaggatacaaaatcaatgtacaaaaatcacaagcattcttatacaccaataacagacaaacagagagccaaatcatgagtgaactcccattcacaattgcttcaaagagtataaaatacctaggaatccaacttacaagggatgtgaaggacctcttcaaggataactacaaaccagcgctcaatgaaataaaagaggatacaaacaaatggaagaacattccatgctcatggataggaagaatcaatatcgtgaaaggtaatttatagattcaatgccatccccatcaagctaccaatgactttctttacagaattggaaaaaactactttaaacttcatatggaaccaaaaaagagcccgcatcgccaagtcaatcctaagccaaacgaacaaagctggaggcatcatgctacctgacttcaaactatactacaaggctacagtaacccaaacggcatggtactggtacccaaacagagatatagaccaatggaacagaacagagccctcagaaataacgtcgcatatctgcaagtatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacagacagcctacagaatgggagaaaattttcacaacctactcatctgacaaagggctaatatccagaatctacaatgaactcaaacaaatttacaagaaaaaaacaaccccatcaacaagtgggcgaaggacatgaacagacacttctcaaaagaagacatttatgcagccaaaaaacacatgaaaaaatgctcaccatcactggccatcagaaaaatgcaaatcaaaaccacagtgagataccatctcacatcagttagaatggcaatcattaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtgtatacccaaaggactgtaaatcatgctgctataaagacacatgcacgcgtatgtttattgcagcactatttgcaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagtcaatgggtgcagcacaccagcatggcacatgtttacatatgtaactaacctgcacattgtgcacatgtaccctaaaacttaaagtataataataataaaataaaataaaataagacacttcattatgctattgtaattccttttaattactgcattttgacactattgtattaatgtagtactgagaccctaacatactaccaggtatggtctcattagaacattaagactattattttctgatatctgacatctgacatgttgtgctgttggtttttccattagtgcaggctaatggatgagataatttttagttgcaaaaccatagaatacttaacagtcacctaatctttatgtcttcttcttcatcatttctttctaacagaaaatactgtcggaccatgtcttcctcatcttatatgtgtttaattgagtctccaagacacattaattctagttcccaggtttacatacacgtgtcagaagagttacaattggctgggcttggtagctcacgcctgtagtgccagcactgtggaagtccctggctagctgatgatttgagatcagcatgactgacatggtgaaactgtgtctctactaaaaatacaaaaaaaaaattaactgggcatggtggcactgtggctcacgcctgtaatcccagcactttgggaggctgaggggggcggatcgtgagttcaggagagtaagaccatcctggccaacatggtgaaaccccgtctctactaaaaatacaaaaataagctaggcatggtggcacgcacctgtagtcccagctactcgggaggctgaggcagttgagaatcgcttgaacccaggaggcggaggttgcagtgatcacgccactgcactccagcgtggtgacagagtgagactccgtctcaaagcaaacaaacaaaaagatacacaaactcagaaaatggtttccaaaaagctagtttacttgatggtttaaaggtatggggagagtaactagtatttgaatagcttaaataaaaaatgttttgattaactaatgaaacatggtgggctgaagatcttatatcaaagaaaagggtggtggagaccattgttttatttattcattcatttattaagtatttatttgtcaccactttagtgccaggcattgtactcttaaaaaaaaagagagagtgagagagagagagagaaaagaaataggtagagaatctaatttaatccgaggtgtgggaggaggaggagaggattaaaatggaagaaggtaatgtcagcctcctgcaaattcttttctcactctgtaattcttccatatggaggaaaggaaagcagagtgctgaaaggatgaagtaaaatctgcagaattatttcaccattcagcattagatttattaaaaaagcatacaactgaaagttttctaggttgaattactaacttgccttcttagaagaatctggatacttagtttgcctgagggaacaaatatttggaaagggcttccaacttcaggctaagacaagtgagaggagttataagatcattcaatcagaattagtgtataagcaaatgtttagaaaatgctgagaatagttgatgaacagtgaatctttattagctgcttgtttacttttaaatctcagagtaattttaaatattaacattgcttaatgttcagcaatttccaaaaagttaataatttcattgaagtattgtttctttcaaaggtattcagatacatacatgggcatagtcatgcacgcacacactgacaacacagtctttgttcactttgttgccagttggcttttttatatggaatgtagctgggcagtggtgagaggcaggttatccactagtggacaagtgaccataatttaattttgaaaggactgaaaattaattgctgtgagtagcctataaataaaacgacactacttgagtacttgtttgagaataataataatatttgctctaagttttagccatctctttttcagcaatattttttcttcttccttaaactaattggttgtgcgaaaacatgtggttggtaccactgtaaagaaatatgtttgcataatataaatttaatctgaaattaactcttaagaaaatgaaatggaatttacttcacattaattgtgtttaggttagccaataattgtattagagaacattagtacttcaaaatactatcattttgaatgaattgctgtcatatttaacaacattttggagtacatgagttctgcctcatgagtacatcagaaaaaataatcagtaagttttaagtaagacttatttaaatttaaatactaatttaaatgagttacttaagtaagagttacatattgttttaaatacagtgaaatgtaagcaagaatctattcttaaatgaagtcattgttactataatacagagtttttgtcatataaagtttgtgaggagctgggggtaatgtagggtagaacgtggagcaagagtctgtgttggatattggaggccattagaggcctttgcatacttccaggcagggcaggggagaatatcaaaatgatgtttgaagaaaaaattctaattgatgtgttgtacatggggtactaaaggcttatcactgagtaagaaataacatttttggagttagagcaaatataatttccccttctagtttcttacgacagagaaggaaaataatttccttttcacagactatcttctctcctcttcctaaaaacaaaaacaaacaaacaaaaacaagtgtgatattttattgaccagcttacatctaggacaatcataccttttcttccattaccattatgcttgatttagttgggtaatagtcattcttctactctgtgaattgcagtaaatttcttggtagatttatgttaccttaagttgatttttttttcttgtgataatagtcataacaactttaataaaacatagcaatatacagattccctgtattttatcagataatttacttgcttttgcataattagtctgcaaagatttgcttctatttttgcagatggagaatttaagtctcagagaggcttgtaacttccttgtggtccctcagttgataagagacaggggcaggatttgaatgacaaagtatttgactcttcatgatactctaatactgtttaattgtaacctatcttttcttttacaagacacatgtatgtaatacacaaaatttacatccaagagatgtgaaagcatagatttttttctttctgaatccacattttaaatgaatggtgtggtacatgaggttctttcctacacttgggaaatgtatggcactaacgcggaaacatttctaagttagtttgtcacatggggattcaatcaggaataactgtgtgacctttaagaaaattaagattggctgtcagagggaaatttctatcctaccctatgggatagtcttacagagaaagagggtatcactttcaattctcaataaagaatggtaacttattaacctagaacatgtgtttattactgaatatagtcattttaataatgggagaatattctatgatatctttcctatttttaatgtctatttagaactttaatttatcacatacagaaaaacatgatctaaagccttcaaggatctggttcactacatgaatgagtttttaaaatttggagaaattcagaaatcaagaagtacatatataatgataggccaaaggatatcataatttagccacattcgtagttacttaaagacaccaaagaaatactgtaggagtttatgattttaatatcttttggaagatatatgcttaatgtgctttttaataggaaattttgaagcttttcctaaggttgaatataaaatattggttcaagaattatgattgtgcaatgcctaataaaaagaacattctgtgaaaaatgagtagatggtagaggaatgccacctagaagaactttgttagaaactagattagcaggtatctgactaggaccaaggatctcttccccaagtataaaggggccaagaaaattatctcaaagttctgaagattgacacaggcacatttagcccatttaggtcatgagtttgtaaagcttgtgtgtttgatgaagttcaacatttttagaaagctctagcagtttataaaagcaataaaacatttcacctttttaagcatctttgtaggaaaaaaaacttccatatactatcatgacaccgaccctctttgggatgacgttattgcattagtcgatcattatttctccttaaatataacccaggagataaagctgtgaagatagcatgttttataaaagctaaaagttattgtgaattcttctgaatcaataattgaaaagaaactgaagggaaaatttttatatagcagcagtttccaagttattacttttaggaaacttttatactttaaaaagttattgaggcccccaaacagctttactttatatgcattttataattaacattttttagtttagaaatgtttaaaatattaattcactaaaatactactagtctttacccaagaaaatcacaaagataattcacacaaaatttgtacacaaatgttcataatttttcataatagccaaaaaatggaaacaaaccaaaggcccatcagctgatcaatggataaatcaaatgcaatatatccatacaatggaattatttgcccataaaaatgaatgaagtactgatatttattacagtatggataaaccttgaaaacatcatgctaaaagaatacagacacaaaaggtaacatattgtatcattccatttacatgaaatgtccagaataggcaaatccatagaaacagaagtagattagttggtgccagggagtggggatagtggagaatggggattaactgtgtatgggtatagcgtttctttttgggatgttcaaaatatctagaattagatagtggtaatacttttgcaactttgtgaatatatttaaaactgctgaattgtatattttttactttatttttttaaaggtcatcttggcttcagatgaattctgtactttacaatggtgaattttatggtatgtgagttatatctcaattaaaaatataataagcagccaggcgcagtggcttatgcctgtaatcccagcactttgggaggacaaggcgggcggatcacaaggtcaggagttagagaccagcctgaccaaaatggtgaaaccctgtctctcctaaaaatacaaaaattagccgggcgcggtgatgtgtgcttgtaatcccagctactcaggaggctgaggcaggagaattgcttgaacccaggaggcggaggttgcagtgagctgagatcccaccacagcactccagccttggcgacagagcagactccctctcaaaaaaaaaaaaaaaaaagaaaagaaaaatataataagcacattatattttatcctaaattatatatttttatgaaaaacaaatgtgtattccaaagaaaaatattaatgagtagcattgctttacattttctacatacctttttgctgtttggcttcatgagaataattggattctatgtttgcttctacattcaatttattgtaatatattgttttggttgaattatataagaaattctcgccataggcacatatatagttagaaaagagaggagtatcgtaataaattattcagataattatagatatttttctttgatattgtgacaaaatttgttgtgtgatgattcttaaaggttagttgaatgtagaatttcaaatctccaaatagtgctgacttgactgcagttattcaaaggttagactgggctaggaagttgaagatgactgactcacgtggctggcagttggagttgactgtctgctggatggtcagtgttttccttggttatgacctctccatgtgacctgggcttcttacagcctgatgggtggattccaaaatgaaatgttccgtgagaaagtgagaaagttgaagctaagccatcaatgttttaaaggcttgtattcggccattcttggattgctttaaataccggagactgggtaatttaaaaataaaagaggtttaattggctcatggttctgtaggctttgtgggaagcgtggtgctggcactcaacttctagggaggcctcaagaagcttacaatcatggtggaaggcaaaggaggagcaggcgtatcacatggtgaaatggagcaagcaagagagagaagtgtgagggttgctacacacttttaaatgaccagatcacgtgagaactcacaatcacaaagacagcaccaggccatgagggatctgctcccatgttccaaacacttcccactaggccccacctctaacactgggcattacaattcaccatgagatttgggtggggacagatattcaatgtatattgaagcccagcctcagaaatcacagtgtcatgttccctacatcatactggacacaactgtagggtcagcccatatttgaggacagtagaaatagaccctgcttcttgatgggaagagtggcaaataatttgcagctagttccatgatacaaccttttctgacattttgaatgccataggcatgtgggagcttgggatatactatgattaagtattatttttatactattgcaacttctgctttgaaatgaacatcttaactggatgcttttgtttgaattatttaaaatttattgtcaaatgcaataaatttagtgcaatgagaactaagagtgcctcatggcttttgattacctgcccttccttttacatttgtgacattattgttcagtttttaaattatcgttgataattacttaagaacaatttttttcaatatggtataaaaaatggaatattaagtgtccactccaatatcagtctgttgttcttagaatgaacatctccacttcctgtcaatgtttattctccaagagtgccttggttttgcacttacaggttatctatcagcaatagttataagaagatatgctagagattaattcatgtatttacttaattacaatctcctttggaagaaattaaacccacaaaacatgaaataaaaatttgttttttaatgtggagacaaaagggagagcacacaatttttttttttatttttagtagagatggggtttcaccatgttggccaggctgctctcaaactcctgacctcaggtgatctgcctaccttggcataccaaagtgctgggattacaggaatgagccaccatgcccagccatacaaaagagaagaattttttaaaactggctacagtcttcaaattgcttttcctgtatcccaaacttaaagtgctgataaaatgccttttaagttttctgttagtttctccaggaaaggtggtatctgacataggcccaggttggaaatgcttacatgttattaagcatttatgtaatttgggaatttttatcattgtcaaagcatgctagaagcatcattctttcagctgcccttagaagttgcttctagaaatctgctttaaaattgccatgtgaaaggcttatttctgctgtataaaaaataaagctttctttccattgcaaaatggcagtgtctgtagattgttagtagaggtgttgggttggacatgactgctgttactgatcaggataggtaatgcactgtgctttcttaaaagagcaatattagaaaactgcagcttgattgacagctcagcatactgaaaatcttaatgctaaatttgtttaaaaatatttggtggaaagacattataaaacttaaaactcagggttcaaaatttctccagaatatttttgtctactctaagtatttgtagtaccaaagcataattggtcaccattgccatttgaaacagcaaattaccttagtgtggtataatggtgtccctctgaaaccctctggatattttagccacatctgaaaactcagcatgtggattttaaatattcttgagaggaagatagaattctgaggcataattttagctgaatttgtattggtaactaaactctcattaagatgggttgccagattagatctgagctagggtgtagctgccacacctttgtaccgtgtgtagcacaaagaggtgcagcccttgtgatcacagagtgttctaaattgcataatactttctaaaggcctgtagcaatctcagtgcatttcttaaattctatgagtgccccccatttactttgattttatgttggcctaactagatggtttgtttctctgtttagttttggttgctggtttattttggagagttcacacttcactgggaaagttttaagttttcttgtatagaaataacttggtaatgttacattattagacattattataacaaactcttgattatatggcatcagataagcttgtttatggattgattgtaaaaactctgaaaaatgtaaattcttagaagtcatcaaaaaataaacacattaaaataaatctgttatttggaactctatagtaaccaacaaagcccagattctctctattgcacagttggcacactctttccccctcagaaaggaaagaaaaaaatacaggtttagtatctcttatctggaatgcttggaaccagagtgtttcagatttgggattttttctgattttggaatatctggttatacataatgagatatcttggggatgagacccaagtctaaacacttaattcatctctattttatacatactttgtaaccataacttgaaggtaattttatacaatattttaaataattttgtgcatgaaacaatatattgaaccatcagaaagcaagggcgtcaggcatcgaattttccacttgtgatgtcatgttggtcacaacaaaaagtttcgaattttggagcatttcagatttttagatttttggattagggctgcttaacctgtatattggaaaggaaccctattcagttattttgtagtgttaacttttgagttaataagtctcctctattaggatgatttcttttaacttgatcataagcatgcctcttaaatggagagtaaaaaacaataaaaaaaactaaacttagaaaaaaaaaaaacttgaggacttttcttcctccctttttcctccatctccagtccctcactttatgggaaggttgtatcatggtttttgggtatggataactttattaacccaccattggtagaatatgcactggagtggtaatagattgtgttgagaccattaacaattatattttctcattcagtccctctcccacaactaccagtgatagttgttgatgtgattagtgacctctatggtcctgctacagttatgtatatctttgtacaaagctgactgtatactgggatggaactttgggatagtgactttgttattatcttgtcactgatgttagaaatagggacagactctgcagccaaaaaaaaaaaaaagtgaaacacaattctgtagaaatggaattttctacacaggaacactgttaggaggtttttcttatatgttcactagcattttgggagtcaattcattatttttgtagaacaggagcgtgaaccacagagggaagaaaaataaacccaattgattccaagaatttaaaaattactatcaacattataatagttttaaaaattgcatagctattctgatgtcttctagcaattaatgccaccaaacttatgggagaagtctttttttctctctcagaagtatgctgtttttagcatttctgtgctttagtttttcattagtttcaagtactttttcctctttataaagtatgctgttttacatgagcttttctataaaaataaacataagcaaaaactacaatgggtttttgttataatagctggctattctactcatattctctctaagattcttgagttgctttaagccaacaaccgaaatccattattagaatgttccccctgccaggtttttattactaatacattgtttatttttaatcatcttttgaattattgactattttatggtgtctcataatagcaatttctatttgttttatgtacttcatagagtagattttgtttttctgcctcactccattatatataatggcttagctttgaaatctttgcttgatatagaggatgttaatttgctttaacacattactatctaaaatagctcaggttttgtatggtcttgtaaaagctttatctcgaaatgctctgaaagatgctttattttttactctctatttaaaaaagaagtttaaatttcctcctgatattcttgtctcatgccaggatattaagcagatgctcagattggctcagctaggtgatattaaaatgtatagattcagatttcaaagcaattaataactttcactctgacattattcttccaatattttattcctactccatgacctaagtcttctaacggttgttttgctacttaatctctagctaattatttcttttctcctcatcctgactgcattgagtgataggtctgttttctgtaggcttgcctgcatttcttaactgaacccctagagtactgtgtcctatcctactctcttcaattcttccccaatgaggcatgaccaagagattgttgtatccttaagaggcaaattcttagaatggagtggcagatggatatataagaatcaccagtgcagtgataatggaaattcaacttcaattagattttaaagttggttgcctccaaaaagtctagaagtgaattgaatagagctatttgccctattaggattttgttccttgctaccaagttgtcaggggaggtgattacaaaattggaggaatccatgattaggaaatgatgatgatgatgatgatgatgatgatgatcatggtgatgatgatcattgcagcctacgtttatcaaaacttattatatatttggcactgagttaattaagccttttatgcactattttgagcatctgttggttgtgcttaatattaataaactagttttctattactatgtaataaattaccacaaacttaggggcttaatacaacccacattcattatcttagtttctgtgggtcagaagtctgggcacaactcagttgagtcttctgtttaggttcccacaaggctgcaatcaaggtttgagccagggctagattctcatttacaggctcaacttagaaaggatctgctttcttggtcttctggtttttggcagtattaagtttcttgtgattgttggactgagagctttattttttgttgactgctagccagaggctaccctcggctcttagagatcaccctcagttccttgacatgtggcattttccagcatggctgcttggttcctcccagccatccctgggagagagaaatattcctgaaggacagatgttacaatcttatataatgtaatcatgtacactgatcatcaacaatctatcatcttttccatattctattgcttagaaataagtcataggtcccacccctacttaagaggaaaggattatacaaggtgtgaccacagggaggtaggaatcaggggcattaccttagataaggtacaccctacaaggtagggtgtaccttgtacaccaccaagagattgctatttgtcttccaatatctttccttcttcttccccacctgagaaatagaactactaattcattattagttaaatatatggtcacctggaatacagagtttattccctagtttccctcgtagctaggtatggccattgtgagtaagtgtggcagaggagtaagataaaagagtctaggactctgaggattttgtgaagttactctatcagttttttgaagattctttactcctgacttctttcaggtgagagaaaaataaacttttattttgcttaagccattgttatttttggctgtcccttgtaggacacctcctttagaccctcctctgctggccagccccagaacagggtgtcttatcctggtcctgcccaagtgtgatcaccctgtgggacaggagctggtctcttcagcccagcctctccatgaggaaaagttcacttcttaacaccatgggaggtgaacccaatcttaactttgttcttttctgtcatctcttctcccctttcctcttttcaagagcccttcatttccattttgtagtgtgtgtgtttttcaaggaacttgaaatcaccccaggtccaggtttaaaccaaccaggacattctgttctctgactcagtggtgaaagcatgacatatgccagtctaatcagagtgaatcttaaaacatttactgagaaatcgtggcaatacttgtatgtagtgatagttctgagtaaccatattttccatgccagccgccaattctgtcctaaggagaaacagactttacctgacccttgagcctgttgcttgacagagatggctcatgggacatataaacaacccagctacttccttatattaaccaatatttagggggtagtctaggggaagcttccacaccagccctgaggttagaaatagcatgtaagggaggactcagagaattgctctgtctccttgactgcaacagtattagtcatggctgactcaggtagaactgggggactctattcagtacagatcttagagaccattgtgtgagtactaagatttggtgtccctgtgcttgtggattcatgcagatgtcacaggatattggaatgctaaagtgattcatcccgttcaagtaacagatccttcctaaattgtctatcagtctccacacctataatcttgaatttattattactttaaaaaattacaaaagtaacccttgctcactgtagtaaattgaacaatacaaaggtgtggcctctgtgtaaaacagatgcttgctttctcaggaagtcttctgcccttcagtgttcctttcacatactccttttagccttacattgataaaatgtttactttttaaaaactaacattgattcaatgcttctcatagtctgtttgtttgtttttgtttttgagacagagtcttgctgtgtcacccaggctgctggagtacagtggcatgatcgcagcttactgcagccttgttctcctgggctaaggtgaacctcccacctcagcctcccaggttgctgggactataggcgcatgccactatgcctggctaatttctgcatttttggtagagacagggtctcactatgttgcccagtctggtcttgaactcctgggctcaagtgatctaccagccttgcctcccaaagtggtgggattacaggtgtgtgccaccatgcctgactctgcttttcctgttcaatatttcaatgattacagggttttaaaatatttttgacctaaacaaataataatttattaattccaaaatagataaagttgtcagcattctggagataaaatcaaagtaaggattcactagtttttccccagtaggaacttaacagttaagttagggcatgaaacgtttaaataagtcaaacagtgagggagaaggtgctaatcatgcactaaagaaagtgaaaaggaaagtgcatctgtttttggtttggcagttaccaccacagctgttttctagtgctgtatgtataaaaagagaaggcaatgatttggaatggtcattacctgggtaacaaaataatctgtacaccaaacccctgtgacgtgcagtttacctatacagcaaatctgcacatatacttctcaacctaaaatgaaagttaaaaaaattaaaagatagatacatagtataaaaaagaagtttcttaaaggagagatgggactgaagttgggtcttacaccaaacaagggaggacagagagaattggggctgctttaagaatcttggcccaaaacagagcagctgtcctcagacctacctgagcacccaggccacagccaacctcagatcaaaagggatggaatctcaggagactgaccaaggtagctgtatttttttttttttttttttgagatggagttttgcttttgctgcccaggctggagtgcaatggcacaatttcggctcaccacaacctctgcctcctgggttcaggcaattctcctgcctcagcctcccaagtaactgggattagaggcatgtgccaccacacctggctaattttgtatttttagtatacacagggtttctccatgttggtcagcctggtctcgaactcccgacctcagttgatccacccgcctcagcctcccagagtgctgggattacaggcgtgagccactgcgcccagctggtagctgtatttttaacatgctctttagataatttcgtctgaagactggcatttaggagtttctaaagcaggtgtgtcttgttattaaataagcacagctgcttgaaaattagtttgggaacataatttatgactaaaagtctttccaaaaaatcaaacaaatggtcatgttcatattagttgatatatttgttattccttaaagacatggttttgtacatgagttgctattctcttaattcttaagattctgtggaatcatttatttgtacaagttgtaccaaaaaggaaaacaagagtccacagaaataacttttttatcattgattgattcattctccatttatttgtttattcctctgacaaatattagataagactagagtcaaaaaggatagaaattagaacaggacattcatccagtcctagggaattttagtagagattatgtgaattaaacacaaattaatgtaaggaaaagtgccagagaagggagggattacttttagctgtgggaatttgagaatccttttagaaacattttgagcttgagatttggacataaatgtgtgtaaaatttgagtatttggacacaggtaaaagatgttccagacagaagatacagtgttaacaaaagcctctgcatgggaaatccgtggcttcccaatagaggaggttgtgctctttgttttgccttaagtgcaagatgtgtggtgaatgagagtgatatgagtttgcaaatttgataagtattatgtatttgccataaaaaagttgaaactgtggctcatgttttcatgatcaacaagttgaaaatcttgaagggcagaaagtagtagcagtagtgagctgccacctttatatgccttcacatttgtccacaccctgttaacattccacatgtaagtactgaaaaagtactgcactgactgtttctgcagaaagcaccacttaataccctgaataaagcttgtctctcatattttaggaatgtacttttaatgcttaagaattactttatttttctccttacctattacgtatcttaggttggattccctagaaatagaccctaaaatggcaatttttaggcaagtggttcactaaaggagtgctctcaagagagtcctgtaagacagtgaggaaagcagaatagcacagggaggaaagctaagcaaaggtgtagttttccctgaagtctagccttcatctgattccaatgggagctgtgaagcacgaatagcatctcagaattgtaggacctacaggcatcttgtattcttcccttttatcactcattcattgcctaaagctatccctggagggagggcataacctcccaacttttcccagaaaggcaactgaagacaattctctgtagaagggtacagctcttactagccaacactcatacagctagaagatgaagcactacaggtaaagggcagtggttctcacctgggggtaattttgtccttgggagacacttaccaatgtctgaagatatttttaattaatgtgactcggggttgggtggaggtggtgttgccactggcagctagtgggtagaggccaaggatgctgctgaacatatgcagaagaacttttctacaacaaagaattatgcagtccaattgtcagtagtgctaaggttgagaaaccctgggtaaagggagtctgagtaggacatcaacagtgactgctgcacctttctttttatgtatgccctgggctatatttgtaaactgcagtagcaggagccattcttaagtattgaccagatcaggtgaaaaaaactaaaagctcattcattcattcatgctttttgttttgttttgttttgagatggagtctcactcttgtcgcccaggctggagtgcagaggtgtgatctcggctcactgcaacctccgcctcccaggttcaaacgattctcctgccttagcctcttgagtagctgggattacaggtgcctgccaccacgcccagctaatttttgtacttttagtagagatggggttttgccatgttagtgaggctggtcttgaactcctgacctcaggtgatccgcctgccttggcctcccaaagtgctgggattacaggcatgagccacagcgcctggcctcattcatgcatttattcaggagatgtttcattaggtaattaaagaacacctgctatgtgccaggcactaggctaagcagtggggatacagagagatagtatccgctcttgggaagctcagaaaattaagaactaagagacatcataacccagtgactttgtcaagtttaaaagagagaatatatattaacacaatttgtacaaacttaaacataaatattcaatcatttacccaacaaatattattgagcacctactagataccatatgctattctaggcactggagatatagcagtgaacaatagggaaaaagtctttgccatcaagtagtatataatccaatgggagaaacagctaacaaacactcaaataaatatgtaataacaatttagataaagataagtgctttgaagaactcagaagaaaaaagtagaatagagagtgaattgaggcaggggctgtgggtgccttatattagtaagaatgatcagaaaaagcctctttaaagagatgacagttcaggtgagaccttaatgacgagaaggagttagccatgtgaagatctgggggaaaaagatctatttcaagaagatgcttggcttcatggagaaaccaaaactgttgctagatgtgcgggctggggagtggtaaggtgtgagttcagagaggtgagcagggactgcatcgtggaagcccactagaccactgtaaagagtgtggactttattcttattgcagtgggaagccattggaggtttttaaggcagcattttggcagatgtgtgatagtccagcaaagagatccaatggaggaaaatgatcaccaagaaggacattatgtgcttgccagctgagtctttgacccttcccaaagtgcattatagagtgtctttccattttatttcataactcactttcctaggtaaaatatctgccattggaagagtatgaaaatatagacataaatttaacattacaccttttccagcagcattgcattatttcaaaaatggtgaatgaatattaggtttgagttttaaagggcagtgaatcatttgttatgcccaagtcccaaatcgggacacatcactagaaagaggaagcccatcagattaatgaggaaagttagatattaggtacctaaactgtatttggtgtagtgtttcaaccaaaccaaatcacttttaacctttttatgtatgtaagtcctcattttgacagatgtagcagcataggctgaacaattattgaataatgtatttctagttagtttgggtgtatgcatgtgtgtgtgttcatgcatgtgtgtgtgttcatgcatgtgtgtatagcacagtgactagaggattgaatttctgttaggggataaataaaaagcctactagatgaatagtttgtagaatgatttttgagagctgcttggaacccagagtttacagcctaattacaatcttctgacagacctttagtgagcagtaatcatgaggataggcttgacttgagtttgaatggtactgttgtttattctgctgttcacagagagcagcatataaaatggattattttgtgtgttagtattcttttatgtgttagtagctaatgacatttttgatacattaataggaagcttgccagaagcccaaaggagcttgaatattttgtaggcaagtaatttatttaaaaattagctacggcataacgtgtatatcatagaagcaaacaacattattccactagtaaagagtaggcattgagatgctcttttgatagaatccttttttaagaagtattttcagagctcataaattataaatttggcaaatatggagctcttttaagttgatttttaaagtgaaccatatgtttagcaggatttctaattgctgtaaatgtccattgatgaataaaaatgagtaagcaagttttcttttttaccatacctggcaattttattaatgtcttacctaactgtaaactcaatagtagctgtttctgacacagaagtgtcagaaacactacttctgtgtcagaaacagccagtcagtggcttcccactgactcatcatccaacttagtaattatcaattcatggccaatgtatatacccatgcaatttcacccttaactatatttttgaagcaaatcccagaaattatatcacttagttcataaattaatagaacctctaaaagataagaattgggtttgtgtgtgcacgtgtgtgtttttactatcacaataccatttaaattcagcttggaaacactctttattactcttggggaagttaggaaaacgacttgtacttctttccatgaaggtttaactgctgccagaatttctttcctgtaataaaaaactagaaaatcaaacacaaaatatgtaacaactgttttcagatagcagacaacaggcaatgtaggactgtgagacctgagaggagggaaatcaataaggccggcccaacaattgtcccagcttcctctctgaggctgatttcaggccaaggggcaggaaggagaactgaaacagagcccagccaactcactgaattgaggaggcggagactggagttaggggaaacccactgggatttgcaagacagaatatcattaggaggggactgtgtgggggggctggggggagtggtaatacctggtgctaccattctgtaccttgctctttttaacttaacaatgtatttatttattatttaaatgttatttgtagagtttccaatatgtgcccaccctgttctagatgttgtggatgcagcctgccttctgatgtattgtcatctcacaagcagtagttccagatttcagtccaactaggaagacactgtgcgactgagtctagcactaagtttactctatagaggataaaacttttattgcacatgttactgtctcctagaacattagctttcaatattcaagaattgtagaaactcattaggtatgctgagctctggtcccaagtcagaacagaattttgaggtactattcttggcctgtcaattactcaggctgattctacttgcacatcaatagagtagtttcataatctactgtgattcaatctgttggaatcgtctatctatatggaaacctagctagaaggacatgtaaataaccatgcattttctcatcataaagccaggaccatgcttattgtagtttcagttgcagaactattttgcagccatgcccatagactatgagtcagtttgaacaaattatcatatttataagcttgctataattaatacttaggatacaatgaccttgggaaaattcgatatcatctgctacatgtgaagatatgaatatctaaagattcagcaattctatccctagatgtgtacccaacatatttatatgtgtgcatgtgcatttagagacatgtacaagaagttcatggctgcattattcataatagctcaaaacttaaaactacccaagtgtccatcagcaacaaatacataaatatattttggtaaatcatgtaatggaacagtacacagcagtgaaaatgaagaaactacgtgtatacataacttatgtgaatcacacaaatgtaatgtttgcgtgaaagaagccacacatgaaaatatgcatggtgggtgattccatttgagtaaagttcaaatacaggcaacattaaagtatagcttgaagagatgcaaatttaggtaaactattaagcaaagcaagtaaataattaccgtaaaaatggggattggaattacttttggtcaaagattgtaattacaaagcagtgtgtgctgcacttccgggagtgcttgcagtgttctttgccttcacctgggtggtggtgtaaaagtattcattctaaaataattgatagttttatatacctatacacatatttcattttattgtccttcactttattatacttcacagttactatacttgttgcaaattcaaggctgatggcaaccctgcatcaagtaagtctattggtgccattttctgaacagtatgtctttccttgtgtctttctgtcacattttggtaattctcacaatatttcaaactttttcattattattatatctcttatggtgatctgtggttagtgatctttaatgttactattgtaactgttacaaattgccgtgaactgagcacatataagatggcaaacttaatcaataaatgtgtgtgtttcttcttactgctccactgactggctgtttccccatctctgtccctttcctctggcttccctcttccctgagacacaacaatattaaaattaggccaattaataaccctgcaatggcctctagatgttcaaataaaaggaagagtcctatgtctctcacttaaaatcaaaagctagacatgattaaccttagtgagaaagccatgtcaaaagccaagataggccgaaagtgaggcctcttgtgccatacagttagccaagttgggaatgcaaaagaaaatttcttgaaggaaattaaatgtgctactccagtgaacacatgaatgataagaaaggaaaacagctttactgctaatgtggagaaagtttgagtggtctggaaagaagaccactagccacaacattcccttaagctgaagcctaatacagcataaagctacaactcttcagttctagaaaggcagagagaggtgaggaagttgcagaagaaaagttggaagctagcagaggttggttcctgaggtttatggaaagaagccatttccataacataaaagcacaaggtaaagcagccagtgtcgttgtagaaactgctgcaagttatcaagaagatctagctaagaccactgatgaaggccactaacactaaacaacaggttttcagtgaagatgagctagccttctattggaagaagctgccatctaggactttcatagagaggggaagtcaatgcctgccttcaaagcttcaaaggacaggctgactttcttgttaggggctaatgcagtgggtagctttcagtttaagtcagtgctcatttaccattctgaatatcctagtgctaataagaattatgcttactctacccttcctgtgctctgtaaatggaagaatgaagcctggatgatagcacatctgtttacagcaggttttctgcatattttaagtcctctattgagacctactcctgagaaagaaagattattttcaaaatattactgctcattgacaatgcacctagtcacccaagaactttgatggagatgtgcgagaagattaatgctgttttcacacctgctaatacaacatccattctgcagtctatgtatcaaggagtaatttctagtcttcgtatataagaagtgcatttttctggctgggtgtggtggctcacgcctgtaatcccagcactttgggaggctgaggcggctggatcacctgaggtcaggagttcgagaccagcctggccaacatggtgaaactccatctctactaaaaatacaaaaattagctggatgtggtggtgggtgtctgtaatcctagctactcaggaggctgaggcaggagaatcacttgaacccgggaggcggaggttgcagtgacccaagattgcgccattgcactccagcctgggtgacaagagcaaaactccacctcaaaaaaaaaaaaaaagaagtgaatttttcttaagactactgctgccatagatagtgtttcctctgatggatctgagcaaagtcaattgaaaactttgtagagaaaggagtcaccattctagataagaacatttgtgactcatgggaggaggtctgagtatcaacatgaacaggaatttggaagacattaattccaacccttatggatgactttgaagagctcaagatttcaggggagaaagtcactgaagatatggtggaaatagcaggagaactagaactagaagtgtatcctgaagatgtgactgaattgctgtaatattatgataaaacgtacatggatgaagagttgctccttatggataagcaaagaaagtggtttcttgagatagaatctactcctggtgaagatgctgtgaacattgttgaaataacaataaagtatttaaaatattatataaacttagttgataaaacagtcgcagggtttgagaggactctagttttgaaagaagttttacagtgggtgaaatgctatcaaacagcatcacatactacagagataccttctgtgaaaggaggagtcaattaatacagacaatttcattgttgtcttattttaagaaattgccacagccaccccagcctgaaattgatgcaagaccctccacctgcaataagattatgagttgccgaagtctcagacatttattggcatttttagcaataaagtattttttaattgagatatatacatattttaaagatataaggcatattgcatgcctaatatacctcaatgtagtataaacgttaacttttatatgtactgggaaaccagaaacgtgacccactttattggcatattctctttatgggtgaggagttgcttcttatggatgagcaaaaaagggtagtttcttgagatagaatctactctttgtgaagatgctgtgaacattgttgaaataacaacaaaatatttagaatattatatacacttagttgataaagcagtggtagggtttgagaggacttttggtggtctagaaccgaacctgcaatgtctctgaggtatgcctgtacatgggaattattttttaaataaaacttaaaaacaaaccctgaccataactacttaacctgggaattttctgaatattaatatttgcaaagtacctttcagtgtagaagggataagattacttgtggaatcctctgaacagaaagaagaggcatctgacccaagatttaatttcttacatagtgaaggacttccttttgatatatacagagaaagaccagttaattgagattctcgtattctaaatttcacattttttttctgtgttagactcctgtatttattccaagaagctcgatagaataatttaggattgtaatgtcacatgcaggtgcaatgtgacatttctgagtcatgccttggagctgacagtacaacttttccccacccccatccatagctttttacctgtttctaaggttttctaaatcataaagatgaggctactgatagtttgagtgaggcttatcaaatcctgtagcttattacatggaagagatggatttcacctagaagtaaaactttcgtttactgataatgataacagctaatgtctgttacaacatcgctacctcagagattttattatgtatcacacattcttttatgtgcatacttgcattagctcatgtgaatctcacaactattcacaagtattatttccattttagtagtgaggaaactgagacccagaggagtgccttgaaaatagatgtgtttgactccaaagcccatgctctttattgctgggatactttataatgctttcgtttagttcagggtcgcaaaagaaacaaagctcttgggtttttgttgttgttgttgttgtcgttaatggtacatttatttcaagtggaaactttagaaaattgacaagcttttcactcatgtctcactgatgtcttccatgtgcctttgagtcttccttggccagtcacttatgtttttaagtaggattcagaatcagaggtggtcacaccacctacctcaaaggctgattcagcttcggactacatttttggactaatgtttaagactcagctgggccaggctcagagtccatcctgtgttttccacatctgatttcttacatagtgaaggacttgcttttgatatatacctagaagcagccattgaataaaagaccttggatgtaatgcaagagaatggggcaagcagaggaaatagttgaaagtttgtagtgagccatcattgtcacattagacctttgtttaaaaaatgtatccattgttaatatttctacttttacctaaagttaggtgacagttataaggaaaagctgtggccgtcttaataatagctaagatatattgagcacttagtatgttccaagaactgttacaagactttttacctattaatgtagttaacactcgccacgatcctatcaggtatgtattcttaattctcctcattttcagaaatggagttggaagcacagagcagttcctaatttacctgagatcacacacctagtaggtggtagacttaggagttactcaggaaggctaattctagaacccacacatttaaccactatgtcatgctgcctcttcttgagttgaagaaagatttgcatgtgaatatactttatatttttaaaaaaatgaaaggtgccatggcatctcaggtgggaaaaaataaagaaaaaataaaaaatgaaaggatatcaagtgttggtggcatattgaatcctttgatttatttcaacataaactatctgcactggtagaaagacatttatagtttggtcgccttataggttataaggcaataaacctcatactgtaagtttataagactgccaagcattttccaaactcctttcatgtctatgaaccactgaacaacaaagatcaagtatgaaaaaatgttcttttgaatttccctaaagcaagaacatactgaaatgaatggtgaatagttggttccttgtcattccttgatcaaataatgaccttcgtgtctattgattctcacttttcttttgaaaatagagtgtttttattctaccaatgatttaaactagaaaattattattgctgtccccttaaagcattacattttttttaactaaaatgtcttgatgttattgatttaacctgtttccctcttttgaaatagctgtgtagtcctcttaatgtatacaacatagatttctggaaagcaattcatatatacttataaaatatgaattctattttaattcagatcttttatgcataactactgtgaaatctgtaagttctcttgatttcctttctttggattaaatctttttcttataaaaatgtagaaaacaaattttacctttattaggatagatagaactatgtacagaaagtacagtatatagttttctgttgctatataattactacagaattactgtcttaaaacaacatgcatttattatctcaaagttctgtagatcagaagtgtagctggcttctctgctcagagtttcacaagactgaaatctagatatcatcatgctgggcttttatctggagtctctggagaaaaatctgcttccaggagcattcagattattggcagaattgagttccttgtggttgttggactgtactccctgttttcttgctgactgtcagcagagagccgcctttagcgtcatgcagccctctccatcttcaaaggcagcaatgacttattaaatcctttttaggcttggatattctctgacttcactttcactcacattcaaagggaggatgttataaaagagtgaaaatcattggaagtcattcttagaattctgcctaccacagagaggtagcaaagtatttatgagtttggtacttccttgagatttgatattgacaaagcctgaaataggcgacttgctttacatgagtgattttaatgtccttatacctattgatttttcaaagggagtacagcacttttaaatttattattattcttgcttatgttagaattcagacttggaagtgttttttttgttgttgttttttttttagacggagtttcactctgtcaccaggctgcagtgcagtggcgcgatcttggctcactgcaacctccgcctgccaggttcaaatgattctgtttcagcctcttgagtagctgggattacaggcgcgcgccaccatgcctggttaattttttgtatctttagtagagatggggtttcaccatgttggccaggctgctcttgaactcctaacctcatgacccacccgcctcggactccccaagtgctgggactacaggtgtgagccaccgtgcctggccggaagttatttttaaagtggtgaaagtataaaattattttgcattcactgaaagattgttaaacattcgtaaagaaggtggtcttctaaccctgattccaaagttccttcctctgatgtcagtggagaggtggagccacttactatggcttatatttatggtaaaggcagaacatgttgagaatgaactgaatttcacagagaacttatcttttcaattttcttgctttagggtcacatagctttgctatgcggcattttttcaatgaaactgaccaccagccatttcttataggaaatgcacaaggcctcaggcagcaagcaacagctgaggggatcagcggatcttttaatctgcctgacgctggccgtagagtccttgcaagcatccaccacgccccagagagcttgttttctgaggtggtagaagggccacatccacagtattcacatcccttagatcctctctctgggaagccacagtggtgataaatgtcgagaagagcagttattctcagggtatatgacctcacagccaccacagctcatctctgctttatttggctttcattcattgaagagacagattttgagcaggaagtacatcttgcaagtactgtctaattactgattaccctctttctgactccaccatgtgagaagcccttcagctgacccgtttcctttataactagtacttaatatgcatcagatttgtgcctttttaagttttatagtcttccagttctgcatagttccaaatatgtctctttagtgaatcaagcctccctgacaccactccctgtgtcttccaacccacagcccccaatgcatttaaaggtacattcagcagaacaaaatttcccaatagagtcatacagtggcttattcatagtgcacactgggggtcttctaatgaaggatagagggcacttgtgtcatggtatcttctatgattcttttgtgtcaaattcaacatctacattagtgcccccttgaaataccatgacctcttagctctacaagtctagtcttttatcatttaccagaatgaacacattttgagtgtctttattattctgtaccactttatttccatgataaagaaatgagaaccccttctttatgtctgagacctttccattctcttactacttacgaatgcaaactttcatgtcatcatacttttcaggtaagaaaatttccattatttctaatagaattgatgtctagattattttaatcatgactacctatccttggacactttatgtttatcagagctctctttcaaaggctcatctgaaccgaacataatattccaaacgtgttctgcccagcccagagcagtctagactgcttcctcccttgatgtgtggattatactttcccaggttcaggtagtatccattctgtcgccagaagacaagttaatgaatgtctaatgaagccaaccagtatttttaaaaagaagtctaagattgccttagaatatttagtagacatactgtgcctctggttcagactgaaattgtggttgactaaactcccccacgctcattttctttggtttgtttatttagatcattatacattgatgaattccacttctccacagctttcagctttaattccttcttgcttcaggttatatccaacagtttattatttcaaaagctctctgttagcctttttaagtactcttatctctgaactcctagtactgggtcaatccagccatctactccacacctaacctcaggctgctgagaactgctgttgaaaaatcacacaccttatttttgtctttgtcttttttatgtttttttttttttggtctgtataaaataagattgattacttttgctagtcagcaccatgatttaaaattttgatttaaacttgattagctgccccatattttcctcctagattgtaagcatgttccttgctctgggactttgcgcttgtgattacctctgtctaatgctcttccactagttgagtaattttcagtcttgactatatattagaatcaatggggactttaaaacagctctgatgctcggccccactccagaccaattaactcagaatttctgaagggtgggacccaggaattagttttgttttaaaagatccccaggtaatgctactgtgcactaaggttaaaagtcactaccctataaagatgcatgctttgccttctcactttaattggttttaagctcaaatgatcaccactttagggaggattttcctgtttatctaaaatatagacctctttcactttctattcccttctcctgccttatttttcttcacagaatgtatcatttatttaccaggtaagctattgttgcttattcatttcatgtgtttgccttcttctcacagaatataaccttcatgagtgcgtacatatatataataatatacacattatgtaatgtattatcaatggtgattagaaccaaaaacacaaaagagtggaagagactgacttggaacagtatatatagagagaagagggcctagaatagaaccccaaggaactaaaacattttgggagcccatgtggtggttactctatttcttgattggtttagttcactgccatagtccaccatctatagtagagcatggcatactattcaacaaagttgttgaaaggagttccccagtacttcaccattttcctcaacctcccaaataaattttctttttcactcttagaatatttttaaattgcagaaaaaaataaaaactgtctaatgaaaattctttaacattctagtccctttgaccaagcttataaagtgcccatgtatcttttttcgtatctcagaaaattgattctcctggtgtttgggggaaagattttgttacatattttttttttgttttgaattcctttattttggatcctgttccattctcttcatcttaagactttgatctattcactctctctcctttattggtgcctttcttcaacgtgagtctacttgtgtttctcccatttaaaactaacattctctcttctgtctctcttgctttctctctctccctgctaaatcctctcatttgtcttatctcttttcatttttaaacctctctatcctctcatttctacccctgatgcttcagcaaaagtgctctgaagtcaataatgatctatttttttccaaatccagtgggcactgttcattattcatctttcttgactttccctctattaagttgggaatgttgttaacttctccttttgaaaattctcttctttcttggtttctgtgatatccctctctcttaagtctgattctacctctaaggtacaatccttggtaagaaagtcatatgtgtcattattcaagttattgataaaaagcttgaaaaaattcaggcttgaggacaggttctgtgttgtgctgttagagacccacgtctaggttgttgctgatcaattttaggggtctgttattcagtctgctgaataacatgattatacagtctgtggatctccatctagtcctggaggatataattaaaaattgttaaatgttttaatgaaattatgataaaatataaatcatacaggattatacctcacagtaacacaaattttaacataaggcaattggcaattgatatttagggggtcttcaagccagcacctcattctcaaacaaggataagctaaaattcctatcttctagggagaggacaagttgtagagggtagcaaaacatcagacagctaggatcttaaaaatagagaggctgagagcaaacaagatcctaatattttctcttttcagtgtccccagattggttgacaaagcaaagatcaattgtatatgaggccattaaattactgcagctatcccaggagtgccagttagccatgacccagcattgtcttcttgtttaattaagctagaggagcaaatgccactatttgataccaaaccatagttggacttgagttgggtgttgattgctgcagctagaacataggtattctatacgcctcaaagtgtgaaccgtggactaaatgtaaacacacacacacacacacacacacacacacacacaattgactgttgagaagaaaaatgaattttattagtcagagagggaggtaaagtacaagtataaaagttatggatgacttactgataattgcttaccataaatttgaaaacttcagcataatctgagaatgagatggcctccatattaatttaataaagttgacattaaacttgaaatattaattcaaaaccaaaagggacctttgtatgtgtggttctgaattttggttggggaatagaaaaggaatctgaatgttgacctaaactcataacatggataggtgagagacagtcacttctttacctttcattttttcttcactatggatttgataaagaacttttgaaattttttttactacattggaggatgttatggacttcattcactttttcttcaagtaaaattttggtaaatattcagttttttaaattggtttgagaaactattgctttggggcaaagtctaaaataacaattgtagatctccttttagagctatgaaatttgaggttaataagttaatgtttcagaggatcataaaacagtaagctgagaagaaaactaagattttccaactttcagaagacactccatttagtaagccctatgttgtcagatgttgcctgtatttctgagtgagaaagaacttttaatattaccaacggtctttgaaatcttttggaaaaaaaagcagacaaattttttctaatttagctttattttgtaattcattttggtaaattattatttgcctccttttctagatttttcttttctagcatttgaattataatctcagaggatgtccttgatagtggaagtatggggttatttgtcatgtcagttgataattactttggatgatcttactgaaagctaaagttgattgtgttcatctgcaaagcaaacaattttgacaattaaggcataaaaattgtgagtgttacatatagctgttccaactataatgtgttgattagagctgtttcatgaatctttctcaggaacagtctgagtgctatatactgcttagaaagaaaatacagagtcagtgtatttgctctcacaatgtgctgattgcggcagcttgcccagagctaaactggctgtaataaaaacttctggattggaacataatgatggcatttatgttatttgcctcctgcactttataaacccaagcaaacagctctcagtttgagaacctcagaaagatctgtcattaggtatggctgagtttccttatgtcgattctttgaagaatatgtcagctgaagtcttgcagtgagcagtagaatatgaatcttacgtagctgaaggtgctagattaaaacagcttccatcttctgactttgtccagatcattttattgaactcagtttgatagatgcctttctgtgagggtgttattatttttaaagactcatagtgagttcctggacctttggatgcatattgccccctaaaatagcatgaaatcaggcaaactggacttattattagcatggtacttaagaaaatttgaaaacagttcaaaggaaaatgactgaacccatcttatacatgcagtatgttttaacaaatcaattgtggattagctctaggaagtggccgtgtttgtgtacatggaaggccacctagatctctgccacatattacagtgtctgttcacaaaattgtccctttttgaattcatagaaccatcactgggaatagcagtgcctctgagtgcctactaaggaacagttgtggagataggccaaagctaaagagagaataggaaagaaaaaataaagatggagggagtgggcaactggagatggaaagggtaaaggatgagtagcagtggttatgtcctgtctcttaataacaatctaatggaagagttggctttcctcttgctgagaaaggatatgcatttttcatatgcatatgccacccttcactgggtttcctgtgtatctttggatcatataccagattaacaggagttcttcattagtaccagtgaagctgttattatcatcacttagccttgctgctgtggacaatccttttgaagatctacatttggaaatggcacgtggaatttcagctcttttataatttatttcttacattattttttaatgaataaaatgaggattacccaagaccgagggacagtatgattcaacctcttcaaggaaaaagtttttaaatggccttactataatattcgaataacttagacccttcacgtaatttccttaaatggaggaatttagtccctagttatgaaaagaatacagtactttctttctagaagactgggaaagtcagaaaagtaaaaagaaaaaagtgcacctataatctcaccactcagaagtaaccagtcaggattagatataatagtcctaaagtgcctttgtattttctaaattcttggggcagtggataactgaaaaacctgaagttttgtgcctgttccctcgggtgatattctaagtaatacctgttatatgttttagtttaactcatgtgtctatggacagtaatatttgaatagctataatgactatgtttaagtctattttattccaaattcacgcatttagccagaaattctctgaccaggagaatagagagaattgcctaatgatttctctattttacctaatgatttcactgtattaactcgtatcttaaacagtaataactatacaaataaacaaaaaaatggacagatacataacttcttgaccacgttggctaatgaaattaataatgaactatgttgaaaactgtaaacatttgctatgctatagtttacaagtgttctccatttagtagaatatcagtgctatttttatgttattgtgctagtatttcctacacaattgttttgcgtgtgtttctactagcatatagattccagactcttcagttttagaagtttcagcatgtatggggtacgtgtgtggtgtgagcatgggggcttgctggaaaggaagttatttcctcttatcttttcttgaaaaaattcagatccatgcttgtgctaattttactcaaactataatttgtttctaaaaactaatgttcagaaggatcaaggaaaagtaatgattataccctttaatttttgtagttaatttatttgaatgttctaaaattgttagcatttttagcccgttaacaatgacagcagtgttgtaaataactgtaacagagctcttgaagaaccagacctcttgattaacaggacccttgatcctacacttaatgaactcctcaggataaaaggtaccataaaattacagtcatgtgctgcataaggacattttgaccaatgatggactacatatacaatcatggtcccataagattataatggagctgaaaaattcctatggccgtcataaggtcatagtgcaacgcagtactcgcgtatttgtggtgatgctggtgtaaacaaacctaccatgctgccaggtgtataaaagtatagcacatacagttatgtacagtacatcatccttgataagaaaaaatgactatcttactagtttatgtatttactatacttttttttatttatttatttttaagttaactgtaaaacagcctcaggcaggtccttcaggaggtattccagaagaaggcattgttgtcataggagatgacagcttcatgcatgttatttagtgggacaggatgtggaggtggaagaaaatgatattggtgatcctgatcctttttaggcctaggctaagatgtttctttgtgacttagtctttaagaaaaaagtttaaaaagtaaaagaaatgagttaatttttttttaaatagaaaaaaacttatagactaaaggtaggaagaaaggaaatatttttgtgccgctgtacaacgcgtttgtgtttaagctaagtgttagtataaaagtcaaaatgttgaaaaaatttaaaagtttataaaatgaaacagttacagtgagctaaggttaatttattattgaagaaagaaaaatatttttaaaatacgtttagtgtagcttaagtgtacagtgtttatacagtctacagttatgtttagtaatgttctaggccttcacattcactcaccacttactgactcacccagagcaacttccagtcctccaagctccatttgtggtaagtgcccgatacaggtgtaccatttaaaaaatcctttatgtcatatttttaatgtaccttttctatgtttagttatgtttagacacacaaataccactgtgttacaattgcttacagtattcagtatagtaacatgcggtacaggtttgcagcctaggagaagtagggtataccatatcctaggtgtgtagtaggctatactatctaggcttgtgtaagtgcactctctggtgtttacacaacaatgaaatggcctagcaatgcattttttgaacatatcctgtggttaagtgacacataactgtatgcatatctttttttgtttgtttttgagactgagttcactccgtcacccaggctggagtgcagtggcgtgatcttggctgactgcaacctctgcctcctgggttcaattgattctcatgcctcagcctcccaagtagctgggattacagatgcccgccaccatgcctgcctaatttttgtatttttagtagagacggggtttcaccatgttggccagactggtgttgaactcctgacctcaaatgatccaccccccatggcctccctaagtgctgggattacaggcgtgagccaccgcacccggcctgtatgcatatctttgttgaggacgttcttcctttctgtttaccactgttaccacccaaattatttcaatttttaagagtaggtttcttttccaattaacctttgtacactgttttgtgaattatactataaaatatgctcaaattgccctcaatcaatatttggtactgataaataataaaatattttctgagtaacaagtcattttcaaaattctcattttcattacataatatttataatacaataattctcttaggtggatgtgactgctagatattcttctccggttctgtgtttgggcacagcttcaactgactcagggattcttagcctgcctagccataagactcccctggaaactgattatgcatacagattccaggcctcacccctccaccccagacctgctcagttacaatctctgggtgacttgtatcatcagacaagtctgagaaacttgaaactagtgaggctgcactgggaatttgatcaatgcgtaattgcatgttggtgtataggaaagatttatggatgtggattgaattgatagtgttcatttacttttatcactagtcaaacatcataagagaaaactgctctcctactttctttaaattttagcttctatgagacttcagttgaggtaatataaaaattattttttgagcactaccatgtacaaagcactattctaatgtttttcatgtatctattactattaatatagagagacgaaataatttgcccagagccaaataagtaacatatgggaaaacttggacttgaacctgagaaatcagatttcagaatctacacaattaacccctgcaatatattgcctatagccaccaaatctaagtatgtattaatgtgtcaggcactactatattaagtacttcatatacttttagtacttttaattcatttaccaattctataaagtgggattacgaaaggcaaattcagagatattaagtattttgcccagagttgccctgctagtaagtggtagaagcagtgtggtttgaaattggggtagctcaactccagaactcttttcacaaccactatcctgtacgccagagtggcatgtttgaaaacactcatacttgtcatcccttcagtattttatataaatagtattagcacctgagtggttttctgtaagctaattatataacacttcattgtctacatttaaaaatgtctacatttaacatctacgttaagacactttggtgtgtacattaaatttttaaagagattctacagtatattatagaattctgtctctgagaaagatttgaatataatatattggtcactctgttatctgtcataggctggctgaaggagagataaggattaacatactttcaaggaattcttaaccctctagtttttatcattaaaggatagtatagttggtgaatacttgcgtattttgtgaacatttggtaagcagttgcacttaatttccttcacttgaacattaaatattccacatttgttctgtcccaagtaagctattctcctttactttgaaatgacttataaatttactttcacacaattattaaagatttactgtaaactgctgctttccccctccttttttttttttttttgtcccaaaatgaaggtgaagtgttaattggttttaatggcatctatggttacctctttgtctgggacttctaaggaaaagcgaagaattggcagaaaaatgtgtgaaatttgtctggggaggtgagaaactttaatgtgcttgtgaattagtgcacttcttctaggtaagactattgcagcataataaatattgaaacggaattctcactcttagacctaatcctttaagtatattagtagacatcatagaagaattttctgaagaaatatgttaactaagtttctgtagctggaaaagatcagcccttgatagactatgaaataagaatgtcttgtgtaaacatacatggacaaccagtgaatagactgtctctctcaagaacaaaggcatgctaatttggattcagaactagaaagaaggagcctggattttgcaacatgctgttatagttaaatacaagactatagttgcctgagacatgtacctggctgttaacactttttcccaataaaagtgattctaataccaagagtggctaattcatctgaaacactgttcctggtgcttatacactgatacattttagtaactctgtgcctttgatttaataggtaaccatctagataagtgttcttatttaacaaaaaaatgtactgggattctggaaagctcaaagaagacttctttaccattttaacagctttaagataactaatcttttttaaaaaattattattccttctgcattttagcagttgacatttccacttgtacctttaccagaaggcagcagagtaatgtaatgagcccagttctgtgttgggggagagagagaaaaatatggctttgttagcatttgcttctgtaaaatcaattcagagtacagtgggacaatagaaatgcaaacaaagtctgttgatttgtttctacacttccctctttttgtcattccatattgaagtgtcggttgtattataagataccaagaaaatgtttttttatcatcaaagacaaaaacaaaattttttggccgtgggcggtggctcacgcctgtaatcccaacactttgggaggccgaggtgggtggatcacctgaggttgggagtgaaagaccagcctgaccaacatggagaaaccccatctctactaaaaatacaaaaatagctgggcaaggtggtgcatgcctgtaatcccagctacttgggaggctgaggcaggagaattgcttgaacctgggaggcggaggttggggtgagctgaggtcacgccattgcactcctgcctgggcaacaagagtgagacttcgtctctaaataaataaataaataaataaataaataaataaaattttttaggcactttgagccattaacccatacccgtgagttaagtcctctacttgaaatacataattttttccacacaattagacaggcattattactaccttattttacagaaggtgaaactgaggcttagaaaagttgaccaaggccatatcccaaataagcagcaaaaactggaaagcaaacctaggtctgtctaattcaaagataatgctcttagtcattatctcaaatatgaattgtatatataatttaatagtgttctggtgtattttgttttatgtacttggagtcagcatgtcacaataaagagcaagatagaaaaggcaggagatctggagtcaagacacttggatttggaatcaacttgtttgttggaattctaattctaccacttatactgtgttatattgggcaagttgctttaactgtttgaactttggtttcttttgtgaactgggaagtaagggagataatggatatgaaatgcttaataaatggtctatgctaatactctacatttgcagagtggcttacggtttacaaagagctttcaccaagattgtctcaggtaatacttagtgatataagtgtttgaagttcattcattcttttattcattcatccaacaaatattttataagtgtccactaggtttcaagcattgttttacaagttggaaagatttagcagtgaaactacagggaaaaaaagactcttgttttcatggagtttgcattttaatgaggcatatagataataacacataagcaaaatattaaatatattagataataacaaaggtagcatttaactcttatatggtaagcactatgagctagtagttagcttaatagctagaagcatattgtgattcatagattagctacatgattttccattatagacaaacaaaacctgtaaagtacttacagttcaactacaaacttaaaaaattgtattgttttaaaacaattaggggatttaaaacaattaaatgttggtacacatcaccaaaattggtgaaatatcttctagctttaacattctatgatatattggctaaaagcatggagtaaatatgtacctcttatacctgtctgtctttatgtaggtctggcaagtgtactctgaatataacataacaataattcacagatttttttaaagattattgaaaaacacaaaataatcttggcatttgttaactttgtaagctagtcagtattctcttgagttgtatgtctcaacttcagcgcaaagctaggaaaaagcttcagtgatctgaaacttccattctcttgtactatggctcttaagaagatgcaatgggatcatgagcagatcttgtagggaacccagacattaaggttatttctgtctaccctgagtttaaattcactgaaagctacaagaaagacaagtgttacttttagggtagttgacagccattgactattgatgactccaagtcatcattcagcatcatggggcagaggtctgtaagtattggaagaaaaagtcacatctccccattaaacgttttgagatttaatcctgaaaatgctttctagttatctcagtaaaaggaaataatctttttttcttgactcaaacattaaaaaatttactgatgaagtatttctggtcagtgtttaagacaagcttgtccaactcatagcccatgggccacaggcagcccaggatggctttgaatgtggcccaacacagatttgtaaacttttttaaaacatgagttttttttgtgatttattttttatttttagctcatcagctatcattagtgttagtgtattttatatgtggctcaagacaattctccttcttccaatgtggtccaggaaagccaaaagattgaacacccctgatgaagaagttaagagcccaagcttcagtaacagaattcttgttctactacttactatttaagaagaaatccattatagcttcaaaatattttgagcatctttccacctctctactcaccaccactattctgttccacacagtgtttctccatacagtagctagagtgaccttattacaattgaaatctgacagtctgatccccacaccttctcctcctcttttacttacttctcctgctctccaccccctatcttccccttattcctccctgccctcttaaaaactgcccgttttctttcttttatgctagaatgaagttcagactccttattcaggcctaccttgctgatctcacctacgtcttgatcactgagtgtaagtcacctgaattcttctaatccttaaacacattaagctgatttcctatttgcaactttaacacagcctgtttcctgtgctcagaacactgttcattttactctttacatggctgactctttatctctcgggtcttaggctttctcttaccacccaatctaagtaggttctcttgttatgctcactcatagcaccatgtttttctctttcatggtacctatcatagtttttcactttatattcctttgagttttgtttaatatctggattcctgggtgggcacggtgactaatgcctgtaatcccagcactttgggaggccaaggcgggtggatcacgaggtcaagagatcaagaccatcctggccaacatggtgaaacccctctactaaaaacacaaaaaattagctgggggtggtggcatgcacctgtagtcccagctacttgggagtctgaggcaggagaatcgcttgaacctgggaggtggaggttgcagtgagtgagccaagattgcgccactgcactccagcctgatgatagagtgagactgtctcaaaaaaaaaaaaaaaaaaaatctggattcctgtcctcccccaaccataatcttcatgtctttttggtctactgctgtacacccaactccagccacagtcattgaacagatactcagtacatcattgttaaggttgaatggataacaaatctctatgacctttcgaagtcttaatttgcttttctgaaaaatagggataataattcctatctctaaagttattgtgtgaattaaatgagattaaaagatctaaaatacttaatgctgggcttgacaaagtcttcaacaaatggtagggtctgtagcagcaacaacgtaatcagcaggcacttattaagcccactgtatgtgtaagacgtcactaatatttatagaacatattttagaaagagaaactttttttagacttttgtttaatctagccttttctgggtatattcattaacattgatccccatattaaggaaattaaaatgcgagtttccagcagtgattccatgctttttaatggaacattgatatgaactagcctcagttttatgttgtcacaattatcagagcccccaacatacattcaacagggtattactttgtgtagtaattgcctagactatcctccctccactccagccagctggcattgaaaaagaagcactgcttttatgtgtgcacgtaatcaatctgtaaaatcccattatccccaacttccacacccccgtggctgcatgcttccttttgaagcctcttaaaaaagaaaaactttgaaggcaaccttgaagtttatttctaatctcattctagccatataacataaaaatgagataggggtagggagtgggaggggttcataatgtgatttgcttacctctttgcctggaatcttatgatacttgtaggtaagcccagtgaaagtttacatgagtaaaaatacttcttcagtgtgtattttgagataaagttggatttaattctgtttcaaagtgtgaagaatagagcaaggttaatgtggttattcttgttcttcttttaatctgttcttaatgtctatactatttagaataagagtttccacccacctcttatgaccagcagcctgtgtaactgattatctgttagagtcctaggtgcaatgcccttcccactctgctttcctgtttcatgtctgtttctttctgagaatattatctcccttctggatcattttctaactgcttttactaggccactgcaatctttttcttttgggttccaatttcccatgtgattggcatttttcttagcattcttcccacagtcttgaagtaattgacgtttttgcttgaggatgacctttcctgtttcctccatctctagaaactaccaacatttgattaaagtagggtaggggagaggtgtgggatgtaggtaggtaatctcaaaaatgttttctccaaacatgaaagatgtgactatgcttctgtcatcattattcaaaaacatttattctgaagtctgtattttatatatgcatcacctaatcccatcatcttctccatcctcttcatctctgggacatttccccatcttccttagagcctgaactacaaaccttaccttcataccaactcattccatctctctcagtgactttgttctcctagctagtgattcttgtaaaactgtagcttctcggtctttatttcaggcatcctagagccacagtcatggcttaggccgcacctcttgggcatctcaactttcttttctcctattaaatattcttcctgtcttcattgtagattcctctcactatactcccatcttcttcctcaggttgatatatctccctcctggtgttcacttcctttttttctatcttgttcctccccatgacccaacaagaccccttcaccctcttaacttcttgaaagagtagtcttaatcattgtttctgttttctttatctcccattatcctgtcagcaccctagaggcttttccctcattactctgcagacgctgctttcataatccccaagggtcacctcatttttcatattcagtggtgacctcttctatgtctttaccctgataacatttttgacatcctccttttttaatactttccttccttgactccataatattttctttctgtgattattttccctcctctgcaatccccccctttttgtttgttgtttctttgatgtggattcttcttcttcccctgctacaaagggtaagttctcctttggcacctcttttctctctgcttattttctgttgattatctcatccgccctctcaatgttaatactcacctcttagatgtggtttcccttcctgatgctgaggatatgtccccacatcctcctttgtaacattctgtagacatgtccagagggataatgtaaacctaaggtcatgttaatttattatctaaactgggtcactgtggagggttgaagagggcactattaataattagcagatgtaaacctgtactgcgcacatagtcacctgttcaaagccaacatttacaaaatactctgaaatctgtttcttctcagttgttttccatctttattaattgcctcaccaacattctacttacctgtgctgaaaatcttcatcatcttcaatattctactttttttactgtatctttttaattaaagctttcttttctttatttcttttttgaccccattccactggcagtgcgctgttcaggcccttatttccccttgcctgaaatactgcatagccgtctaacttgtcttcttgttcccagtttctcccattcatctttaagcaatattttttatttttataaaatgttgcctgaagtgcactgatcatttatatacctgcttaagagtcattgccaaagaatatcaatgcagacttctcagcttggaattcaacacactacaaagcctaatggaaaatatacctttccagtcttacctccttcatggaccctgtatttcagttggactattggcctttatccaaacacctcctaaatcagtggtccttgaccacatcataatcacctttggaatttttttttttttttttttttttttgaaatgtacatgcctagccttcatctgggagcttttaatttagtaagtctttactggggcctaatcagaccccaataaaacctcttaataaaaacctccctcaggtgattctgaccaaggccagggttgagaaacattgcccatttttatttctcgataattttggtcacattttttcttcataaccagtatgtgcttttctttaaattccttcttacccttcaacacctatcctatctccttcatgaggtcttccttgagctattcaaatagatgtagttgtttcttcctttttactgcagagcagtgaacggtcactgctgtttatgcctaataattggtagacagcacacttcttgaaggcaagccatctgctacttataaaaaagaagccagctgggtgtggtggctcacgcttgtaatcccagcactttgggaggctgaggtgggtggatcacttgaggttggaagttggagaccagcctggccaacatggtgaaaccccgtctctactaaaaatacaaaaattagctgggtgtggtgacgcaagtctgtaatcccagctactcgggaggctgaggcaggagaatcgcttgaatccaggaggcacaggttgcagtgagccaagattgtgccactgcactccagcctggataacagagtgatactccatctcaaaaaaaaaaagccagtcagtaaaagtcattgactagttaagaatatttgtagagaactttgaagttcttaaaaagtgattgataagcaggagttattttttgctaatttaacaaaaagtcccaaaacaaaaagtacggtgtttgtaattctaagactatgctaaattaagatttgttaatcatgctaagaaggaaaaaggaattagaattttaaatgctgctaccattttcagcagcaatgaactaatagtacattcattggtggattgattccattaacactcatgcttcagatgctttagggcatgtagctctctttggattcctcatgaaattgtcatgttggcatgtagctataaaatatgcattaatcagaaactgtagttactaaagccaagttcttttcactagtttgtttggaataggggaataatacttttaataaatcggccttcctgtaagatagagcacagtgtcatttttaatagggagcaagaataagtgcagtgattaaatgcagttacaaatggctgcatctaaaaacaatttttgatttttgtcaaacatttagcaagggagtaatttttttcctctagttttttgtagctttcccagtttttttttgttgttgtttttgttaaagttatatgctatatattcagaattggattctttttccctataaatttgttagtacctgatttggaatttagtcttattaatatcatttagtttgggatgcatggaaatgtatgtataattattgagtgccctttaaggtggagacttgtatcttgatattctattgaaatatatatatatatatatatatatattttgtattttgcaaagcaactggattttatagcaagcgtaggtaaagaaaaaacttgtatcctcttggtgctctgtgtatttgctagtataaaacatgtttctgatttattccaggcaacataatcaaaaggtgtattttagaacatacacaaacttttctatgctcatgaaaggtatactgactggaaaatatcaatataatctcttttttttttttttgctttttataaactacaggtttacagagactttatggagacatccagtcctttccctgacttctagcagaactatagcttaaactactcaaaacttctagaagcaaagtcaaacttccttcagaaacattccttatgtttaatgttaatcacattcatcttttaagttgtccctcgaaaacaaccataatgggaagccaaaagacagagtgttgggaaacattttgaagacagcaaacaaataattaataagatttcatagtcacttggagatatctccttgtcagtagaggagtaaaaggagcagtatctagtaaaacttgggaacagatggcaaacatttgttgaccataataatagtagtaacttgtattttgtagaagattatacagtttccatgcacatcgtgtcatttaatcctcacaaaaatgagggtactattaacccccttttacagatatggaaacatagctaggaagggtaagtagtttgtttttaattgcatacctaagtggtagatctgagatttcaagtcttttgatgctctgtgtggaaaacacaaactcaaagtgtgtatgtgtgtttaattctctcattcaacaataatcaacatagaagacttgtcttaacaagttttgccccatacaccacgcaagcaatcagttcttcagcagataccagctgggtgtcctccaattcagtttaatcccaacactgtctacctggaaattgtgtcatatcccacaggttgagggcttattcccacaaaactgcctcctcttcagacaccagttgcaagactagtcagcttcaagtttggtttcccaggatcccctttttgtgttctattaatttgctacaacagctcacaaaatgcaaggaaacagatttactgacgtattataaaggatgttacaaaggatccagatggcaggaaacataaggtgaggtctaggtgggcacagagcttccatgccctctccaggcatgccatcctgcaggaaccaccacatgttcagcaatctggaagctctccaaatcttgaccttttgtttttttatggaggcttgattacataggcatgcttgattaaaccactggtcactggtgatcaacttaatcttcatccacttcgccctctctggaggttagggtttggggttgtaagtcccaaccctataatcatgtcttggtcttttcaatgatcagactttatcttgaagctacctagggcctgccagctatcagtgaactcattagcatatgaaaatatatcactttgaagattgcaaggattttaggagttgtatgccagaaacagggacaaagagaaagtgtgtatttcacagtatcacaaatgccaactcactctactaaaaggctattttaaaaaaacagtttttcaaagaccaccttaaaaagtatcaggacagtggcagcagtgcgcctaagagagaaaggctttgaaaccatttcttaaattttccatctatacagtgtataagtaagaggaaatacatttatacatgaaacactgaactctttgaagtaaaatgatacacaacctcaagatgttgattttttaaaatttttagccaacttttatttttatgcctagaaaaatacatgggacgtttaggactaatgtgctgggcaatttgctacttagtgatagtaacacaatcctgaaaaagcaagcacaattattctgtactttttaaaagttttattcagcaataagaccataatttttcatatttaaggagtatgaaaaatttgtggagttttaaaagctgaatacatgtagcgttggatcaaggcacatacaagactggccaaagggcgtacaatgcactttggttttttgttgaaaaaaaaaaaatcatggcaacagaaaagtgatatggtttttcaacaagtaacagctcacaattcagtaggaagctagaaggaaatgttacattacgagttcattatataatatctggaaaattgtgacagtaatgggcagtattcttgatctttgtaaaagtaaattgaacatttatgtacagtgttaaaacctttgacataaaccagatctaaatttgatgtctagtatttatttttctttaaattatctcttatttaaagaactactttctctggattgttgaggggaatcgcttataattacattacatttttaatatgcataaagtttctctgacatcctttatgataaaaacatcataaacactaacaattttgtgtttataattcacttttcaaaaatcaggatggtataggcaaaaccaaaatgcagttttggtatttgtgttcattacactatacaagtctaagtttccatgttttcctaagtacacattttccccccaacttggaagcacatttacattaccgtttttgtgaagtcctttattttcaaagctttgctgacaatggctttaacagacttcatgctccttttatgccagctgatgtattcagttcagaagatatgcttaacttttttaaggataattaatttgcctagagcaaaaatggagatatgcaggaagtttgatattgcccattacttcacacattttgatttattgaataccactgggataatacaaatttaataattggaacattatttcataaccattttttaaaattaaattttatctcattcagccattcagccagttttttttttttacattttattaataccaaagtgaaaaatggcctgtgcttatactacaaggatctcatatgaatgcagtcctgattgttcgacacagcaagaaaattcactttcacagtcaacaagtcatcttactcagtagaacacaaagtaaatggtttataactccaatatttgcaaggaaaatacagtacaaattactaaaaaatactaaaatatagaattgtgttcaggcatctccactacatcaatcgcagcagtaacctgaaatttgaaacttttaataaaaagttcttaaatataaattatatggcaaatgtacagtacattgctttttttcagtctctttttccagtgttttgcagtagaacagggttcctaccatcacctcccttaggtttaaaaaacccaaaacacaagtctgctgtgagtccttcagcatcatgagtgtgagtgatctgagtctggaataccactgtctctgtagcttcggttactactgctttcactgtgattgtttttgtacagattcattccattaggaggaaatatggtgtgtattacaaactcctccttcgagatgggttcattgcttattggtaacatctgaaaagaagtttccctgatttccaggatagagttgtccttcttagtgccagcttctgcatagtcatcctttcttctcctccctttgctatatgcacagttccttgagaagagcgatccattcctatgaacataccaacacactaaagcaagaagggcaatggtaaccagggccacagccccaccaatgatggcagccaaaggtaaattggggtttttgtaaggttctttctcttgctctcgattgagggtggttgtagggttgtacattcgaaggggtgcagtttcagtctcaatacaaacaggagtttcatcaaataggtagaggttgctggtttccatgggaaccatgcatactttatagggtgaatcaggctccagggctgtgaccaagtactcactgcgttcccctgttacaattgtttctgttatagatccaaatgccgggctatggcccagtttaagccagctgagtctcaaagcagtcataggtagagcaagtttccaagagatatgaatggtatcagaggtgacagacttcacagtaattgtaattgtttttcttgagggactccctgtggtttggtgatccttagtgagcttggggttcttaatatctggctgtttggtcactggagctggccactgtccttgggcaggatacactgtgttgggtattgcagtggttatctgaatggtgcttacaatcccactgtccttacaatcaaacagttctgcattgagatccttaatagccatcccacgaaccttttctggggcttggcacatgagcccacgcacgttgaccttcacaggtagtgattgtaaccagtcacgtacccatttcatcttgcacccgcaataccagggattgttgcgaagaatcagttgtgttatattgtccaaatcatcaaagataccctgaggtaaattacttaggttattattggacatatccagtcgatagagctgccttagataagaaaaagcatttgggggcacccgattgatgtggttatcttgaagataaagcttcctcaggtttgtgcctggaaggtttactggtgcagcagtcagggaattccgcaccagggacagctctgtcaaattaactaggttgaagaaaactttgtcacctaaaccatgattgttcaacaggtttccatctagaaccaggcgttttagactagtgagaccttgaagagatggtgatgaaatagtggatatgcgattatcatccaagcgtagttcttctatagtcctgggcaaaccccagggaattgtgctaaggtgattacgggacaggaaaagcagtcggagatagttgctgtctcggaatgctccctcttctatgctaactgcagagacagagttgtcatctaaatgtaattcttccagatagggaatttttgaaagtgaatcataagtgatagtccttatgttattttcttgcaaatgtaactcttttacatactttgggaggttggtaggaaattcatctaaactgttgtggtataggtatattctttctactttcagcaagtttttcaaatctgaaggaatcccagcattatttatttggttgttctgaaggtagagagttgtagcatcctctggtattcctgttggaatggatgtcagaaagcgatcattacagtaaatgaaacccgcatcgcagcgacacacagatggacaggatttagccataactgatagaggtgctacttgaaggaacagcccaattttagtcccgatgaggaagatgctccaggctgcgctgatcatggtcagcagtgttgaggtctttatacaaggtagcttccgttacttcagaaccctaaaatgaagtgagtaaaaaaagacagaaaacaataaggccagcatactgaatataatgtttaaaaacaaatgtggaaactaaaatatccataatcacttttaatattttcatttgttttgggagggggcataatagggtttattgctagctaacaatagacactgtcatataatctctttaccttaatggtttcttaatttctttataaattaaaaagtatctgtcctaaatccatttgattttgaaatattaaatataattgaagttttattgaataatccaaagtattttaattatactttatatcaacctttagacagtcactgatcaagctaattgaatatccatttcttacttaatattcataataagtaacaccttggaatattatttcttatatttaaaggtaatcattttactgttatcaaaaaaccacacatttttatatttactttttattaggcaaaaactatacaggtgtagaaaaatgtcataaaaatacctattctcttcatactcaggaatagttacacacatcttgagatcctcaatctcaaacccatagtttgctttgattattaatgtcatttcattttctttggttattaattttaagcattattttaaatggatggatttctgcaagaaaataagaatgattccttcatttatttttgggaaagaattacaaagctaatacatccagctaacctaagtggaaaatttcacttcatattaaattctgtctttcttctgttcacattttgttatatgtttcatactgcaggttttaatgactttgtccacatttttcattattttctacctcataacgtgttgtcacagtgcatttatatttctttgaattctaacctagaacataaatcaactttttctatggctggcaaagtatagatttatactgatgtattgtgtaatatagtctcttctgtccttttaagtattaattagcctttgtaattttaggcatgaaaataaaatactttgtttttcctaccttattgaacgatgtgagtaaattttgcgggggtgaatatccaatgcacatatattattttcctggtgagggactgggacttataaacttttgtttagtccttggaaatgttcttcaccgtttattcaagtaatcctatggcgtacacacctccagatcaggcttgctgttgtcaatgaacattccagctgcagttcagcatggtgggcaagctcattaaagtgggggcagaaacaattctgcttcctgttactatgtaggacacatggcttcctatgtattttttttttctttctgatagagtttctgtgtgaaagttccttttgtgtagcttaattcccttagtggaaattgccctctttgaaattcttattggctcttctgtgcaatgtggtcagagatagtaacttcagatcctcatgaagaaagtcattcatgatgctaaggcctgtatagtaataggtttttcaggcagttaccccctacctttattcccatccaggattatccaagtataaactttgtacagtagctacatcctgaggtatgattacctgctgtgaaatagctatttccagcttttgcttcttgctgatttttcagaatgtctggtgcagtcacgttatacaagaacaggtattctcttttaagaagtaaaggaaactaaattcttcatttaaagaaaaggaggcatactaaatttcctttatatttctcttccttaaaatatactgggactgagcatctcctgtgaaagtaaaaggttttaatgaactattaataatgaactttaacatactagagaaatttcctagacatttaatttcaatgtcttaaaataacacatctttcatcatagtggttagtcagaagggataggttgacctctttgtttttagacttctcattttcttatacaaataaagtaggagccaaagttgagattgtcatcaaacagataatttctattatctgattgtgtcactttgaattaaacaccatggctttcaaattcaagccagtctttaaaaatttacttttaaatcatatgcataaaatgataaaatgtttaaaaagaagaaaacaagtacatgtcaaagaggtgagcaaatacattaacaaatatttttgacagaaatgccaaggtaactttttaggcatttctgaacatgatttaacaaagtcacacaatccacaatttagagttgaaaagactattttaaaagcttttcttttgatttgcttagtgccctgtttgattcctcctgcaggtctcaattctcccaactgcagaatgttgacatcatcccctttctctttaggggtgtatctaaggactacttagtgatcttgaaactctaagcactcaggtgttcttgcccaaaaggtgacatagaagttcaagtcatatttagtttttctggagaatactgttctaattttcttttagcatactgagtttgaaaaaaaaattgtatttgaaatagaagggacactattatttcaatctccttgtagtgaccattaggaaagcacatcaaaaccaggtggggcatttctctctaggttcatacatgaatattgccagtttttaataagtgtatttttcatttccaaaagaagacttttggcttgactaaagagatcattgaatttaatgttgactgctttgcccattatcaaatatgcacgaagattttttgagagtttagaggaggtgagtaatattcgaattggttatgcagggtcatccactctgatactttgtatatatgtagggaacatttgagtatcctggaaatatgtgaccctcaaagtaaggactaaagtagtagcaatttgcttctcccacagttgctatctaacatccaacaagtatagcatctgttccataattcagatactctgctgaacgagtatgttaaataaggccacaatttgtgtttctggttctctccaaaaattcagtttcttttagtttgctaactacataccaacatggtcataggctatattaacggaagaaaagtgaaaacaattacagatacatataatttattatttacgcaacttgaaacaaaaatagcagttagcagatggatcaaacagtctctagtgaatattgcaaagtgcccacagaggaaagtttaaatgatttattgtttaatgtgaggttttactgtgatgcctttagggctttgctcattattgtcaaattccaatagtatcttttcttgaaaactgttgctttctcagtgtgtgaaaatggaaaaccaagctgctgaaattataattacaaagttactttttaaagtatcttctgtaaaagttttttaaacttgaaaattattcaacatataaaataatgtggttaatttaagtttagaaaacaattgcttatgttaaattgcattagaaactaattaaaaaccattataaaaataacaagtgagaacctgcttaaaatgttaccaagagtcaagcatttctgatattccagggatgatggtgaggcaatatatacttgagatgatgaatccgctgattggggatttaaaaactgattgtcccctgagtcaggtcagaccacagtgtgtccaaggtgatgatcataatgataaccagacataaaataaatgtcttttatcttgtgtctggactatatatatatttcaccaaataaggctctaacaatatgtattgattttcacatttttaacccagagaatgaaagagttctaaattggtgtgaaaagacggaagattaatttgtttattttacctgttttacatttgtgaagctgctttctctattctgtttgatatgcaaactcacatttgccattcatacaatagtggtaataatgtgggattaacagaaagccttaaatctcattaagttcttggaaaatgtcattctcttctccccacattgtattaaaataaaaggcaaaaacataaaacaggtttcttaggagagaaggatactctttcggaaatgaagattacgttcagagctactctcatatgcccctgctcccttaggctcaaaacagttcatgtttaactacgttttatatcttctctttcccatttatgtttgaaactatagtgctaaacagatttttgggttttggttttggcatattaaaggctgcaaggatctcttcatcaaaaatgaacgatcctctcctatccttagaccttcccctttctgagctggatctacatatttgcgcacctagaaatactgtagtcaaatgtcgatgatgaaaagaaaaatgacccccactggcatggacactgtggccaggtttccataacactgacttcagagcctttctgtccgcctaggcttgaaagaggccattacttctgaacaaaatgaatcgatcttttagaaaaatactgttaatggggtaacttgggaggaaaacataaatgaagccctggtaacttaatggaatgtttaaaaacattttttaatggaatcattatttaactataaaacacttaaaactgtagtaaaaagaagaaaaacataaccacctcactgatgaatcaaatttttaatagggatccttatattcatattcagtttatttttacaaataaaaattgtggggtttttttgcatttataatgtaatcatcaagtctgaaagcttccaatttatttccatgatacacccaataaaacatgtaaatagataaggatactattttagggaaactaatataagaagttgtatctgaatagaaaactagtatttaaataaaatcaagagcttgcggcaatctacatgtttatgtgatttcttccctgctactacaatattttggaggtgggagtgttatgagaaggtatttcttatgttttgagaatattacttagattaagatgaagctgtataatagtagtgctaacttcttatttaatgccttagatttaaattgattttgatttgacctgtttgatcattagtcattttttaaaaatattaattcaagtataaggttttgagattatagtttatttttaatgatttctctcacagaatgatttcttaatgctggggacttttaaaaatattcaatctaaaatctaatggcatgtagaacttttaatccaagttagttgcattgttttaagtaaaaccttgagactaaagaaaacacatgcctaaacaaatgtatccaactttgtgaatatttctaggtaaactggaatttatacaatcataatttagagtattaggaaggtaatttatttatgaaggcttaaattgctgccaaaaaagctcaacctgtgaatgctaagcctttgcaacaacaaacggtatttcaaataaactacatatacggttaaactgaaaaactggagtacatcaggttagttgatagtgacagcaaaatgctttctaagcagcctgtctggtagttaaattttccatgatcatcagatttcaggaaagttccaattcttttgttcaatgccaggcaagcagaaggacctctaactctcctcttgagagtcatgaagtctgaagggtttgctgagaggcagagaagcaagtgtgccttttcatacttggttttatccagactattttctagcctgaacaaggtccttgtttcatttatggaaaatagaggataaaatttccaatgctaagtatttttactttttctttttctgttactggttattttccccggtacgtttctgacaaatgaatcaaattctgcttcatttattttgacttgtaaagttaaatcaagcatccttaaaacaaaaaggcaaactgggatattatccgtcagcatagtgaatgctgcttccttttatgatattaaacccaaagtaaatgaattagagaacaagagttgtaagaacgagtaagatattaatttagagagtggtgaaggtaagtggtgcagagtttggggtgggggcatgctttaaatttgtgcttttgagcaaatgcaattaaaagtttgcctacttttgttaaaccacgttttaccattgcagacttcaaattcctttttaacagtgtgggtacaacttggttgatgtgctttaaatttctaatatttaagtttccatacagtagttcagcaaatacatttattttagtctactgtgtggcaagcactatactggtcggtgagaccacctgaaatcataaaatacattgtttttcatgtccaagcagggtattacttaaaccagatgaagaggaagaaaatcaacaacacataaactgatcaatccacagtccagtggcacactttaaaaatggtttttaaccaaatgtggtctgtgggttttctcttcaaagttgcctcggtaacttgtgcacatgtaaagtgaaagaataaagaacaaaagctgtcattgtctcatcgagtgagagcaatttctccctcctttgatttaaacagaataatacctgcagaaagctttttatacatccctgacacttgattttagggtaggaaagagattatgcatatgcaaaacaaatgaaattttagcttttgcttaaattatattctattgctttctacttaaaatctgttttctctggggttttcgtaaatagataactcaaagttctttcttacacaacataaacatagctttgaaaactgtcttttagtgtgatgtttaaccaaattgagtgatgtcgatctgtattttgaaactggaaaatactttttgaaatgtgtatacctattttcttaagaggaagaatgctgtttcagaagaccaactctttgttggaaatttatttgttgactttcagtaaatttttgaaatggtggaatgttagaaggagctgagaaacatccctttttatgctctgaagagaaaatgcagttttgaggattaatattgctgagagatttttactgtagagtttttgcccactggggggtggtacactctaccagaacactgctttctgaagccgcaagtcagatgttggctgctgctggccagtttttctctggtttaattacaacaaagcctcccgttgagaagaacagtgaaggcctctggggcaaaaggtggggggtgggagggaagggggaaggaggaaagacggaggggagaaattatggcctttgaaaaattactgaatcttatttccattgttgactttatttatggtagtcttcatttgatttaaacagttatttctaatgctttttttttttaaataaatgggtttgaataaaagaatatataaggggatctattcagaatttttaagttagctctggattttgccattaatcaatcacattctttgttatatagcccacccaccttaaaaagaggcatagaagttaagaaatgactgaaatggcaactataaaccaatactttttcattgaccagatttaatattggtatgaacattggcatatcaaaaatgaaaagcaagaaagaagaaacattaatatattattaagacaaggccaattccctgcactgatttttgtagggcttaaaactgttcaaaataatccagaaaaaggaggaagccttagggtgtgtggccaagaaaagcacagaaaaatctctctgcagtgcacttgcatgtttaaagctgattattgtatttttcatctagagagactgagtgttcattagggtcttgtgtccctaggcaggagatgctgagcataattggagtttctatttgattgggcaatatagtctagagaagaaactggggtaaagataattaatagcttgctaacaaagtctgacagccacaagatttcaaccaaatttatttcacactgcttcatttagctctgaaaaagttttgatagaattgtaggctccttaattaacacttgaaagcaaaagaaacataccttctattttgctgccacatttagttatgacagattttcttactgtttttcttctttttgtaaaaactttatttgctatccaattatatatctcacaaacgttatgtttgggaagtgtttaattgtgcattttgaacccagtcataattgattttaaagggtggggtgcagcgaaatgaaaaacccaattagtaactggtagacagttttacagaaccgcaatattaatgaattcattatgtttattcattcactaatattttgctgatccttggacttgatgtgttttggttgtgctcttcaaaaaatcaaattttagttttcttagtaaatctatgcgtttttgtaactctgtttttatttcagggtaataaatagatgtgcgtttgtctgtgtgtatatatatgtgtccaaactaaggggcatatctctgatttaattttcccatggtaaaacctggcatattatcattaatatttgtagtagttggtaatgttgatattattgattgtggcacttttaaaggattaatttttctttactcatttcggaagagatgaatattagtcatctgtcactttgggtcaggtataagtgattctccctgaatataagcaaatttattctttatgtttaggctggtcaggatatttttatgcagtcagagataaatgaaaggcattgctacagctgaaggacttttctagtggctttatttatgttgtttctggataataaaataacatagatgagcattttagacagatttattaatagacagatttattaagaatgtttaaaatagccttattattaaaaccattagagattttggactaaaaattgaaaaaaaaatcaattttttttcttttaaattctaaataaaataataaaaacaaaccccccagatgttgagaagacatggatgggcctgttgcactctttacctatatgcaaccattttgtttcagacctaattcagtgaacaaaattttttgagaagatacatttaactactttttcaagctttgtagtataaatgcatttcttccaatataagattttcctattataagttgcaaagaatggatcctctgcaaaacccacttgataagggctctactcatttatttttctttcctgctaccccaaactcactgcatacatcaggcatagcttccagggtgagctttgttagtttttctgagtagacttagccatttactatgctagtcacatacttcacttgcctaagcaatggattttggtgttctattgaagagggaatatggtttggaagagtgtctccccctcctctgagttcaatttactagttgagatttgcaagcctgaaatgcttgaagcagctcaggcacgatagcagtgcaagctttaaaatctaggtgtagctgttaatcctttacagaggcacataagtctccaggagtagctcggctagctgtgagcaagatgtatgcttttcatgtactgcgtactcatgggctgagggattattgattttctttcacagttgtaaaaacagcaattggtgatcatcccacacgtacagtacacaccaagttgctttcctatctgtgaagaatctccttgtattctttaatatttaacattgaactttccaacttgctgttttccataaggctcttttcacatagcaattactcaagacagaaaatagccacttactatcttttataaatgaaagaaggttctaagaaacttcttacattcagccatgatagtgaaatttttcattgctggcttgcacgcacatatattgcttgttgtggtgacagagcaaacgttcctatttggatttctcatagtatcaagtcgtttctttctagagagtaaaaccaagcaaactttctgggacaatcataagaaaaaacatggaaaacacttaccaggaagacgagaaaaagcaatcctatatacactgccgctatagctgtaattccattgacagtgaattggagtaatagccctcccccgtctcccaagctctgcgtccagtccacacaaagcccacggcagctgcaggctgagcttgtcctgcttcagatcactcctacactgaggagtgagcgagggagagcattccagtttactgcacacagcccacctccaagtctgaagtttaaagcttcacctcgcagtggctgaagaagggggtgatgtcatagatgggcaggacttagccaagatcttgttcagtgaggtaactggataatcagacagatgagctttgcaaacgctagagggggcgagagcagccaaaatgaagcatcagcctgccaaagctaggatgccatttggtttgtaggcagccctttggaatctcaacattttctaaagtttactacaaggcagtggtagcatacttatgtattttttttaaaaagcatgttagaaagatatttttaagatcacaatagaaaaagacaggctttgtcttatttttaaaccatctgtattgaaaagaagttaaccaaaatcaaattagttttattattcactagctaaaataatgttataattgtggaagatgtatgccagtaatcccaactgtgaatgtttattcaacatatgaataaacagcagattcaaatatatacatcagggctgggtgtggtggctcacgcctctaattccggcactttgggaggccgaggtgggaggatcacctgaggtcaggagttcgagaccagcctgaccaacatgtagaaaaaattagctgggcgcccgtaatcccagctgtttgggaggctgaggcaggagaatcacttgaacccgggaggcagaggttgcagtgagccaagattgcaccattgcactccagcctgggcaacaagaacgaaactccatctccaatatatgtatatatatacacgtgtcactgattcatttagttatgggaagggcaataggaatgccaaaagatttttttaaatggtattaaatggtctgttcttttggaggcgaagaagttactgttctctatgttttagaaaatgaaagtatgttttatgtacttctgctacgtgtttatattatttaaaatggattatttatatttaacgatcccccaataaaatgtttttaaaaaatttaatagaatattttcctttctaaatgtttttgctgatctgagcatgggtttagatataaacatcttaagaaaaaaatctttcagggtggtttgcctggattgaaattattttagtttaatttaggtacatgaataaacactggacaattgtaagacgtggagattataaatttctatgcctaattaacagaattatacttgtatttttaattatgatttttgtagactggtttctgctatttggtcaacaattgctttgtgcccgtaagttttccatcaaataagtgtatttcacttgttcatgttggtggtaagaacttagcttttatatttacctggaggaccgttgtcttaaactaatatctttatttgctctattcttagaggtgcatgaccttctcctttgtcctttctcaatttttccctgcatgtttatttctgaagaaggccagctaatagtctttcccaggactatttgattgtggtctcttcattagcttcatttagtttatctatttatatatttgtttgataacagtttgacctgagttcccttccaagaatgggtgatatcaaagtaggtgaacccttgataagaaatgtattgaccctattgttctatgattgcacttttgtgggcctcagaggacagacccattaaatctaggagttttagattctaatgtccattgaaaagccaatttctttgaactgctaggtagtacaattaaactgatatgcagcagctgaattttgggaggaaagggaggtggatatttttctgttactatgaaacaaagacatggattaaattattttattaaataattatttctagaagccattttcagataggagttggttctgtttaaaaaagaaaatttttgcctggtcaaattcctgtgggtttatagccatatttaatcagtttcgtcttcattcaggcaggccttaaacagaaaagaaaaatcaattggtgaattgggttataggtatcaaaaataaattgtactggcctgggagttagcagtttggaggtttcccttctctgggctgccattgttatatgacttcatatttgttgccctaggctttggtttcatcacttgacaaataaaggcagcaaggatttattaaatgccaattattttttgttgctttttttccccttttaagctatggattaaaatatgggaaaagaaaagaaattgtgaaaatatattctatactggggtactgactttgggggcaaactcttagtagaatctgtggcctcctattctgtccaaaaatatatactcttttgctgcatacatagtttttcacttcccgctcttatcagctacctgaaatgctactagttgaaggtgaatttataataatgtgtgccccctttgaaatagtatgtacaatctctggaaacatgaggttatcatgagttacttcagattgccctcctcttttgttttctaaggcactttggctacaataaggggatgactgttttgattgaaggggatggaatgctggcaatctttagcatgaaacccttttggctgtaataggaagggaggaggtggattctcatatcaggaaggacttggctcagggtagaggacaaccagtgtagtagacctgggtagtttaagaacatgggcttcagagattagcacagctgggctccatgttggctttgccacatgactgtagacaaattacttaatctctttgagtttgttagctcagtgcctgactcatagtaagtgctcaataagacgatagctgtcattatttaagatgggggacatccaagcacctggaacaaaaaggacactaagaatgggagaagaatacacaaagggaggtagtacagggccaataacagatttttggaatttttcaaatttctctttgaagtaattttacagtcagtaaatggaagtggaaaagaggaatagaagagcatttcattgattttttttttctcttgtacttacacatctcatgacctcatgttcccagaacttaacacttagttgggttctagtagatattttgggttgaaaagatgtttgctgttttgcattttgttctgttttgttggctagcctgtgaatctagcattgtacgtgagaaagtgcatttcagattgaaagcaactggtttggaaatgaacttcaataacatatcccagttttaaaactctaggactatctaaacttgtcatctcaaaggactttgtggtgttctttgtttgtttttatgagaaaatgtgagatgttcactagtggacatgaaagtagattggatttggaattgggtttcccaggttctgccatttacttgtatatccagacaaaaaaatgaaaaacaacatacacacagaagcctcaaatctgtcttttagttaccaactaccagctgaaactgactaaaacacacagtcatttcatggaacaatacaattcaggtctgtctagagttaagctacctcattcacacattcattcattcagtcttcacattcatttattcattcatcatatacatatttattgactccctgtgtaaaagaaactagtaggactagatgatccccaaactatctccaactatgaagttctgagatttaatcttagaagacattaaggttcttttaagcctaagaaacattcttcatgattttcctttccctcagcattcttcatgagaataaaatcttcaaaattgtgtaaagaaaacagtttggatgggcgcagtggctcatgcctgtaatcccagcactttgggaggccgaggcgggaggatcacctgaagtcaggagtttgagaccagcctggttaacgtggtgaaaccccgtttctagtaaaaatacaaaaagttagccgggcgtggtggcacgtgcctgtaatcccagctacttgggaggctgaggcaagagaaccacttgaacccaggaggtggaggttgcagtgagctgagattgtaccatgcactccagcttgggcagtacaagcgaaactccatctcaaaaagaaaagaaaagaaaaaatagttcatacttttgatagattaaatgtcttggactgttattagttaagatacttttggttgcaagtcattgaagatctaagccttacctgcaaaatcaacaatgggaatccattggttcatgtaactgagaagttaaaatgtatagtacaacttcaggtaaagcttgatacatggcttaaaatatgtcaataagaatacagtttctctctggctctctgtcctgcctttctcattgttggcagcctcctcaggctatatacagtggacctttggcagctctgggatttcctcttaggcaataacagttccacatatcacattcccataacacaatgttcaagggagagaagcgtcctccaaaagcccctgcacggagccctgggggggtcactgtttctcatttgcttaaacttgatcacaggttcattcccgaacctattacatgggtggggagataacgctggtgagcttaagcccaatgcaggagctgcagataagcccagccttactcagacacagaactgagaatggaggacagggcatgatccaaaggaaaatggggtactcttaggttgagaaggaaggagtggatgctaaggatcagctcattttcagaggttttaccatgctgaaacttgggcatattttatacatgtataaacttgaaactgctctttttctctttgtcttttttttcttaagccagagtttctgttaaaattgccaaaacatctttaaaagatactcttatttgtagacgctctcaagtctagcccagatttttctgtcaacaggtagtgatgcatgtcagggcacatcagtattacatcttagcataagcctataggatgttaataaaatatatagagagtgcactatctgtaattctgtgaagtcaggccagatgcttaatgtagtagttagaaactataccacatctttctcaacaattccaaagggtattggagaaataattagattttagcaggtcacggatgccttagaatgccgaaaggttttgaaaatgctacgttaaactgttcttttgttctgatatttgccttttattagtcaacacttaaaatgtacctaaaaacaatcacataacccttttaactatattcccaaaacattctgcactggaatgagatctgtcattacaggacttgaaacagatatcaaagcaaaatcagagtggttatttccctgcctgcctgcctgcttgcccaccctctggtacacccttcttttccccaacactcatgttggactgttacactttggggactgggagaaatgcaattaaaaatcacaactgagaaaaagcacctccttggcctcccaggaaagaaaggaggaattgtggttcagaataagctagtaaaagtcacggggtgtggcagtagctggtgcaaaactagaagcctgctgatccctactttcttccctcttcagcacctccatatatggccatgcagatacagcatatagaactccagctgatataggtcaaagctgtgtccttgaccccttgccactccccagtgccctgtccccttcacttgttttaaaatgttaaaaaaaaaaaagacttaaaatgatccttgaaaaaaatgagagacttggaggaagcagattgagtcaatcatttctatatgatactttctatgtggccctgagaaaataactggagctctttgagccttagttcctttatttatgaagacaggtatgtggcacccacctaatttcctattatggacttcaaataaagtggtggatgtaatagttcactactaaatccgagaaagcacataccaagactgagttgaaacctggggatagttgcttttaatcttcatagtgatgagtggggccaggatcagttcaaaagaaacaattcactaatgtcaaattgaactgtgtgctttaacaatttatctttgggaatgaaacaatttgagaaatgcttctgccttctctcctggatgctagactttgagataacagtatctaaccctggttctgagacttaattacaaatcaaaggacaaattccttatctttggcaatgattagtataaaatacagctttggaggaatgactaacagttaataggagcagatcaatatgtgtctgattattgacatgtggatcaacaagatattatacaagtggattgccctgaagcacgtgattttctctgtgtagccagctactgctgtcagtttggaccaaagtggtcgtcattttgaaaccatcttattgtttcactatttctggagtattggtgctaattttagacacacaaatagactttctgaaaggaagattttctgaaattgtcagatttttttttctggaaactggctctgtagttctccttgtattggagattatctctttgctatttctctgcagtctagactacttgggtacattaacatgcttaatgttgaaagaaacatgtttaaggtagagtcaaagactgttttctattttatcagtttattaatgactatggaaattgcccttcattggcactgtctgcaggaagcagatttactacaattagcatttattgccccttgggaactgatatgaactgattatttgccagattttcggggatcaagtatcagttgattagatttggattatgtaaatgttttacaatctattccaaataaaataagttaaaaattaagtcacatttaccattgggaaattttctgtaaaatataaaggtacttaaattttctaagcatgatttatgataaatatgttatatattaactagactcacttagttcattctgtaaatgattaacctcaaatttgaggaatttgaaaacattttataattttttcactagttttgtttgttttttgttttgtttgacatttgaagtgtattcatgctggaaattcacaaatactttgctaggtttcctatgtggatttaaaaattaagatctagactgaacaagtttatttaaagtacacaaatattgccaaaatgtatttatagtttaatgagctttcattcttatgttcaaagttgttttaaaaattgaaggtagacttgaaaaagaataaaaaagtgtgtcactttttaaagttattaatttttgtttggagaaattcaaggagctttttggttgtttaattctcatgtgtacatagaagcaacacacaactgtttgagcagctttggatgtaacccctctttgttttcttcagtagcccagggaacagacttgtcactcttaagtgctcacgtgtaatcctgtcctccctttcttccccaaggcaaatcagaaataagcttatcagatcatatcttattaacaaagaacaaaggattttgactgaccaaagagtaggaaaggactagcaaaatataaatgttaaatgtttgctgccaaaaatcctagtttgacagtggttttaggtaactaaactttttttgaaagtaggatttacatatttttaaaacatttgcctgaattatactttgtctaggattttaagtgcattagttaatggctttacctatattttatatatgaattaagtacaattgtcactcattattattgtcattgttattattatttgttccttacaagcaaatctttctagcttatatctgagagaagttagagacaattatattatatcctatgtgttttcagtataaagtgttttaacagaaagtataaatagccttctaataaagggagaagtgtttttctgatagaaagtacaatacattatttaggtaattataaggaacttttaaatcatatttgtgtcttgttttcttggttatttttatttgaaggtttttttttttcttagatggagtcttactctatcgcctaggctggagtagctgggactacaggaacgcaccaccatgcctggctaatttttgtatttttagtagagatgggttttgccatattggccaggctggtctcgaactcctgacgtcaggtgatctgccagcgttggcctcccaaagtgctgggattataggtgagagtcaccacacttggcctgaagatgatttttctataaggacaacaagttgttcattatttagagttgtgatagtaggaaggaaataactttagaaaggaagacagcaggctgggcaaggtggctcacacctgttatcccagcactttgatcacgaggtcaagagatcgagaccatcctggctaatatggtgaaaataaaaatataaaaaatactactaaaaatacaaaaaagttagctgggcgtggtggtgggcacctgtagtcccagctacttgggaggctgaggcaggagaatggcgtgaacctgggaggcagagcttgcagtgagccgagattgcaccactgcactccagcctgggtgacagagtgagattctgcctcaaaaaaaaaaaaaaaaaaaaaaaaaaaaaaagtaagagagcaattcccttgtgaaaatcaggcttgcattttcttgaagtttgaagtttaaagtaacctaactttatcacaaaaacaataatgatcccaaatatatttgggaagaaagataaatttttaatccatatgaatagcaaaaacataaacactacaagacgtatgaatgtagtgtttctattttgtttgctgtatgttctgtagacttcctgtgtggctcacattctatcaattgtttttttaaactttcttttcccttggcttctttgctcctacattatctgattctgcttaaggaagagcccctgaacaaagaacagatattaccatctccattctaatatagctgatttctagtaattgtatagcagatgctcgttcaagcacctatttatgtgtattctaacaaaaacatggtattcaggctcagagaggttacagttttttaaaacactttatccaacttactagcattctctttgttttgtttagattgattttactatcatctaagtctcagaatttgctaattaggaggaatgggtggtgatgtctaagtaatctgttgctttgagagtgtttagtagaaactcagacggaacaaaaggagtaagaaggagaaggtagaacaggtactctaagaggacccctagtttaatgccttgtttgccacgtgtcttcccttggtcagtttttcaacaaatgcttattgaatagcaaggtgtgcctcataagtctgatctcttttactatattctctgtttttcaaagactttataactaactttcccaagttggtctgtccacttatacatagattataggttggacaaaaccatctcatgacatagatatataggttcttgagcaatctcaaagaaatgacaaagaaactttttcgtggtctgtgggtgagaaggtcagcaacaatttaaccaatgtgctctagatcacaaaacgtatttgaaatgagactgaaagcagctagaggaaaagtttttgaagagatagtaaggagagaatcagaggtgctaagatagcaacagcatgttaatttgaggtgaaaagtgtcctaattagtaggtagattttggactctttatcagttactatggtggtaagtgcaagcaaggaagacagaggaaattctctaggaacattcataatgcacatatgagaggtcacccatccttgtagtgcgttttggggatggatagaggaatttgctgaattatagaggccaattatgaaaaagaaagtacgtagatttgggctaaataataatatcgatgtaatgagactagtattctaataatgataatagcatgaaaagagtagtggacagctaaatatagacgaaaatatagtaaaatctgattgtacaggatggtaagggtacacaaatatggagatgtgttactagtctggaatgtgacctaatcctgctgatttccatcttttgctcttccagggaagagagatgaggctttccaaaagctgccacttttaagtttacaggagaatccatgggattcccaagtttttatctgttctgtattcagaaatgcaattccttggctaagaaagggtcccctctaccatttgctttagaagaatgaaaactgacccttgccaagagagccagaactaagccttggctattaaaacgaagatatgggacatggggccaacatgtcccagccagatcacccacacatccattaggaatatggggcagctttcaggggtttctggtgtgtatccaggttaacatctagcctaacattgccatgtcagtggaggcaacagagtcatccaagatatgaaaccagaacaaatgtataggtataagccaggcacggtggcttacacctgtaatcccagcattttgggaggctgaggcaggtggatcatctgaggtcaggagtttgagaccagcctggccagcatgttgaaaccctgtccctatctctactaaaaatacaaaaacattagccggtgtggtggtacgcacctgtagtcccagctacttgggaggctgaggcaggagaattgcttgagcccaggaggtggaggttgcagtgagctgagattgtgccattgcactccaacctaggcgtcagagcaagactccgtctcaaaaaaaaaaaaataaataaaataaagaaagaaagaaagaaaagaaaagatgtatcggtattagaacatggaataaaaattctgtgacattaagggttcatggtaatttgtatcagaatgtacatgaaagaaaatatcaagaaggaaggtataccagttcaggatgtgttatctactaaatagtgtgccagaatcctaataggcatttctatttacatttggctcctctgaaccttattacttccttcaacttgtcttttatgaacaacatcttttattagtagacaaaaaaaaaaaagaatttcttatcagtttaggaaaaccaccaattgtcctgttatctcaaggaatgatttttggtggaatgtaccctaattctattttttctcctcagtatctttaatatgtgatgcttacagattcattaaaaaataaatgaatatttatgacttggaattttatgctatcaggaaccatatatgcattttttaactgtaagaaatgaactgaccactactgtctatttccatcagacttgtttcaattaacagcactttgggaggctgaggcaggcagatcacttgagcctaggagttcaagactagcttgggcaacatgatgaagtcccatctctacaaaaaatacaagaattagctgggcatggtggtacatgcctatggttccagctacttgggaggctgaggtgggaggattgcttgagcttaggaggtggaggttacagtgggccatgatcaccccactgtattcctgcctgggtaacagaatgaggccctgtctctaaataaataaacaaacaaataaataaatggaaaataaaaataatctgaattcccactatccagtattaacattgggtggtttaaagcctttcaaatatttacaacttgtacctatatacaaacttttttttttttttttttacaaattaggaaaatagtgtacttgttttataacttatttgttttttatttttaatttttgtgggtacatactaggtatatatatttatgaggtacatgagatactttaatacaagaatgcaatgtataataatcacatcatggaaaacagggtacccatcccttcaagcatttgtcctttgtgttgtacttcagttaatactcttttagttattttaaaatggctatagtcaccctgttatgctatcaaatatgaggtattattcattcttcttttatatatataatagtacctattaaccatatatattgtatctatatggttaattaattatatattatatattaacattatatatatatatattgtacctattaaccatccccacccacctccccactgcctcctgagtacttttcccagaccctggtaaccattcttttattctctgtctacatgaattccatcgttttgattttgaaattccacaaataagtgagaacatgtgatgttcgtctttctgtgcctggcttatttcatgtaatataatgaccttcagttccatccatgttattgcaaatgacagaatcttattctttttttcttttttttttttttttgcccaggctggagtgcaatgcgattctcctgcctcagcctcccaagtagctggaactacaggcatgcaccaccacgcccggctaattttttgtattttagtagagacggggtttcaccatgttggtcaggctggtctcaaactcctgacctcaggcgatccacccacctcagcctcccaaagtgctgggattacaggcgtgagccactgtgcctggccatcttattcttttttattttgtttggctgcatagtactccattgtgtataagtaccatatttactttatccatttatctgctgatgaactcttaggttgcttccaaatcttggttgttgtgagcagttctggaacaaacatgagcgtgcaaatatttcttcagtatactgatttcctttcttttgggtatataaccagcagtgggattgctgggtcatatgagagctctatttttagttttttgaggaacctcaaaactgttctccgtagtggttgtactaatttatgttcccaccaacagtgtatgatggttccctttttctccacaccctcgccagcatttattattgcctgtcttttggataaaagacaggcaataacaaatggggtgagttgatattttaactggggtgagatgatatctctttgtagttttgctttgcatttccctgatgattagtggtgtcaatcactttttcctatgcctgtttgctatttgtgtgtcttcttttgagaaatgtctattcaactattttgtccattttttgattggattaatattttttttcctatagagttcttgagctccttgtatattctggttattaatcccttgtcagatgggtagtttacagatattttctccttttctgtgggttgtctcttcactttgttgattgtttcctttgctgtgcagaaactttttaacttgatgtgatcccatttgcccatttttgctttggttgcctgtgcttgtggggtattactcaagaaatctttgcccagacctatgtcctgaagagtttcccttatgagtttcctcatagcttgaggtctcagatttcaatcttcaatccatttcgatttgatttttgtgtaaggtgagagatagggatcaagtttaattcttttgcatatggatattcagttttcccaggacaaattattgaagagactgtcttttccccaaggtgtgttcttggcacctttgtcaaaaatgagttcactgtaggtgtgtggatttctttctgggttctctattctgttccattgagctatgtgtctgtttttatgccagtaccatgctgttttggttgttatagccctgtagtacaatctgacgtcaggtaatgtggttccttcaactacttttctttttgttcagggtggctttggctattctggtttttttgttgttgttgttccacataattttttttaaatttctgtgaagattgtcattggtgttttgatagagattgcattgaatctgtagattgctctgggtggtatggatattttaataatattgattatttcactccatgaacatggaatatctttccatttttgtgtgttgtcttcaatttcttgcatcagtgttttatatttttaattgtacagatctttcacttatttggttaattcctaggtatttaattttatttgtggctattgtaaatgggatttcttttttaatgttcttttcaggttgttcattgttggcatatagaaatgctactgatttttgcatgttgattttgtgtcctgcaactttactgaatttatcagttctaatagtttttggtggagtgtttatgtttttccaaacataagatcatatcatctgcaaataaggaaactttgtcttcttcctttccaatttggatgccctttatttctttctcttgtcttactgctctagctaggactttcagttctatgttgaataacagtggtgagagtgggcatccttgtcatgttacagatctaaaaggaaaggctttcctcactcagtatgatgctagctgtgggtctgtcatatatggctgttatgttgaggttcatttgttctatatccagttatttgagggtgtttatcatgaaaggatgtataactttatcgaatgctttttcagcagcaattgaaatgatcagatactttttgtcttttgttctgtagatatgatatatcacactaattgatttgcatatgttgaaccatccttacatcccagggataaaccccactttgtcataatgaatgatcttttcaataagttgtttaatgcaatttgctagtattttggtgaggttttgcatcaatattcttcagagatattggcctgtagtttttgttttgtttttggtgtgtctaacttatttgttttatgactttgcacagggacctgcataactagcctctctagctgggcgtttgtgtgctttccagtttttcaagattgtgagcaagttttgataaaaatactcgtctcgcttcggcagcacatagacttaaattggaacgatatagagaagattagaatggcccctgcacaaggatgacaagcaaatttgtgaagcattccatatttaaaaaagaaaaaaatactcctaactaaatctttatgcttattatgtatatttattaggataacttctttgaggtaaaactgatggtttatagggatgacactcttttaatgaatttgctgtaattacaagattgccctccagaaaggatatatgcacccttctaacctctgccccttcagtaacattgagtagtgttcatctttaacttaataggagatacattgtatgttaatattgatttaatttgtatttatagaaggagcacattttcttgttttgggaaaggatgttttctttttcttctttttctcgttccttaatttcccctttttggctaaactttttctatgtgatccatttttttttttagtagataaacatggaagtacagagactaatagaacaacaatgcaccacccagaattaacaaaggttaacatttgaatatttttgctttagcttcttcattaaaaatgggatataatatgataataaagttgaaatattatgagtttccactctcatccactcacctctttccttatccataggcatctactatcatcaatttgatggtattttccagtttatgtttttcatatttgtttaattaaaattagcgttagctgtgactcttcaaaaattcaaattatgagtggcttaaacaatatggatgttgatttgtcacttgtgtaaaagtccaaatagggggtctagggtgtgtatggtcctccacatagtcagcgacccatgtttcttccaacttgttgctttatagtgggttaccttggtctcataatagtagcagccttattccaggaagaacagaaaagggattataaatatactagaattaataattactcatctgttataattaatagcaataattacttattttaatgataatttattcattaactgcaaaactgtatttagttgtctcctgtgcaaataagactgcaaggaacattcttttccatatctcctactccacatgtgtgagtttctcttggtgaatatacctagaagtggaattttagggttttaagggatgactattttttacctatactagatattgcaaaatttttaagctttctctgttagagtatttttaaccacaggtaacagacaatggaatttaaagtggcttaaataaagaaagctatcaatcacctcatataataagaagtccagaggtagaactgctctagatttgggtaattcattgactcaatagctttcctcttggtcatgaagaatcaggcgcagacaaaaccatggccagaggcgtttattcctctatgtctcttttgaagggcaaagaaactttctttagaaatttgtgttagctacattctttcatgtttcattggttaaaattaaatcacatgccaatgcctaaattgattacttgtaagggtctacaagaccatgatgattggctggggggcaaggctaattttgcttaaaaaatatcatcaggaggaaggagatacctgaaaaaaatatacctttaggaaggaagaaggggaaggtgggtgtcaagtcggcaatctgcagtgtctgctctgtctctaaagtggttactgcattcccatcattagtatttgagttattaattgtcaggatttttgtttgttttaccaatctaatgatcaacactttgttgttgtattccttagaattttctgtttctattgggttgtacacctttttagatatttatagacccttaggcttttcttttctttgaagtaccttagctatgttctttgcctgatattctcctaagttatttgtacttttcttattgatttgtagcagttctttacatattcaggataataattacttgtatgtatacttgtgttggaagtttcttccatcagtgaatggcttgtgtttttacatttgtttgcattaaaaatgtttttataacttaaatatttgtttcttgtgtcttattcgaagaaccattttttataccaaagtcatacaggttttttttctatttcttattgaattttaggtggatatcagcctttgcttgctatatcctagcagtttttaaagtgatggatggactctttcaaagtgtctgcaagactaaaattatttttataatgatattaagatgtcatttgccctttcccccatatatgtagaattgggtctttttcaacttttattttagattcacgggtacctgtgcaggtttgttacatggatatattgaatgatgctgaggttcggggtacaaatgatcttatcacataggccctgagcacggtacccaacagttagtttttcaacccttgttcccctctctcccttccttctctagtagttcccagtttctgtgtattcccaggtattttattttgttcatggctattggctttatgcctatgagtatccagtgtttagctcccacttctaggtgagaacatgcagtatttggttttctgttcctgcattaattcacttaggataatgacctctggctgcatctgtgttgctgcaaagatatgatttcattctttcttatggctgtgtaatattccatggtgtatatgtaccacattctctttatccaatccactagtgatgggcacctaggttgattccatgtctttctattgtgaacagtgttgcagaatagaaactggtagaatgatttgttttcttatagatatatacccagcaatgggattgcagggtagttctaagttctttgagaaacctccaaactgctttccacagtggctcaactaatttacattcccaacagtgcatatacaggtcattaacaaaattaacataaaagataccacttgtaacctatcaaattataaaataatgtcttaaatgataactaatataagacagagtgagttatgactctgactaggagtgtaaagtgataactttctggaaatatgttgcaaagaccccactaatccatatatttttaactcagtaatttctgttctagaagctagcctgaggaaactgtaagaaagacgttcagtgtagaattatttaaaagataaaaaagtggaagcaaccacatatccatcaataaaatacagaatcaagttttatctatggagagaattattttgtaaccatttatgtggtttttttgtgatgacatggaaatatattatgtaattgtgagaaaatcagcatataaaactctacatgtcttatgattttaatgatattaagagcaaatttgaaatggaaaaaaggaaagaaactatcaaaatgtttacagtggttatctctgagtattgttatgcatattttaaaaattagctttccaactttttatgataatatatattgttttcactaatacaagtgttattaaaaaggtctggtagagattggctatttttcatttcagccttgagattattgggagtggagagggcccttttatgaaatgaagtctcttatttctttggggagggagtagaacatttggtagtgtgtctttcccgatagaaagagaggaatgtgacccagcagggcctggggcagcagatactaactcagctggatttcaagaacaaccattggatcctgatttagtggaatgcactccagactgcttagtgtcatggttaagggtgctagttttgtagccagagtttctagtttatagcctagttctgccacttgtgagctgaattaagttttgggtaaattacttaatctctgtgtgtgtgtttcagtgtttccatatatgaattgggaataataacactctctgtgccatggagtttttaagagaataaactgaattattgtgtttaaaattgtcagcagagtattcccacataataacctcttactatttttttagtaagttttaataggtcttactattagtggtttaatcagctatctattacctcataacaaacctccccaaaattggtgccctaaaataacatgaaataacttatttagtccataaatctcaatagttatagctcatctctgctccacagggcatcaactgagatggctcacctgggggctggaggatctactttctttttttttttttttttttttttcgagatggagtcttgctctgtcacccagggtggagggcagtggtgcaattttggctcactgcaacctccgcctcctgggttcaagcagttctcctgcctcaacctcccaagtagctgggattacaagcatgagccaccatgcctggctagtttttatatttttagtagagatgaggtttcaccatgttggacaggctggtctcaaactcctgacttcaggcgatctgcccaccttggcctcccaaagtgctgggattacaggcgtgagccaccgtgcctggcctggaggatctactttcaagagacctcacgcacggctggcatattggcgctggcttctgctaggagcccagccagagctgtgtgatgggggtctctattttctccaagtgggcttcttcaggactgtccaggcttccctatggcagcatgtctggatttggaaagtgagcatcttgaacaaaacaggcagaagtgcatcacatttttataacctgtcctcagtagtgacttctttatcctactacttcatggagtactacttccatcatagtcatgaatccatccagatttaagagggaggaacgtagacacttccctgtctatgtgaggagtgttgggcacattgtaagaagagtatgagtggtggaaaatattgtttcagccatgtttgagaaatacagctggccatggcagtctactgaccttttagataacataatatgcttggctttcttatccactaacagcagcaatctcaattctgtgtattagaaccatcttaggactttttactaaatgcagattatgagtgacttttcatttcttttgaatattttctgtatttttcaatgttgaaaacttattactataatgaaaagttttaaatgaaaagataaactttttttgcaatgtatctagatattctacaatctatgaatgtaagatttctatgtagaattttaaaaatctattacactccttctttcttggtttggtcatatttctagtagcactgacctctagaatgaaagaaaagaaagaaaaaaaagattctactcacaaatatttctatgttaaatgtagtggttcctcagggcaaaccttagacaccaaatacagcctataaaactatgaagtgtgatttccactggcttctccttagaactctgggttgcaaacaactgatgagcagctgctggcttttactgctagtgaacttgaacagagagcagtttctattcatctgtcaagaaggacaggcacacaataaatttttgactacatttgatgatacaattcatgcaaataaacttgcaaataagacagtgctctcaagatttcaagaaatggccaaggaggctgttttgcccctcctccccaaaaaactttggagctgccactgatctcacacaaagtcatctctttgaattaaacatgtcttattctgaaagatgccaaggcctggtccattgaaacattcaacttgtctttgcagctgtaatttatttcttctctttcttcccatcaaatgggaaaattgttcattttaaaaagcaaagaccatttaaggtttgaggcaaaaagagaatgaaatatggaagtcaagggtcagtttcaaaaaggaatagtactgtataacaatttagtttacttctaagtggcaactgttgttacatatatataggataaagtatgcaggagtaaatagtggattgaatgtcactgtggtgacccaaaggagtcaatgcaacctctcaagtagattaacttattcttggggacagtttataaaatggcagatttggggctcaatataatttttattcattgaacatatatatattccagtttctatcctaaatacttatattaactcatgaaattctcttaacacccctaggaggtagttagtaccattgtcctgcttttttattttttatttttattttttgagatggagtctcactctgttgccaggctggagtgcagtggtgcaatctcggctcacggcaacctctgcctccctggttcaagtgattctcctgcctcagcctccctagtagctgggactacaggtgcccaccaccacgtctggctaattttttgtatttttggtagagacagggttttaccatgttggccaggatggtctcgatttcttgacctcgtgatccacccgcctcgacctcccaaagtgctgggattacaggcgtgagccactgcgcttgtccaccattgtcctgcttttacagaacaaagtggttaagaaacttgcccaaggtcacacagagttgcactcaggtttcaaaccctggctgacctcttttcacctattgtgctttattgcttcacagataagtttttgaaaaaattgtagtgaggccaggcatggtggctcatgcctgtaatctcagcactttaagaagctgaggagggaggatcgcttgagcccaggagttcaagaccagcttgggcaacataatgggacctcatctctacaaaaaatttaaaaaattagccaggcatagtggtgcctgcctgtagtcccagctacttggcaggttggggtgagaggatcacttgaacccaagaggtagaggttacagtgagccaagatcgcaccactgcaatacagcctgggcgacagagcaagactctgtctcaaaaacaaacaaacaaacaaacaaaaaacacctagattgagagatcatgaataattatctgtaggggatttttttcagagttcacatgcaaaaattaagggtggttattaccaaaaagacaaaagataacaattgttgatgaggatgtggagcaaagagaactcatgcacatttttggtgggaatgtaaactagtacagccattatggaaaacagtatggagattcctcaaaatattaaaaatagaactaccatatgattcatcaatcccaatactaggtatatatccaaaagaaatgaaatcagtatgtcaaaaggatatgtgcactcccatagtcattgttcataatagccaagatatggaatcaacctaagtattcatcaatggataaatggatagcaaaggctgggcatagtggctcacagctgtaatcccaatactttgggaggtcaaggggcaggattgcttgagttcaggagtttgagaccagcctgagcaacatggtaaaacccgtctctacaaacattagcctgacatggtggcacacacctatagtctcagctattcagggtgctgaggtgggaggatcacttgagcctgggaggttgacgctgcagtgaactgagattgcacgactgcactccagcctgggtgacagagtgagaccctgtctcaaacaaagaagggtaaagaaaatgtggaatatatacacaatagaatactattcagctttgaaaaaaaaatgaacatactgtcatttgcaacagcatggattaacgtggagaacgttatcttaaatgaaacaagccagacacaaaaagacaaataccacattatcttacttatatgtgaaatcttaaaaagttgaattcataaaggcagaaagtagaattgtggttaccggtggcttgctgggcacagggtggtggggggtggggctgggggctaggttggttcaaggggtccaaaatttcagttaggcgtgaggaataagttcaagagatctattgtactgtgtggtgactatagctaaataaaaatctatcgtatacttgaaaatcgctaggagaatagattttaattattctacccacaatcagcgtgtgaggtaatacatgtgttaattagctcaatttagccattccacaatgtatacatattttaaagaataatgttgtacatgataaatatatacaatttgtatttaaaaaacaagtaatgtttttttaaaggcaagaaatgtctcagaaagggaaggtaggcagcaaattgatacatttcaggttcattgttcaactttctttgcatctggaagttgagtccaatgggtttggaatgtgggagatgtctgacctgcactgctgtttgtaaaaagaacttgaatgagtcacttcatctctcctgaggatattaacagctgccctgacagccttgctaggttgttggagagagcaaatgaattatcatggttatcaaatcctgttgcaagctataaagacctcattactgttagttattgctgtaatcaggcatcttttcttttagaaaagcatttcaggaatgcctccttttagaagatcacattctgcagtttgttcctctatttttcactacattttatttaatgatacaggtgtgtcaaatgtttagcatggtgcctgccatatgatcacactgaatagattttattaattattacttaatttctagcagaagtcttggatttgcagaagcaattaagggaagatatctcacagaaggacagaagctgccgagtcaagatctgaaaagcagggcttcctagcttttccttgatgtcaaagaccataataatactgaagagagtttggaagtcgaattgctgttttcattctaattttagttttcggtgataatccctttcatttatactatctacttatgtacttatgtgccaaggccattgaaagtggctctttgaggactgtgttaaatgttctgggggcacatctaggtttgatgagaaggaatgtcatgatcactgcctccaggaggtagtatttgccatccctagcctattctagaaagtttataaaatatttttgcttccatttttaaatcataccctcactaccaccctctatatttgccaggggttagtttaccactgtgacgtgaggaaactgacattgtgactcctctttacctctgcatttttctcactagaccatgctgtgatggttttgcccattccttctcaggtttcaggttctgtcttgaaatctagaatggagctggatacataatagatgacccatacatttttgcagaattaaactttaatgaattgaaatttcactcctaaccaaatgatacatgtttaaagataaaagctcaaacttcaaaatggagctgctggtacttccctcattcttcctaaataccagagatttcagtctctgtaatgcatgtcactccaataggtggaaagggtgaacagggtcatttaatgacccgatactgttctcagatcatttttgttagaatggccattggactagggaggtgtctaaaaaccataagggctgtgaacaggatgccaaaaacaagccaatagctgatgtggcacccaatgggaatagggagaaaaagactcagtagctaggcattcttgcttcttcccaatgtacttttctgacatttgggctttttctgttttgcccatagctcaccttaaccttttaattttctttgtctgtgcccagcacaagtttactttctagagcccatttattgacgtctctggtttatctgcacatttcacaatcttttctagctgtttaataaaggtcatgtttatagctttagtattgatggtttgcccagtaggccaagtgtcagcttctgtaatgtccaatagaatcccttcccataagacaaagtcctaagatgttactcaggagtatgagtttttatagatccaaataatgacttttggtcttcaaaatatatcatatgttaataataataacttactacattccgatcattgttcccagcactttcttaatcttgataccaaccaagtgagacaggtacttttattgtcctacttttatagatgagaaaacagaggcacagaagtcaagaagctggtccaaggtctcctagtgattgctggagtcagtatgctatgctacttcccatgtgtgctatgtgtaacacttatgggtcaggccctgtggtagctagcgggattttgcagtgagcaagacagtttttaccctcttgagttcaagagttccctcagagaaccctccgccctcattcctaccattcatgccttaatggagacggcttttaaatgaagcatttgtgtaaaaatttcacagccccaagttaactttgtatagtatggtttaattgctctatctaggtgcatttcagacccctacgaaaaccaaacttgcatccccaggaatctttgatctcttgggctagaggaaaaaataacaccaaaaagttcctttgggaggaagagaattaacgatagattgaagcttattaaagcaatgaattgacacctgtgaatgaaaaccagatgttgaaatctctggggaaaaaaagatatgtaaatgtatacagggtatataatgaaccttaagagcatagataatagtaaaatgtagtaagataggaagcgatgacttttgagtattcttgtttttaatgtaattttttaaacatataagtacatataatttaattattaataatgaccatttaacaaccagctcacaaaatttctgaaaacttaacagttggcttttgagacccagtgggagccgtctgacacctgtttatttatatacacaaagaagttcaattaacattagccctgaagactcatatcactcagctccacctcttcacctggggtttggaggcagatacacttgagctctaactctcactctatattttattaaaactgagacatcaggcaaattactgtttctgagcctccttttattatctgtaaatataatataataattgtgaacaattatcttgtgccaaacacagttgtaattcaatgaatttctcaacggggagatactgtaattcctcattttacagctgtggaaatagaggagtagagagggtagatagcttgccccactgagaagtgaaagaggtgatatatgaacaaaggcattttggtcctaaaacatgccgttctaaccatctcaatatactgcctacgttatcagttatgaagatgaaatgacatagcatatttaatatgactggctcagtgaattctcttcaattctcttttccttcttcctatttagaaaataagattaggggccgggcgcggtggctcacgcctgtaatcccagcactttgggaggccgaggtgggcggatcacgaggtcaggatatcgagaccatcctggctaacacagtgaaaccctgtctgtactaaaaatacaaaaaaattagccgggcgcggtggcgcctgtagtcccagctattcgggaggctgaggcaggaaaatggcgtgaacccgggaggcggagcttgcagtgagcagacatcgcgccactgcactccagcctgggcgacagagccagactctgtctcaaaaaaaaaaaaaaaaaaaaaaaaaaaaaaaaataagattataagattaggaccacaaggtgttgttgggaatgtgtcagaaaaagggaacactgcaatctagtgatggtctcaatcatggtggcacagaaaaatcccctggggcacttttcaaaacatagatgccttggccacaccctgtactaattaccataaatccgaactctaggggtttggggcatgggtattagtgttttttaaaagcttcccaggtgattaaaaggtggttttctacttttagaattcttgataatggtactctcttactcctgtttgctgatcttttccttttttctcataaacacagtaagaagtactacacagaaaagaggtccacattagggaccaccttaatccaaacagaaaaattgatttggatttccttaacaagttactgcaaagcttataggtttgttagtggaagttccactttatgaaggcagattcctgctgatgtagaaatatgtaacctcattctacagtgagctgcagtcatcgtataggatcttacaaaggtttagttttgcctatcatttaatgatttgtgcgctttgtccccatatttagttgtataatttaaaaattattgtgaaatttacatatcataaaattgataattttaaagtgaacaacttagtagctaaggatgtattcacagtgttatgcaaccaccgcctctatttccaaaatattttcatcacctcaaaaggaaattgcatacccattaagcagttactccctattttccctggtcccttctctccttcccttagctcccagaaaccaccaaactgttttctgtttctaagaatttgccagtcaggatatttcacacaaatgggaattgtaccgtatatgacctcttgtattttgctttttttcgttagcataacgttttcaaagttcatttacattgtaccatgtgtcagtagttcattcctctttgtggctgaacaatattctcttgtgtgtccatgtcaaaatttgcccatccattcatctgctgctggacactttggtagtattttgttgaaaactttttttcatttatattcatgagcaatattggtctgaagttttcatatagtgttctgtctggctttggttcagagtaatgctagcttcatagaatgaattaggaagtatttcttccgctgctgtttcttgaaagaggttgttaaggagtggtgttaattcatctaaatgttaaattcttttaaatgttttcaagccacatggtcctgagcttgtctttgatgggtggtttttgattactgacttaatctctttacttgtgagagacctgttgatattttccatttcttctttagtcagttttggcagtttttgtgtttctaggaatttgttcattttatctacattattcaatttgttggtacacaattatttatagtattctcttataatcatttttatttctctaagattgagaaataaagcttagagaaataaaagtgggataaataaatgaaataataatgttcataaataacatacttatattgttataaataattatataataatatttatgtaataatgttcatgtataatagtgtttatagtgtttcatgctataaaacataatattcccactttcatttatgattattgtatattttttacccttttttcttagtccagctaaaggtttgttagttttgttgaaattttcaaagaaccaatttcttgtttcgttaactgtttgttgtttttctaatctccatttcatttatctctgctgtaatctttattatttccttcactctgttagctctgcacttagttttctgttctttttctagttccttaaagtgtaaagttaggttattgatttcagatcattcttttttataatacagattttgtaactattaatttccctctgagcactgcttttgctgtatcccatgaattttggcatgttgtattttcattttattttaggatattttctaatttcccttgtgatttctttggcctaatagttggttaatattgtgttatttaatttttatgtatttgtgaatattccagtttttcttctgttattgatctctagcttcatttattgtggttgaggaagatactttggatgacttcaattttttaaaatttatcatgacttgtttagtggcttaatatgtagtgtatcctgtagatgttccatgtgcacttgagaggaataagtattctgctgttgatggtggagtgtcctatatgtatctgttggatgtagtctgtttatagtgttgtccaaggcctgtatttccttattaatctcatgtctaaatattctatttattgttaaaagcagtgcatggatgtcttccacgattattgtataattggttgcttttccctgcaattctgtcaatttttgctttatatatttggttctctattattaggtgcatatatatttgtaatttttttatcttctttatatatttctacttttatctatatatagtgtcctttttgtaacttgtaactttttttttttttttgagactgagtctcactctgtcgccaggctggaggcagtggcgcaattttggctcactgcaatctctgcctcctgtgttcaagcaattcccttgcctcagcctcccaagtagctgggactacaggcacgcaccaccacacccggctaattttttttattttagtagagatggggtttcaccatgttggccaggatggtttcaatctcctgacatcatgatatgtcctccttggcctccgaaagtgctgggattacaggcatgagccaccacacccggccaacaatttttgacttaaagtctattttatctgattttagaataccacctctggtgtcttttagatatgacttacatggagtatcttttctcattctttcactttcagcctatctgtgtctttggatctaaaatgagtctcttatcacagcatgtagttgtatcaagttataaaattatatatattttactaatctctagctttttgttggagagtcatttaatttacattttaaataatttctgattaggaaaggcttgcttctgccattttgctatttgttttctgtatgtcttatagccttttgttcctcatttgcttctctactgccatattttgtgtttaactttttgaagtgtgcttttttgatcccttttccattttcttttgtgtatattttaaagacttttctttgtggtttgtatggggataacaattaaaatcctaaatttataacaatctagtttggattaatgccaacttagattcaataggatatcaaagttctgtttctatacagttctctcctcatgttaatgtttttatagataacatctttatacattgtgtgtctgataacatacattataattattgttttatgcatctgtcttttaaataccataggaaataaaaagaagagatacaaacaaaaatacaataatactggcttttatttatcatgcagttacttttactagagcgctgcatttcttcacgtgatttcaggttgctgcctagtatcctttttgttaagtctaaaggactccctttagcttttctcataggtcagttttacttatgaatagctcctttgctttttgtgttggttttcctggaactgtcttaatgtttcctggtttttgaaggacaattagccaaacatagaattcgtggttgacagttctttgcagtactttaaaaatgttatttaacttcttctatgattttgataataaatcagctattaattttattgaggatcccttgtatgttggatgaattgcttctccttggctgctttccagattccttctttacccttggtttccagtcatttgattataatttgtcttagtgtagatctctttacagttattcgtcttggagtttgttgagcttcttgaatgtgtgcatttatgtatttttcaaatttggaaagtgctcagccattatctttacaaattctgtctgctgtttctttttctcttctccatctggggttcttatgacatatatgttggtgtgcttgcttgtgttccacaaatctctttgattccattcatttatctttaaattcatttaaatttaaattctttggtaagtttttcatgttagttattgtacttttatttccagaatatctgtttagttcatttttataatttctttatctttactgatattctctacttgtttatacatcacattgctgatttcctttagctctttgattttttaaggacagttgatttaaagtctttattcattaagtccaaagtgtatgctccctcaagtacagtttttgttaatttcttcttttgatggggcatagtttgttgtttcttgcacacttcatacttttttggcttaaaactgggcatataggccacgcacagtggctcacgcctgtaattgcagcactttgggaggccgaggtgggcggatcatgaggtcaggagatcgagactaacacagtgaaaccctgtctctactagaaataccaaaaattagctgagtgcggtggcgggtgcctgtagtcccagctactcaggaggctgaggcaggagaatggcatgaacccggaaggcagagcttgcaatgagccgagatcgcaccactgcactctagcctgggtgacagagcgagactctgtctcaaaaaaaaaacacacacacacaaaactgggcatataaaatatgataacgtattaaatctagaaataagatttttccttctcctctgggtttacttttgtcccttgctatagcatgtagctatttgtttaatgactttttgaactaattttttaatgtagtattgtttttcatgtgtgttctctgaggtctctgttcctttagcctttgttcagctagtgtcttgatagagaataacttcaataacagaaggcaacagagaagaaacaaaagaaaaagtaaaaactttaaaaatcaagaaaaacaaaacaaaaaacctctcctaatgtttacagattggatctttgctgacaaacttcttcaacactttgctaggctatttttaagctctgtcttagccttcatttcctgtttgcattgatcctagagatcatctaaagctgaaagaataagtttttattagcgagcatgggcatggatttttttaaattcttcggtatacatgaatgctatacatgtcctatttcccaaggaaactctttagttcttctgcctgagctttgggtactctactatatgccccaactataatgtttttgtcttaggtagctgtggattttttgtttaccttacagtattttcaaggaatctctgctgcatttctcctctgaaggagtcctcagttagagaaacaaagtaaggtgctttgcgttattccccaagggatttcccatacaggttatagcaaatgtagttttttgcgagtaagattgtctttgcttcctccagaaccaaggaccagggttgcctactggggaagctacctgcagttttgaagactgctgtcaagccaaggagagagttggagcaggggcaaatacaaacatcacatacttttcttactgtttttaagtctcctttatcttttatttttaatattttggtttcagcattttcttggttgctatcaacctgcctattttcaagagttttgttagagttgattctgacacttttgcttgattttgaatatttctgtgggaacacaagctcttggagctacctactccgtcatcttcactgatgtcacttgcagtttactttcagggctttagttatccacatggtataatgtgcactgtccgttgaatactatttcctatttaccttttttctcttatttaattatttgcatatatttattttagaatatatgtactctaggtcttctctttacttcatgaaatctaccacctccataaaaaaagatgcattcaaagtagacttgataaatacttaatgttaaaagattttctttcacatagtttcagatttaataaagcaaaaatgcaatttcaaaaataatctttttgcaagttttgaaaaattctggctgctgaaaataaaattgaattattggcaaaggcaggaatttggaatagaataaatataaacttttgtgatgttaaaacaaattgtttcgttgaatattctttataagaaacaattaccatagagtcttcaagaccttattattagagataaatggaaattaatttatctcagctattatgaaaatgtgattttaaactttaatattaggtagactgctgctcaatagtttacaaacagaggaggtaagaaataattttggataaaatattaatgtatgagttataattgaattatcatgttatatagtctcttttaataattagcagttaatggaagaaaaaagcatgttctcattaataaatataaaaaagcatttaagttaaataaaagaaaaaggtagcttttgaggaaacttcagtctgaattgtccaaatagactgaaaggactttaagggcaaaattttgtttgggtttgggaataccaaaatttaggataaaatatttcttttatccttctttttttgttttgttttaagagaagaaaaaatttacatagactctttgtataccagtgagaggaagtatagcatagaaggccatctaaaggatgaaattcccataaggagttttctgaaccacttatatcaactggtcagaacttagttttaattaaatttgctgggctggggatggtggcaggacaatagcctgttttaaggatagagagccagctttaactttaactttgaatttcctggctccaatccattggtgtcactacttcagtgttatttaaatgcaggattttccatttaatttccttttaagggagataaaaaccacagtttctttttcagaaaactgccaaagagtctccctgtgctttattaagtaacaattgcattttcagtagagaaatgcaatctaagtggtagcacattaaaacattatagtgtaaatgtgcagatgaaaatactaaaaattaaataattattattcatagcagttaattcagttatatgtattttgaactcagtgggaaattgtttatacaacagacttaggatattaaaattaagtttaaaaatttgatttatttttataagacagacaataccaaaactcttttttcccttttatgccttgtattagttataatgtttgctcttacattttgtgactttgagcaatttatacttcattatacttaaaatagaaaaattttaggccaacttaattttttgtaagttttataaataataacttttgccaggtgtggtggctcatgcctgtgataccagctctttggtaggctgaggtgggaggatcacttgaggccaggagtttgagaccagcttaggcaacacagcaagaccccatctctacaagaaatttttaaaaattagcaggatgtggtggtgtgtgcctgtagtctcagctactcaggaggctgagatagaggatcccttgaatgaatccaggagttcaaagctgcagtgagtcatgatcatgctattgcactctgcgctgagtgacagagtgagactccatctctaacaacaaaaaaaagaagaaataataactttgatcatattttgtttgtatccatttgaatatctgcctttttatttttagtaatagagattttaaaatatagattattttttaatagttgacctcaatttacatacttgaatagtgagcatttactatattaaaattattagaaatcaagtgaaggaattaagtaactaaataaagtgacttttaaaatctacctgatatttctgtgtttatgataggctttaaagaagccattgctagattgccttccatgaaagccatttgtgcctaggttctctcttccatgattgctcttttcttttcttttctttttttttgaagaatgggaatgaagattcccattcttcagattttagctcaggcatcaattactcgagggccttttctgacctcccttaccacattagctccccccaacccctctgtatgttctcataacattatccttctcctccccagcattcataatagtttctagtttgacttctttgtgattatttgattaatgtctgtttccttgaccacgttttcctggtccgtgagggcagggaccttgcctgattttgcttatcatcataattcttgagccctgcataggcttggtccagaagcagattccagtgagtgcttgtgtgttgtatgaacgctgtactcggaagtactacatcatgctgtcctattttatgctgataaatgaacttcaaataattttactagaaaaaacatttatttattatatgtatgcaaaataagtcttaattaggaacattaatacagatatcctaaataaaatattagcaaattatatctagtagtgagcatatcaaaataataatacagagagtaatactaagactgtttcagaccagtaaatgaaataatgactgtaacatgggaataaaatatagtttggagatttgatagaaaatgtccatataaagtcttttgtgccttgtgtctttttagtggtatatttttggttaaatataaccaaaaaacaggtatatttaaccaattttcttggttaaaaatgatcgtattctaaatatattaaagaagggatatgtattaaattgtttctttgcttttctgattcaattcctctcaccgttacccccagctctcagccttccatctccccattcctttatttcttagttatggtagacttccagacttccgataacacattcctgttttttttggagagttccactaggcatttctccacatggctatctacttaggctttaaaaaagtttctatccttggatttgttttcatctagtccatatccaggtagaaaaagatgtgatcaaaagatttcattggttctgtttgctgtgtcttctttctggtctcgccttattctaccatggctttataactgtgtgtcccagtgtggtttgttttgaagctttctcctccctggggcatactgtcaaaattcatttatagtgacccacacttagattttcttttgtaagtcttcaaatattttgccattccaaacactgccttaaacctactaaagactctctatagtctctaagggacacatgggagaaacatcactggtatacccttcttgacagatatgtaggtgaaagataagaaaataaatcagcaagtggcggttgctctttcagcagccctgctttctcagactttccaaactaccaaaatgaaaaaaatacagaggaaatatttagtgcccttgcttttccatgtgattatatatctggtaaaatttggcatatataatatgtatgtttaatttccctcctatttttaatatgagatgaaatgtaatacatttgaattatgacaacatcaagaggttatttagaccaaaataggttgtattatatacaaaaataatggcaaatgttatgaattgtctctagtatttttttttaacgtgtgttttaaaattgaattggttgggagactatttgaatgtgctttacttatgtggaaaatatcatcgtttactatttttctgcagatccctcactctagcccctatacacataaacaccaaataatttgcttccattgagttagcataaaaatcatcagggcttcaggataaatacccttaaagtaatgcctcagaatgtgcctttttgtggaaaaggttaatctagcctattattggcatcattagaaaatcttgaaaatagaagttcacagtttctatgtgaagtgctgcattaattatgcagcgagagtacacctaaatacaggaggtgctcacatttaggagtagtagccacagttacgcggtgttacactagctctacatttgcacacatgctccttgttttgtttattataggctttccttagagaataaagtgttgcaaataaatattgcatgtgtatgtaggcagtttttgtttaataggtattagagtaaatgactgtgaatttgttcctaagaatcttctgtgtaaaaagagataattttatcatcttatcactttatctctaacattaaaatggtaatctttgcatgacattatttacttgcgattgtgtagaccctgaaaatagtgtatattatatctataaattattgtaaggaatattatattactgaatgttcaacactaattatacttttatctccaacttctttagagcttaatgtattgatttatttacacttatagcttctaacaaggtatattctaaaaagtttttacaaatcaaaaaatttaactagtttcttaatacacaaaaagcctcagtacaaatgacccgatgaccttaattcccaggaaactgtcacattacttctttacccctttgtctagcttaacaatgtgacccaaaatactgcggagctttaaagtttctcagcattgtaaggtcaagctttggtcaccatagttacagtttagatctgcaagtcagaggtcaaatagattaatgatgtcagacacatctttaagtggttctaacaccacttcaccatgcagtaaacagctgagcatattcgatatggcaaaggtattcttcagtcttgctaataagaatatctttggagatattctttttctgatagaaagatttttttataagaacttgcaatattgggctgtggcatcagcaataatagttggcttttagatttgtaatatcagatgcatattgaaaagtatattaaatagctcagatttacacttttctgcacgtctgtgttttgtctgtcataatcaaattgatcatccacctatttataaataggtatcctcactcccctattaatttatggctaaccatgacagtggaccgaaaaaaacaagctttttgattaggagtttttgctttttgcgtgtgtgaatggcacatctcttttctcccaatttgggtagtatgcgctttaaacagaattatttagaaaattgtgtttgggaaatctttctcacattagagagcaggtaattatccatttgtattttatatccaaatacctttatttatagcctaggactctttataaagatcatgggttgtatattcactttttttgtcctaaaaggaaattatttcctcccttttgaatcagaatggaaggagaaaaaagaaactattttacagtgaacgttacttctagaaaaattcaaatgttattttttacaaataaaaaatactctatagataaattttaatcaaaaatcacagaaatacaaataagacaaaaatattaagtgaggtgaaattgcaattattaataaaatatatttaagcaaaaacaatcatcagaattttactatagaatatatatatttaaagctttgccagtatggaattttgcagccagtagacagaattatgtttaagcagtaggcttaggttaagctaaacattaaaggataccctgtttctgaaggttttgtttcccatgtgtattttgtgcagctgtaagattttaagcttgctggagcatttgctcttgatcacatactataaaggtagacaaaggggagaacgaagaggtttggcagctgggaggtgttattatggaatttaatagcaaagaagatgggggttggggcttttctaggtgaaacagagattggcagctgggaggaggaaataagtcctggagtctgagaagagctagtagttcagttgcctgtgagtttcaaatgacaagctagctttcatgtgaatgaatggattgtctccggttttgcgttcaattcaatggaaatcactgccttgtagatatcgtggaaaccaacaactcagcaaagacattaattgctgacctgttttgcagcacttagggccattggttcaacaaactgatggagtattctgtttggtcattatgccaggagaatggcaaatcaatatttaactaccttttgaagaagctacaccactgaaatgctggttttgtataaaactgtttacacataagagtgtcctgaaatgcaagaaaaatgattttattctaaatgtagaaaaattttgtaatcaaataaaatatcaggttgagttctgactttcagaatctgaaatagtattatttctgtaaaaattgccttatgccttgcttttagatttcttgctcctgatgcattgttaaggtgggtaaaccaaccaatacttaatgtctaaatatttatttatcaaaaatatatgaaattggagatattacattttatttactcttcttccttaaagtctgcttttcttgtctacttcctatgcctttttatttaaattttttcaatttacacctttacacttttgctagtgtcgtgaccagaattgtacatatattgctactgtagtgcattagtaatagtttccagtccttggtgcacatgaaaatcatgtagtgaacattaaaatcacctgagcataatgcccagacccacccaagaccagttgaaataatgtagtgaaaagaatgcaccctgtggggatgggtgtagtggcttatgcctataatcccagcactttgggaggccaaggtgggaggatcattgcgccctggagttcaagaccaacctgggcaatatagtgagactccgtctctacaaaaaattttaaaaacattagccaggcatggtggcatgtgcctatagtcccagcttcttggagggctgaggtgggaggatcgcttgagcctgggagattgatgctgcaatgagctatgatcatgccactgcactccagcctgggtgacagaatgagagcctgtctcaaaataataataataataataataataataataataataataataataatgtaccctttgactctttggaaccatacttccctttggctctggttttctcacataatagccatgtgatattgggaaagttacctaacctccctgaatctgttttcttatctataaaaggcaataatattaatactaaatttgaaagatttcttgtgaggattttataaaatattggcataacttccagcctaatccctggcacataggagacatccagtaaacaataataaatatcactgtctccaattagcttgctgtgggaccttgagcaagtcactcctagccttttctggccccatttctttacctatataatgcagctgtaatacttgtcaatctcagagtgcttgtgagcatcaaattacagatgtgtgttgaagggctttgaagaatagagagcaatatagtaaagcaagatgtagcttgtactcttattgctaaggctcctagttctaaggctcagagaaaacaccatcaaaatttgaaactgtttgtgggcattcaatgcttcatttatcattttctcagaaggtttcctgggatgctctaatgagttgcagaccacaccatcactcctgtgttattgaatacttagagtgacaatatccatgaagatttttcaccaccttgtcctgtcactgtttggaatttgtctcatcactatctatcatatagaattaatgcagacttgaggattttccttagctttttgcaaccctgtgcatccctcttggctacaaatacaatttctgtagaagagacaaatagccttgaggctgctccctgcctcctttctgagctgatcttggtatttcttcacgtgcagatctttttagaagcccaaggagagagtcagatgccaactaagttggatttggctagaattgttcacctattagcattttgctttacttaattcacatttgtatagcccttagcatgttctcttatacttacagactttttttgcaatgagtataactttatgttgttaattcacttttctgtggatctgtgtcacatataaagtaccatgtcaaatattgttagagcttagtagttaccttcgagtctgtaaaccaacagctctgtgattgaccagaagtcggggctccaagtaatagaatttctttgttttccagtagtattggacatcagtccatgatgtgcattcataagagtgcaggctgtacctgcagtgaaataattttgcatgcattttatattttacatagcatatatagtagtggttctcaaacttagcatgcatcagaattacctggagagcttattgaaagacaaattgctagaccttacctccagagtttccatagtttattagttttagcgtgggacctgagaatttgcatttctaacaagtttccaagccctgcaactgctgctttggggacaataatatgggacccattaatatggtgagtgctaaggtgcactacacagattcccttttgagagtagagcattcatttcctaactgcaaggggtactggctgtcatggtttccaggccctctgggagttgccctcagttgatgggcactgcctcacttaaaactccatttctgtccctagttgtagctcacataaaatgacaggttaatgcagggagtacaaaggcccatccttcttgcttcagttcaggataactgaggggccaccccagctcagaggcctctgctgcaattgcatcacagctcagcttttctctacttaatctctcttcccttactcccaagagcactctctgattaacctgtgtctcaaagtcttttccagagaatttggcctgcagcagtaggtaataaaagagagttgtatttgttaagcacatatctgacagtaattaaatatcacaactccttcttgtgtagaagcatgaaggagtttgtggtggtttatttggtaatccatgaggccggagcccttaactactatctctcctatgcttcagcatgtcagtcctcctctttttagacatatttggctattgtcttccttccagttcatcagcattcttgttgcagaagctttcccacaatagccatttttagagtacacatttgctccatttcatttacaacaaatatttttcaagacaaattccatgcctctcatgaagcaggttgttgttcttcagtgggttagaagtgggatgattcctccaaatctaccctagaatctcagatgcttttctccgagcactttccccaataataataatgactagcattagtgcttcatatgtgccaggtacttgactaagtactttagagatattaactctttgaatcttcataacaaccctatgaagaagatactattattcttattttagaaaacaaaacaaaacaaaatgataggttaaataacttaccagggtcgtataattagaaagaggtggagccacattttaaatccaggaagattggctccagaatctgtgcgtttcacctgtatgatgtgctacaaattttcccatctgtgttatcaggtggcagttatgacttttttgttgacataaatttttaacagctttattgaggtgtaatttacatataatacagttcacccatttaaagtatacaattcgatgggtttttgttcattacataattaagcttttaattgtaagaaatatataaataaaatgagctattttaaccatttttaagtatgcaattcagtgacaataaatactttcacgatgttgtgtaaccatcagtagtacctattcaaacctattttattagcacaaatagaaaccctgtaatgagtaaacaataattccccatttttaccttaccctcagcccctggtaatctctaatctactttctgtgtctataaatttgcctgttctaggtacctcattcaagtaggatcatacaatattcattcttttgtgtctggctcattttgcttagcacaatgcttttcaagtttatcaatgttgtaccatgtatcaaaatttcactcctttttaaggctgaataatactctattatatttataggccatattttgtttatttattcatctgttggtagacacttggattgtttctaccttttggctatgatgaataatgtggcaacgcacattattgtacaagtatctactttcaattcctttggatctgtacctggaagtggaattgctgggtgatatggtaattctatgtttagtttttaaggaactactttaaaaaccattacattttctatagtggctgtaccatttacattcccaccagcaatgtatgagggttcaaatttttccatgtcttcaccaacacttttcttctgtttttggttttagccatcctagtgggtatgaagtgatatctcattgtggttttgattggtatttcccaaatgattaatgatattgagcatcatttcatgtgcttatttgctatttgtatgtcttctttggagaaaagtgtgttcaagccctttgcccattttttagttgggtagagttctggatatttaacactcatgtgatatatgatttgtaaacatttttcccatttaataggttgtcttttcactctcttgagagtgtccttcggtacacagagtttttaattttgatgatatccaacttgtctattttttcttttttgtgtgtgcttttgttatcctatctggtactcaattgccaaatccaagatcaagaagatttgcccttatgttttcttctaagagttttgtagtttaaggtcttatatttaagttgttgatccatttggagttaatattagtatgaagtgggagtccaacttaattcttttacttgtggaaatttagttgtcccagtgccactggtggaagagattattctttctctattgactggtctcttcatacccttgccaaaatcccattgaccatagatgtgtaggtttattttccagactctcaatctgtttcatttgcttatatgtctgtccttatgcctccattatactgctttaattattgtacctttatagtgactattgaaatcaggaagtgtgagtactccaaccttgttctttttcaaaactgtttttcctattcagggctcttttagaatttactatgttatgcttttgtacttatcagtattcagtatttatttgtccaggcttgtattttctcttttattttgtattcacatagtggctatcaccttagaaagatttctttgcaagctgttagctaatagttcatctcctgatttataactctgctagtacaagtctatgctttcttaaacacagttccctaatccaaaattaaaacctgtcctgaccagaagctttttggaacagagactgatctggattgatataaggttattttgccttttaaaaaaatcttacctaatatgaatattcatatcttttacagtagaactattcatatatttgaatagactaagctatctgagaccttacaatggatattatatattgcatgtaaactgtattttggtttatttcccttattaaagtgaagtgattctaaatcttaaaacacattttgccctaaggatttcaaatgagtgatcgttgacctggatttttatttttgagatatatcaagaaaaaaatttccaatgaaaatatgataggtcctgtgttagagtagttcttataaaatttagtgatctttgttatgatctttgtttcagttgttatgaaagaatagttgtggtcaggtaaatctttgtggagtaaagcttgatatattgggaagaactttttactaacattatttatcacttacaaggaaccatgcacattataagaaggaagatagtagtagcagtaaaaaatagcagtgagcggtgtttcctatatgaatgtgttgcatgaagaatatgtgtgcttatcccttcatctaagaacagattctttgtctctattatgtttacaccaaaacccaacactaagattttcttcaataaaaagaaaaattctaaattcagccctcctactcccatcctttgataacactctctgccttgactggcatcaagtctacttgttgaattcacactctcaagaggacaggaagaaagacagacagataagagagacacttgtctcaatcatatagtttcatgaactaacaggtttttgaagtcctggctctgaagaacatggtcattaggtttccaaaatcaaacttgggcaataaaaaggatattgctttgtttgttttggtaccacatatactataatgggattgatttttttttttttttttttgagatggagtctcgctctgtcgcccaagctggagtgcagtggtgccatctgggctcactgcaaactccgcctccagggttcacgccattcttctgcctcagactcccgagtagctgggactgcaggcatccctgccacgcccagctaattttttgtatttttagtagagacggggtttcaccatgttagccaggatggtctcgagctcctgaccttgtgatccgcccgccttggcctctcaaagtgctgggattataggcgtgagccaccgtgaccatacaggattgatttttgaaaggttaatctgggccaggcgtggtggctcacgcctgtaatcccagcactttgggaggctgaggagggtggatcacctgaggtcgggagtttgagaccagcctgaccaacgtggagaaaccctgtctctactaaaaatacaaaattagcggggcgtggtggttcatgcctgtaatcccagcgactccggaggctgaggcaggagaatcgcttgaacccaggtggcggaggttgcggtgagctgagatcgtgccactgcactccagtctgggcaagaagagcaaaactccgtctcaaaaaagatataaataaataaataaataaataaaaggttaatctgaattcttttttaggggtgacctaccgatttgccaagtattctatgttttcaaaaaggcagcctgagaaatttcctgacttcagttattcttgaaccaccttcagaacttttaccataactgagtaatcttttatgatctttcatgtagtgctatatttgttatcttgcttaaaaaaaattgcatttaactgtcgtaaaagaaaaaaatcaatattttccaaataaatatgtaacaactaaaattaaaaatgtacatatgtttgctacctaaaatcacctcagaaaccactggaaacaaatgcaccacacttttgggaacactgccctaacgctaagtctcaaaaaattgatgcgttcttcaagaggatgtaagaattggagggaaaagccacaaatttttcttttaagtctgggattaaaaatgcattcttgctttcttagtttaaaaacaaacagctaagtaccaattgaagggaccaccatggaagtccacatatagtttctgcacttgtcattttatagaagcaatctctacatctccgctgccccagactgaaaatttttagagcagtaatttgtcataaccgttttttgtttttttttttgctttttttttggaactccgtgacgataggaataaatagtaaacaaacaaacaaaaacttgtgcctcttgttccttcgtgaacactgaagttgtgaataaaatgataatgtagagtttgtaaatattcaaatttggacttctgtctttcatgttaaattgccctaggcacttggactcaatttcagacattagtcatctgtaaaatagaggactgacgatgctagccattgatgccaaagggatagaaagactttatgcatatcgagttctagaatgacatagttggctatgtaaatcagtttgcctgatttatcataacagtgcatttaaatacaatgttcatgaaatattacaacttgtaattagaaaattgatgttggttagagaaattgtgttgactttgtcttttctaaacacttcagaaactttatttattagctttagaggtagatccttcaattaagctgacttaaagaggtaaaatgaggttattgttagaaataaaaaccaatttttcattaagttcaattaagttcagtttctcctttattatgcttgtatttaatagaataatttatgtggtatttccattaaatcatttaccagggttttataacaatatgttactagtgtttggaaatataaatacaaatctcttataattttcaatttgtgcttatattaaccattcatttcttaagctttgatcatttaaatgctttatttactagttttcatatgcttcttgtaaacctagtctcacattaagaggatgcttaaaatgccaaaatgccctggtaaattaaaacgaattcatcgtatttcttacattacttaactctgatgactacagtctagttgatacttgtaggattcaaattcataaaacctgagatattcagatcaaggagaggatagccattgggaaatgagttttttattcttatggaactgaaaaatgcggtatcacttgaaattattagtctaaagtttgccttcacgtgactaatattgggaaaaaaagtttttaagaaaactttggaaaatcaacacttttaaaattttatatttggcaccagacataattggcactaagaaaggaaataactaaagttgtgttaagataaatacaaatgttttgtttccatcttaagaagggtttttgatgtcctctggtgtagatatttactggagagaaggctattgccaatctacattccattgcagttgattttaaaatatagagctaaacaggaaatgtcatgagtgatgtgaccatctgccaagtgtaaatggagtctgagcaagtggatgtaatctgtactaaacaagcaaatgcgttggagtacagcctgaaagatttttaaatcatgaagctacaagcccaatatataatgtttattttacatactagtaattcttgtgcaattgggtttattgtaactcttgtaacaactgtgataatttttgctaagtgaaattaaacagcatcttattccagtttcagagtttccatctgatatactttagagtgcttggaattctttggtagttcttttctgaaatccttaaagttctttccctgccaagaaacctgttttcacagtaattataaatcaggaatgcaggtaagaggaaagaagaaacacaaaagggtgctttatgtaatcccacccctctgctctgttcaaaggtgccaaaaagaaatcagggattgttaaaactcatactgaaggatttatagaagccatcaaattggggacaagttacaatgaaaacttttcattgtaaatgcactcagctaacagcatgatatctcattttaataatcaatggagaaaaagttctttcaggcaaagtgtattctaaagtgatttttttcccttatggaaacatagatagaataatcatttaaataaagctttaggagtaaaatgatacactattattttagttatacatgttatatacatttttattgaaatgtagatggctacacctttatcaaattacagttttattgtttcagtgttgtttacattaacttccattaactctgttgtgattcatagtttaaaatgggccacaaaaattacatttatcatttcacaaatttaaaaaagtatcaacgtcgggctatcctattcctttaatggaccagtttaatgcttagtaacataaccctttaaagtctacatgtcaaagatagcatttttacttgaagaaagtaaacataaaagaactttaaagttttagtatctgtttccttaactgattttaatggacttccaaaacaatcaagggcagtgggtggcctcttacttgcagaagccaatttttaagtgcatgtgtttcttttccatgttgacctcttgctgggacatatttgttgtcttttaaaatgatatttgctaaattagcttattgaaatgctaaatcatgatatgttgcttttcagccatcaatttgaaattccacgctttataaatttcaagtgatttaaaaacactgacttttatattcatgctcagataacaactgcatattacaaatgacttgtaaaggtgtgtggatcttccaataatgattgtattacttgcatgttattagcattaaagaacatgtatcatttacttattctttcatgcaaatgtattgaaggcatgtacatttattgaaggactgctgtatgagccaatacagcgtatttttgttaggtacctaatttgtgtgaggccctttgttaaatgcacttaatgccatatattatttagttttcatcataactttgatgtagtatactgtttttatcttcatttaccaaatgaggacatgaagacaataaagagactcacccaagaacatatttttaggaagtggtggtttaatgatggaaactctcatctgtctgactttatgtacagctatggtgcacagtagcagtctataaaatctatcttgtagaattcatggttttctaaaatactactgtggtgatgatagttttctctctattgaattctgccatactctacccacagattctgctttctcttctctgatggcaatatagtttggatatttgtcctcatgcaaatatcattttaaaatgtaatccccagtcttggagatgggacatgatgggaggtgtttggaatatgggggcagatcactccttaatggcttgggccatccccttagtcaaaagtgaaccctcgctgctctgaattcataggacatctgatcatttaaaagtatgtggcacctcttttctctctctttctctctctctcttgctcgcttctgcttttgccatgtgacatgccagctccccttttgccttctgccatgattataagtttcctaaggtctcatcaggagccaagcagatgcccagcatcatgcttcctgaacagcctgcagacacatgaatcagttaaacatctcttcattataaattacccagtatcgggtgtttctttgtagcagtgcaagaacagcctaatgtagatggcttttctctgtctcctttgcttcaaatgcagagaggcagtactagagacagaaactgcataaggctatggccttggatgacatcaccaggagtgtgtgatgcaaaaatcgggttgaggctagaaaccggagaacaccagtaatagaatcaaaattatgctttaaggacatgaatctaacagcaggcgtatctccttattgatgttctctgcttactcatacatcattctcctgaatttcttttttgtccatagttttcttcagctttttcaacataagacaattaatttaaagtctttttatagtctgtccaaggctaggcctcctcaggagtagtttctcttttacctgtaaaacagtatgaatgtgccatacttttctgtttctttgtatgctttgtaattttttgttgagaactggacattttgagtatcataatgtagtaagtgtggaaattcttccccctctccaaggattgctgttgttaacttgatgaaagctgcagttgtccatttgtttaacaagttttttctattttttttcaaaactatattctttgtcatgtgtggtcactaaagtctctgttccattatttttgcagtcagccagtgatcctacagagaattccttgaatgcctagatccaataagaaaatagaaaaaagtgtctatctttttaagttcctttgacagctgctttagcccaatagggttgaaagaatggccagcctctgtgcttctgtgccggtttctcaatgaacagccaagcatataaaaacacacaagcacaattgttggaggacaacgtccttattgtccactctagcaccaacaagccataccaagtacatggtcttatctccctatggctgccagcttggagctggggctaaaggatggtagctgctttgtgaaatgccaaaattcattgaaatttgccatgcctctttttccctttacactctcctcatgttgcaagtgtctcaccagacttcagagtctgaaatactatagtttattctgacagttcttgctacctcaactgatttcagtggagacatcaattcttggagcttcctattcaaccgtcatctgtgacataattctattttccttttttccctttggttcattttaaaatttctttctacttttttttataggtgacttttatgtaagtaggtttttttttttttgagacagagtcttgctcagtcacccaggctggagtgcagtggcatgatcttggctcactgcaagctccacctccagggttcatgccattctcatgcctcagcctcctgagtagctgggactataggcgcctgccaccacgcccggctaatttttttttgtatttttagtagagacagggtttcactgtgttcgccaggatggtctcgatctcctgacttcgtgatccacccatctcagcctcccaaagtgctgggattacaggtgtgagccactgtgcccagccttatgtaagtagtttttattaatttggaattttaagtacacttgactctgaataatgtggtagttgggactctgatgtcaccccacacagtcaaaaattcatatatgacttgattttacaaaactttattaatagtctactgttgaccagaagcattactgatactgtaaacagttgattaacacatatttgtatgttatatgcattatatactgtatcgttgcaataaagtgaaacaaaatatcacaaagaaaatcatgaggaagagaaaatacatttacaatgctgtactttatttgtccgtaccataagtttacattgccttttcagaaaatgaattgtctgtcagaactagcaggccatctgcagccgcagacctcaatctatggcacatctcaagcaattctatttttttttaatgttgtgacttctctgcttcttgcaaggacttccggcatcaccagtggcattttatatgggtcccatggtggttattcaagatttatggtatcacactaaactcagtgaaaaatacatgagaactgagacacagagagagagagcagtttttgtttttcatttttgagatagagtctcattctattgcccaggctagagtgcagtggcgtgatctcggtccactgcaacctctgccttctgtgttcaagtgattctcctgcctcagccccctgagtagctaggattacaggcaccctccaccatacccagctaatttttttgtatttttagtagagacggggtttcaccatgttggccaagctggtctcggactcctgacctcaggtgatccgctcgcctcggccttccaaagtgctgggattacaggcgtgagccaccgcggctggccatcggccaattattattattattatttttttaaagagatagagaccagcgtagccaacaggcgaaacctcgtctctactaaaaatacaaaaaattaaccaggcatggttgcccttgcctgtaatcccagctactcgggaggctgcggcaggagaatcgcttgaacccggcaggcggaggttgcagtaagctgagattgcgccactgcactctgacctgggcgacagggcgagacttggtctcaaaaaaaaaaaaaaaaaaaagacatagggtctccgtcaattgcccaggccggagtgcagtggcatgagagagatcacttttaccatgacgtgcaaattatgggagagataaactgttcacatcgagatgattggccacactatgttttaagaagatacttgtaacatttgagctcaatgcaggggcaacgggagctggctatgaaattatgataatggtacagtgtacactacagttaatactgcatttttacatttgcttatatttctctcaatggcaaatggcaccatgtacaatctattagtgttaaattttaaccataagcatacttcaaaataataagagccatatatgacaaacccacagccagcatcatactgaatgggcaaaagctggaagcattacccttgaaaactggaacaagacaaggatgccctctttcaccacttctatccaacatagtactggaagtcctggccagggcaatcaggcaagagaaagaaagggcacccaaataggaagagaggaagtaaactatccctgtttgcagacaacatgatcttctatctcaaaagcatcatagtcttagcccaaaacttcttaagctgataaaaaacttcaacaaagtcttaggatacaaaatcaatgtgtaaaaattactaacattcccatacaccaacagcagtcaagctgagatccaaataaagaagaaactcccatttacaattgccacaaaaagaataaaatactagaaatacagccaactagggagttgaaatatctctacaaggagaagtataaaccattgctcaaagaaatcagagatgacacgaacaaatgggaaaatattccatgctcatggataggaagaatcaatataaaaaagaccatactgcccaaaccaatttatagattcagtgccatttctattaaactaccattgacattcttcacagaactagaaaaaaactattttaaaatttatttgaaaccaaaaaagagccagatagcaaaggcaatcctaagcaaaaagaacaaagctggaggcatcatgccacctgacttcaaactacattacagggctacagtaaccaaaacagcatggtactggcacaaaaacagacacatagaccaatggaacggaatagagaacccagagataagaccacacacctttaactatctgatcttctacaacctgacagaaataaacaatggggaaagattccatgttcaacaaatggtgctgggataactgactagccatatacagagattaaaactggaccccttacttataccatatacaaaaattaactcaagaatggattaaagaacttaaacaaatgtacaagaaacaaacagacaaccccattaacacatgagcaaaggacaggaatagacacttttcaaaagaagacatacatgcaaccaacaatcatatttaaaaaagcacaacaccactgatcattcaagaaatataaatcaaaaccacaatgagataccatctcacaccagtcagaatggctattattaaaagggcagaaaacaacagatgctggcaaggttgtggaggaaaaggggcacttacatactgttggtgggagtgtaattagttcaacaattgtagaagactgtgtgatgatttttaaaagacctagagacagaaataccatttgagctagcaatctcattactggctacatactccccaaaatatcagttgttctgttataaagatacatgcacatgtatgttcattacagcactagtcacgataacaaagacatggaatcaatctaaatgcccatcaatgatagattggataaagaaaatgtggtatgttacatcatagaatactatgcagccataaaaggaacaagatcatgtcctttgcagggatatggatggagccggaggccattatccttagcaaactaacacagaagcagaaaaccaaatgcctcaagttgtcacttataagtgggaactaaatgatgagaacaaatggatacacggaggggaacaacacacactggggctaatcagaagctggaaggtaaaaacagagaggatcaggaaaaataactaatgggcactaggcttaatccttgggtgatgaaataatctgtacaacaaacttccatgacacaagtttagttatgtaacaaacctccacatgtatccctgacttaaaataaaaattaaaaaaatttagccttctataagagatctgtgtatattgtagcaacatggatgcagctggaggccattatcttaagcaaattaacccagaacagaaaaccaaatattgcatgttctcacttgtaagtgggagctaaacactgggtacttatggacataaagatggcaacaatagacactgaggcctactagatgggggaaaggagggaggtggacacgggttgagaagcttactattaggtactatgttcactaactggatgatgggacatttgtaccccaaccctcagcatcatgcaatatacccatgtaacagatctgcatatgtactccctgaatctaaaataaaagttgaagtcatttaaaaaaattaagttttctgccttaggaatgcgacttctttttttttcaaagtaaaaataacctccatgagacttttcttttaatttcatttgttattctattcccatagaatacatttttatatttcatcaactccatatagactttctgagtcctaaatggaaactgagatatcttcaactagataattgaacttgatatatttcaagaattgttatgtatttcaaaattttacagatacaaatatttttatactagttccttttgtcctccctcccttccttctttcctttttcctctctccgttctttcctccttccttcgttccttttattcacatattacatacataatatcacttgtatgtgtaaatatatgcagttagacttttctgaaactttatgtgacttcaaaagattattctaattcattatgtagatcaaaaagctgatttcctttgagagggttttaaatattataaatgacttagtatgcagaagctggactttgccttgttatatatgataattaaatacttgatttcaaaatatataaattaagatggaaaattatttaaagattgtgtgaacctattattttaaagttacttaaaaatataatttctagtcatcagaaatattttatggttttgccatgagttaaatattagtccaaaatgaatctacattttgttataatgtatatgcctgtttggactgtctgttcctaaatttcattctccccagctctgtagtcccttagctctattatgtggctcccaatggagtcccaccttaggtttcttatattgacggcaacttggatgcatgcctcttaagctgacccatgcctgactctgccctgtgtatgaatttgtgtctgcttgtagatctctgcagtatagctctgggtcagaagcatttccatagttaacctcaagcctgtgcctgtccagactgtctgtggtacccatggatctctagaatactaaaggcttcactgacatgttgaatccaaactcaccatatattaagtaaaaccaggttgagatcttaaaatgtgtttatcctcccaacagtaagctttttagacccgagaaagtggagagatataagagagagattatcattacagtttagaggagtgtatctcattgaaatattgttaaatgagagctgatcaaaactaagatatggtttcacaatacatgtgaaacacatttaggtcaggagtttagaaaacttctgaatgagcatgttaacaagaatattgatatggagtctctttctttcataaggaatggaggaatggcaaacagaaattaatgtttgaagtcaataacctagtgtgcaagttctttatgatctaactccatttcattttataagcttctttcactgtctaccctttagctatgccaagggtcagaaaattgaatatattctgtcttccttagtgtatttgttttttctccttttcacattttcttaccttagttcctctgcctggaatctctttctgctcatgactgtaagccatgcgtaatatctgctctttcagactcagatcatcatcttgtgcaaagccctcattcctccctttctttcccagctcctctctcccaccaacacagaagtaattcctctttcttcttaattcctactgaaattttggcatgagtataatttcttacagttttatatcatggcttagtctcattattgcttgccatatgtgaggggagttgttatggactgaatgtttgtgtttccccagaattcatgtgttgaagccctaatcccaaacgtgattagattaggatttgagagtctttgtcaggtaattaggttaagatgatgtcatgcgggtggagccctatgttaggattactgtccttataagaagaggaagagacaccagagctttccttctctaccatatgaggacacagagaaaagttgaccacctgcaagtcaggaagagggccgtcactaagaactgaatctgccagtaccttgatcttgtacttcctagtctatggaactgtgagaaataaatgtctgctgtttaagtcaaccaatctatgatttgttatagcaacccaaaaggacgtgtagaggaatattatgtcctatgaataccacagtagttttagtatacatggaatcagtttgtcaattgagattgtgttgaatttatagatcaatttaaggaaaattgacatctttgagttatcaagcctttcaacccatgaagatggagttgctctccatatatttagatcttctttaatttctctcagcatcgctttgtagttttcagtgtataggtcttatatcttttgtcagatttatacctaaatattacatatttttgatgctatggtaaatggaaaaggtttttattcaatgttaaactgcttgttgctagcatgtagaaacacattttttaaatattgctctcataaattgcaaccctgctaagcttattagccctagaagcttttgcacagaatatgtagatcttctacatagttatgttttacttcttcctttcttatatgaatgcctttcttttttctgcctttttttagtgtcttatattgccttatcacaatggctagagctccccatacaatgctgaatagcagcggtgtgaggagacatccttgccttgttcctaatctcaggggtaaagctttcggtctttccccattgggtataatgttagctgcaggttgtttttaaaaaatacataaaatgtgcctattattccaagtttgctgagaagttttatattttccttaatcaggtattgatgttggattttgtcaaatgcttttatgcatctattgatatgattatatgtattttcttatttgtcctgttgatatggtgaattatatgggttgacctttgaatgttaaaccatcattatattcctagaataaactctattgtgtcaaaatatgctatctttttaatatattgttggatatgattaaaattttaagattttttatatatattgattagggctgctgacctaaagctttctttttttaaatgtcttttctgatgttgatagtagagcaatgttgatctcataggatacgtcaggaagtgttccctcatcttcaactttctgtgagagtttgtgtagtattggtattattttctcttaaaatgtctggtggaattcatcagtgaagacatctggtcctggagtgattattgattattagtttgttttttgtgggggaaggtttttaattataaatttaatttttataatagatatagggctatttgtattttttgagcaaggtttggtagttcaagttttttaactaatttgtccagttcatctaatttgtcaaatttaggggaacagagctattcataatattttcttattatccttttaacatatgtaatctgttaaaatgtcatttctctcagtactaatttttgtaatttgtgtctttattttttttcatgatcagttggctagaaatttaccaatcacattgatcttctcaaacagcagcttttgatttcattggtttttctctgtcattttgttttttatttaattcatttccactttgatattcagtatttattttcttctgctcattttgtgtttcatttactcttctttttctggtttcttaaagtggcagctaggtcattacttgatacatttcctcttttctaatataaatatttagtattacaagtgttcctctaagtacttctttagctgcaatccacagatgttggaatattgttttaattttaatcaactgtacatactttctaatttctcttttaatttcttctttgactcatgggttatttagaagtgtgtaatttagtttccaaatatttgaggattttccaagcatctttctgtcatggattttttatgtttatttttgtttttagagacagggtatctctacaatgcccaaggtagactacaactcctggactcaagtgactgttccacctcagccttccaagtagctgggactacaggtgtgtgccactgcacctgctatggatttctaatttaacttcattgtgataggacaatatacttagtatgacttaaatccttttaaatctattgagacatgttttatggtccatggtgttgtttgtcttggtaaatgttccatgtgcacttgaaaaacatttgtactctgctgttagtgagtagagggttctataaatatcaagtcaagtggttgatagttttattctatatccttactggtttttctctacttgttctattaatcattcagagaatggtgttgaaatctctatcattgtggatttgtgtatttattcttgtagttctatagtttttgcttcatatgttttgaatctttgttattaggcataaaagtctaggataattgtctccttttgatgaatgaatccttttatcatagtgaaaccttctttattcttggtaatatcattttctctggaatctacttttatagccgttccgattttcttgtattagtgttagtatggtatatactgtgacattcttctaacttttttgtgtctttacattaaaaggggattatctgtatcagcctatagtttggtgttgatttttaaaatccaatctgggctgagcgcagtggctcacgcctgtaatcccagcactttgggaggctgaggagggcggattacgaggtcaggagatcaagaccatcctgcctaacgcggtgaaaccccgtcactactaaaaatacaaaaaattagctgggcatggtggcgggtgcctgtagttccagctactcgggaggctgaggcaggagaatggcgtcaacccaggaggtggagcttgcagtgagctgagatcacaccactgcactccagcctggacgacagagcgagactccatctcaaaaaaaaaaaaaaaatccaatctgatagttgttaatttttaattggtatatttagaccatttactttttttttttttttttttaattgagatggagtctcgctctgtcgcccaggttggagtgcagtggcgcaatctcggctcactgcaagctccgccttctgggttcacaccattctcctgcctcagcctccagagtagctgggactacaggcatgtgccaccacacctgggtaatttttgtatttttactagagatggagtttcaccatattggccaggctgatcttgaactcctgacctagtgatctgcctgccttggcctcccaaagtgctgggattacaggcatgagccactgtgcctggctgaccatttacatttaacataaatattgatattgctgggtttgaacatacatcttgtttgttttatattgttggcttattaattataagtcctttatagtggttgcttatagtgtgcacatttaacttatcccagtctactgttcaaaaataacattgtagtttatgtatgtaacaagctcttaaaatagtatattttcatttttctcctttggctatgtgttatttttgtcacactattatctttacataaattgtagaccctacaatacatcgttataaattttgctttaaataatcagttatctttttccctttcatttttagttgatacataataattgtacatatttatgggacacagagtgatattttcatagatgcatacaatgtgtagtgatcaaatcagagtaattaggattacaaacatttattttttttgtgctgggaacatttgaaattctctcttctagatttataatatatacaataagttattgtcaactatttttctccacagtgccatagaacactagaacttattcttttctagctgtaattttatatctattaataaaactctgtcttctcctccctgctacatttcccagcctctagtaaccataattctactctttccttctacttctgtgagcttttttgttgttgtttccacatgtgagtaagaacatgtgttacctttctgtgcctgagttatttcacttaacataatggccttcaggttcatccacgttgccatggatttttcattttttattgataaatagtattttattatacttgtgtgtgtgtgtctgtgtgtatgtatcaatcacatttgctttatccacttatctgtggatggacatttagatgaattacgtatcttagctattgtgaatagtgcttcaataaacataggtgtgcaggtatctctttgatatattgatttactttcttttgaatgaatacctattaatgggatttctggattatatggtagttctatttttagttttttgagagatgtccatactgttttctataatggccatactaatttacatcccaccaacagtgtgtaggagttctcctttctccacatccttgccagcatttttttttttttttggtctttttgataatatccattctaactggggcgagatgatatctcatgtagttttaatttgcatttccctgatgattagtgatgtggagcatcactaaaacaaatttgatgtttaaacttgttgggcatttgtatgtcttcttttggaaaatgtttacttagattctttgcccatttacaaatgggattattttttatttgctatcaaattgttggagctccttatatattctggatattagttccttcttggatgaatagcttgcaaatattttcttccgtcctacaggttatctctttactatgttgattgtttcttttgttgttaatagtcaattatcttttaaaggtatttcaaaaataggaaaaacatctggtatatttatcatttccagtgctctccattcgtttccatccatatttccatttagtatcactttctttctgtctgaaggtcttccttttatattcctttttttaaaattaaacagcacgccctgttcataccattcctttagatttcttataatgtagttctgttggaagtaaacccattcagcatttatatatctaaaaaagtttttatgcctcaatgagtattttttttttttttttgaggtggagtctcactctgtttcccaggctggagtgcagtggcacgatctcagctcactgcaacctccgcctcccgggttcaagtgattctcctgcctcagccttccgagtagctgggactataggcacacgccaccacaaccggctaggttttcttttgtatgatagagacagggtttcatcatgttcgttaggctggtcttgaactccttacctcaaatgatccatttgcctcggcttcccaaactgccaccgtgcctggcctgaatgagtctttattttatcttttttaaaaagacattttactaaatattaacgtctatgttgacaggagttttttctttttctatgctttagatatcccttcactgtttttggcttgcatttttcatggagaagtctgctgtcatttttatctttgttacgtaagatgtaatttctctctagctacgtttaattttgtctttatcacggtaaataatttgatgataatttgctttgttagtgttttcttcatattgcctgtgcttgtcgttcttgaatttcttggttctgtggatccatagttgtcatgaaatttgaacatttttctctgttgtttttccaaataaattttctgcccctccctgactttggggatgcatattaggttgtttacatgcatgcatattaggttgtttaaaattgtcttacagctcactgatgttctgatcatttaaaaaaattcttttccatcctcttctctgttttattttggatagtttctgttgttgtgttttcaagtttactatttttttctgtcttatctaatttgtttttagttccacctactgtatctttaaatgtcatatattgtattctcagttctagaattagatttttaaaaatctttcctgtttttatttaacatgcttaatctttcttctgtctacttggatgtacagaatatagttacaaagatttaatgcccttgtctactaattttctcatttctgtcctaagtatttgtattgattaatttttctccttgtaggttgtatttttttcttgtcttagtaagcattgtaattgttgactggatgagagacattgtgaaatttataatattgggtgctaaatatttttgaatccctatcaatatcttaacttttattctaggattcattggagttactggaaagtagtttgaccctttcaagccttgcttttaaggtttgttagacagtaccagagcagattttattctagggctaattttccccactactgggtttaataccttttgagtactctccctgatgacccgtaaattatgaggtttttccattctggctaattggaacataaactttccccagtcatgtttgaatgccagatattattcctctcaggtagttttatcatatgcatgtgctgatcagtactaagctgaaaatacaaggggatactgcctgtaaatcttgtagctcttctgtatatcctttcaatattctgccagtgaactacagctgtcatggcatttctgggtgccatactccatttcctcaactttaaaagaatgtctggatctacctccgttcctcctccctacactgtcatgtggaaaatgtctccgggcagcaagatggggcaatcctagggctgattttatttgctgcttttctctcagggatcactgttctgtactgcctaatgtcctatgtcttgtaaatcttgagtcatatatgttgtcttatatttttagatgcttcagactggagtgtatatctggttcctgttattctatcttgtccagcagtggaagtccttttaccatatttatactctactgtgagtcataatgatctatattaataatatccattagtacttatgatgttaatggtaaatgttctttggtgtggtaatgccatatgatttgctatagactatcatcattacagagatgcaggctgtatccacatcggtctatacagacttcaaccgacttggttgaagtggctggtcaatttaaactcttgcctaattctatcaaaaactaattttcgtgttcttcaaatcaattaatcattccataaattaactaaattgagcagatttctgagtatacgtgtagtctagttatattatttatgccaagggatagttctggaaactgcatatttccattccagtaggttgattccatgtgtttgctattgtgaatagtgctgtggcaaacataggtatgcatgtgtctttataatagaatgatttatattcctttgggtatatacccaataatgggattgctgagtcaactggtatttctgtctttaagtctttgaagaatctccacactgtcttccacaatgactgaactgaaagagcaaattttaattgttactgtatgctttctttactgcctgaaatttttgtttgtgtattttacataaataaataaatagaatcacacagatattgtatttttttccattaatccaaatatgaatctaaataagtcacacttatttcttcttgggtgttaattgccttttttgacaaccattcatccaatcagtgtgtttattctgaattgactcaattcaagtaaaacactcagcatgtgatttcctttttctttgtaagtcccctgtcaacactgatggatgtcattgtgaaaaggcatctcatggtggttttgttggttcacagatctgtctgtttttttttccccaatacaaatttgagtctgccatcatatactttagtttcatctttgttgtaatctagattataattgttttatttcatatttatttccccttctgctagactatcatactgatcttgtatgggagagggtgtgtcagtactgttgcttcctgctttagatccacaaattgaagtgccatccaccagctgttacattctctgaacaggcagcttgccaacaaaccagagattttctgatatactgcaggctttgtcaattattttaatatacttagatatagaaatattttcatggtacagagtatgtattagctgttttccttgcatcaataaacagctattatagttcaattataagtgtatgtgtatgtgtatgtgcatgggtatatatgtctcatgctcagtgtcttctggctttaatttgttgcctggaattaaaaattatgaactctgaggagcagtggcttttttgtgttagtgttgttttctaaaacacttaagttctggttgtagtttatgcaatttttagttgctttgaaaatatgacacagaaagtgttctggaataaaatgtacccaagagaattgtatttatcccattcatttgctgctcatccttaattcttgccttttcatgatctttataaacacattgctctaaatattctagcttgggttttcttagattaagcattttatgccagtggtggtaaaactgaaaaggaaggttcacatcataggggaaatgtatgtgtgtacgtatgtatgtctgtgtctgtgtgtgtgtgagtgtgtttgtgtatgtctgtggggttttgctacaaaggttaaatcccagaaatgttatgatagtttatagaaaatgtgtctcagttacagctgagttaaataagaaccctgaggtaatgctctaagaaaaatgaacacttgatgcccttttctttagtgtccccttagagttgcctaataggatcttagtgaactaacaatcataaacagaccaatagaaagaaaccttcttccttagaggaaaaacagtttcagagtcttggggtattcagtttgctcatgttgttagaatagtttcttttgccaaacactgaacattggggctgtgttttcttgttcaagaaggaggaagaggctatatgctaatgacagaaggcagctacttgcatgggtaatagactcaaaggaatgtaaatggctttcataaggcaaaatatctcgtgtataaacacttcaaaatctagaactcatatttcattaacaaagatattatttccttgtcttatttaaaactcacaagatattttaaaaattatgtttgatattgggatattaaagaaattcttttattttggaattttctcaagatgagacaaatgtagaattatgcatttgtttaaataccaatggaaataaaaaaatcacttctaaggggtccataaacaatgcttattgacttactggctcattgtacccccaaacactgacattgccatgtcactggatgatttttcattaattaaggaaaaagccaagtactttatttacaaaaaattgttaattttgacattaccttaatgtctttttacagatgtaaggcattttacacatccccctgccctcaattatttggttggctttattttaaataaaaatcaagggatggtattttttttaaaaagcccaaagtatataaatgtgaaactcttcagtaaatgatcagaacttaatatccagtttgctattgaaacattacaaatcactaactataaaggttgaaatagaattgcagcatcagaaataatattttagctttagaaatacaaaccagaaatacaaagcagaaattttgttgcctgtaaaatcagtactacatccttttatggaatagaagatttctttttcacagagtattctctggagccaaatacctgggttgtcaaaaatgctgcaaaatgagaatttagtttacagtagttgcaattgggcagtgtaccctaattgacttggaactagaaatctattaaaaggaagcctattaaccagatctcaaaaattcctgtagataaagctctagcaaatatgagcttacaatcaaaattcataaaacatgcaagagcccaagataccctaaataatataactattggaaaaatcagatatagaataaaaatttatatgtttaatatgataaaaaataattaggggagttgaaaataaaagtaagtaaattagaataaccagttaaattggacaaacataaacagaactataataaattgaaagtataataattgaaactgtagatcagaccgtggaatgaaaacatgagtgaattagggaaatatagatgtgaggaaattcccaataaggcagaagagaaagatagagacacaacacatgaaagagagattaaggtacattaaatatagatttagaatatatatctagtcagagttccagaatgagataataagagaatagggtagaggtagtatttgaaaacataaaggctaagaattttccagatatgattaaggaagcacatgtatacaaagcaagagaagtcaagagaaatctaatggggcaggtgcggttgctcatggctgtaatcccagcactttggaaggctgaggtcggcagatcacttgagtccagaagttcgggaccagcttgggtgacatggggaaaccccatctgtacaacaaataccaaaagtagctgggcatgctgacacgggtgcctgtagtcccagctacccaggaggcggaggttgcagtgaacagagatcatgtcattgcactccagccggggtgacaaagtgagacccccatctccaaaaaaaaaataataatatattgaaaccctgaaaaaccttagtggaactgcacatcaccaaaggcagagaagatttctaaaatagctagagaagaaagacatgacctaacaataatgagactgacagctggcttcacaatagaacagaaaccagtgtgacagctatctttaaagttaatattattttaggaagaaaaagcagagcagagaagcacaaaatgcaacactagaaatgaatccaaatacagtatctatcagtaattacaataaatttatatggactgaagtcactaattaaagaaaaaagattgttagaataaaggcatatttaaaacgtacagaatatttaaagttgaaaaaagaaaaaaaatatatattccaggcaattatcaactgaagaaaggtaagatagctatgattgtgtcataaaaaataaaatttaaagtaagcatattactagagttaaataattctaaacttacatgtatctaatatgaagttcaaatatagaaaagcaaaaattcacaaatccaagaccatgttgagacttttgaagactctgtaacagtaatttatgtactaagctaaaaataattttagtaagaagatttgaaggaaaacttgagtgatcggttagcatttaaagcaacttgacaatactacagaggtggttatttagtaggaagacttaaccaaaaagccccttttcggctgctatgagactttaaatatgtttatgtctgactattatggaagggtttgttaatggaaattaggaataattttcttctttagtgaaataagttcaaaatatgtgtgttggttagaaatatcctataggcatctccagtctgaaacaaagaggatttaagaatctacgggagtccagtaggctattggaggactttgtcctactctgtgctcagccatgttcaggtactctgtcacttgaactcattagaagattagctaaatactgctgctagaatggagtcgtatctgcttagattattttatgtaagattcttgtcagaatatctaaatgtgcagaaagctgggacttcattggtctttcatcatggcctatgtgactggttttttgcttgcttacaaattcatatttgtacctatggttaaattcagtctcagatcttgtatttctatcataccatgcataattatagttttattggagtggagatctaagtatgagctctaaatattttgtgcaaaaaagtaataattgtgaagaatctattacatataggtagtttacagcactatggtttcaattcattgactagaggtcagaatccaaaataacttgagccattactgtggaattttattttctgattttatctaataaaaaaagagacttttgtcaaaacaacagtaacttgaattattcctgtggatcataactggacaatttggactgatggaaaatgagaatatttattaaaaatgtcaaaataggacaagatcttagaggatactttcttttatataatcatgaggacctgtttgacaaaaatttgctcctctctgacctatcttatgggaagtactccaacaatggataagatgtacttattcttcatcaaagtaaccttttatttgcataaaatagcagtaaataggatagcagtaaaagttctgtaggtttctttttgaagtatgcactacttaaaattatttaaatatcaccttttacctatggaaaaggcaaatatgtatttccttttacatatggaaaaggtcctggcttagacgtgttctgattttatattcttgtaagtcaagatggagagttgggtagagaataagggaacctggtacaaagaatgatgtgtgaaagaagatttttagaactagaacagtgctagattgtatcaatattgtaagctatttatatacagaaactgtttgagacagctatttagtctccttcttttgaacttctgcaacttttcccccttagcattgtgtggttagctatcttgcccttatcttttcaactaaacagatgttacattcctcaaggataggaagacattgtctttggctttcttatgtgcccatccttgccagcccattactttgcagatagtaaatacctagtaaatatttgttaagtgactaattccctgaaactcaccatctttgtcatgtctcagtaagtcattctgtaaatacttcagcatatcacatattaatcattgacatttcagaagcaaagagagagttctgatgatcccaaaattaagtttcatttctttgtaggaagggctcagccttcttcaattttgtgtcccctaacaccttacaaagagcctttcttggaatgggcttttaatatgaagctgttgattgcaaatgtgggttctgttatcatgagaaactgtattgcatccttgcagatagttttatagtcctaatggtctacaggccttttttagccaccatatttttaaacaatccttttattcagatctagtgatattactctagtggcaatgaaaaaaaaaacatggtaagaaagtatagccctgtttctactggatgtagatttaattttcatttaaagtctttcttaccctgctctattttctctatttttgttttctcttggggtttcatctgttcatctgtgggtctgtatttatttatttggcaggtataatctttcctttcctctccctccccctggcatctccttggaagctgctcttactttgtgtcaccctaaagctgatggtgactctgttttctggcttcaaaagcagttttatgcacttttttctctctctctctcccactctctatcttttttgaaatgagctgtctttgattatagtttgacagtgtggtctgactgctaacattgattcccagcagtgaacaactttgtcatattgttcaacattaggtttcgatgtgtcatttaatagactaaaaagccattcccagtaaaatcgaattcctgtgggaatcattgttaaggacgctctcaaaatgaagtaaatatgtaatgctttagaaatttcactggaaaggcatcaggtgactacatttactgaaactaccaatgtcttagctggattttatattctggaaatgcaatttacaacttgcttgcctttatttaggcaaaatgtgattcacaataattaagctttatgagcttcttcacttaggcaggtcaaataatatttttattttgtttttaactgtaagaaaatacttgctctttcttcacatttctatatgtgaacctaactaaattcaggtctgggcccagaagtgcctgtcccatttcaggctagacatgcagtatcactaaaaactaatatttaactgtatgctatagtggtggaaagagcaggccctgaaaccagactgtatgggttcaaatgccacctttggcatttactgactttgtgacttttagtgttatgtaacttatctgtgccttagtattgtatctataaaatggggatagtgcctcctttataggattgttggataagagttaatacacttgtaaaatctgtgcacacttagtgtgcatgaatcatattaagatttcagtattatttgtcatgcttattatgctgttttgtttttttgtagttgacaatgtccaatatttatttagagatattcctctgtcttatatctgagaaggatgcagaagtagaaccaaaggctatcctcttcattgacccagcagtttgtttctcacaccaactttgcataacactcgctaacagaatgaaagcacttcagtagaccacaccaactttccttgggtggcagtgtggaggccccttgtgattacttaagtatgctcccgagagtctgatttccctttgccatcaattcctttttgagataagactagaaatgttttccacatgtctttaaattttcagcgaacatgtttttcttacctggataggccatattattactgaggttcaactgccaggatctcagtccctgcttcagaggagtataaacatgggtggacccaaagagaagccaagtgggtagcgcccactaagcatttgggcatctatattggttcattagccatagagatggcatttagataactattagttgaataacatcttactctttgtgtggaatcgttttataggcactggctatttcagatcaagtaaagtttacctctagagagaagcttggttgattccagagaagaagtctttatttgcctcagattcttaccctggcaatgaactatttttagggctgtttgtagtatgtgccttagacctaggccttgagtcagtcaaagtaaccctgtctatcacttctgtgtcttggctaaactactacatatagagccttcactcctgctgcaactcttgcccatgtcaagcacatctagagcttagtcctgctggtacctgacatgaattttgaacctgtttttgtctcctgttttgtcttactttgccgtgggctgtctttgcctgggcttgctctacgctcttcttctaaggtctgttttggcttttttttttttttttttccaaacgtatcccctagtgccatgccaggtaagtgataggtcctcagtaaatgtttatagaacagaaatgctggatccccctgcaatggaagcttgtctaatttgctgtgaccttgcattcagctttgacttctgtgatggtatccctacaactgtacttctcaatgctcagtaagctcttactaagtgccaggcactgtgtatatcactttgtattcagaatatcattttatcctctcatgaaaccctatgttattggtattttattattattattattattccctttgtacaggtgaggcaaccgagacccagagagattaagtaactcacccagagtcatccaggccaagtaaccatcgatgatgggattgaaatccatgtctatctgaatgcagagacagatcataacctctactgggttgccttgtatatcataccatttagaaaatagcatgacactttgagtcagctgtcccataggcagagtttatatttcatctggttgggccaaatctccaccttatcctaaccaggttttgtgggctgctttagctgcacttgctcagatggctataaacgtgaggcttagtgtccttaattgctgctcgggttggagagcgcattgatacaagaatgctcaaagactaagccactgtttgtgggatggaaactccaactgctgaactgaatcagatctgccagcatctttagaagaaacatgaaagtatagcagagctgtagctcttcccatatctccaaagcattcacccgtcctgtgtaggtagacatgaaagtttttatttgcaagtaccttctactctttcttgagggctttctctggctcctgaagccaactcagcttggagggagagagggagtagatcagaagtgttggggagttgaaacccaggagatgtccatcaatgattggcaagagtttgtagattaataccctagcttagtttctatcaaactgtagcatgcttaagaatcttgaaaagttgtttaaaaattagtaggttggaggtgaggcccagagtttgcatttcttttttttttttttttttgacttttattttagattcagggagtacacgtgtaagtctattacatgggtaaattgtgtgtcactggggtttgttgtacaaatgatcctgtcacccaggtagtgagcatagtaccctgcagttagtttttaaatcctcactccacttccaccctcccacttctagtaggccccagtgtctgttcttgtctttctatgtgtactcaatgtttagctcccactcatcagtgacaacatgcagtatttagttttctgttcctgtgttaatgcgtttaggatgatggcctttagctgcagcatgtcaactgcatgttgctgcagtggacatgatttcattgtttttttgtggctgtgtactcagaatttgtacttctaataagcttccaaatgatgctaaccttcaaaccacattttgagtagcaaggccctgttgcctcccatttgggataaatatgcagtatagggtatgctgtaggttccttagcaggattgagctccagttgttgataaatgtaaactgtttaataataaacactttattatctcctttggttttctttctgacttccctacttttctatcaatgctctctggcatcagcatttacacaaactgctcaactacaaacactctcatgcttgtctcagtgtcttcttctggtagagaccaacctgagcagatgaccataccaacttctagaatggaaagccctacccagacagtgggactgtctccagtcctccagcctcaggattttggccgacttgaggtcactctcatggatcccttccagaaaagtatcactgggcatgaggtagtccaggttgagagagtgtattgatcttaaagtgtttgctgatgacagcatagctggcattcttccctgggggaattgccaggacccttatttgagaaaaaggtactgtgttctttctctagtgaccatagggcttctaaacttgatatgagccaagattgcccagtattctgggatagattttttttcttaagggttaaaaaaagagagattcaaatcttcaactctaagaaatctatcacacttttgaggatccattagggataagggttagggagtagttagtcaccggcatgctttcactctgaattcctgctcccagctgaattcccttaatgttttctctctaccagctcctaaagttttctctggttctcattaaccccgaatttaaacatggctcctcctgcttcacttcccacagcattactcccataatgctgttgggtatgttagacccttcctgaaggtctgaggttaaaggatggaggttacctagagaacacttaaaattcagtctaagatactaaatactatcactgtgctactaagaattagtatcacagtcactaagttttggcatccatttctgttgccaagcttcccatactggtggctgctgctcatatgagccccaagacctgttatattttctcatcttgttttatttttcttctcagttcaagctgccccctaccagcacctccctgtgtgtctgcacaggctgtagactgtgcaactatggggggcactatttaccatagactgcgatgaaaatagcatcccctagagtttatgcagcttgatagctctctgttctcaaccccaaaagacttagacaccactctcttaaaaccagtggaagacggaattttctattattttattatacacagcaattaaacatcattttctttcaatctgtattttctagaagtgccccaagaatcccacatcagcataaccaaaagtgtcattaatgtattttttccccaaaacaaaatagcagttttctttctgtgaagaattctgtcttccttttaagctcaaattgcatccagcttctaaaattgcaatttctctgcccgcactttctgtttagcccagtgaaggatgacacaggttctatctaggccttaatcaaacaaatcactgtgaggacttctgtcttagctgtgaccctgggccctttgggaattcccgtcccccctaggcccttctggagccagctttttatcttgatatttctctgctttcaacgcaggcttagaaaacctttcaattaaagatgtcatgttggccttaatggaagccgctcttcatacctctcattcccccaaataggctgttttccattggcagtgattcataggagccacagaagagtttgagatttaagtcattctcaaccagttacagaccctaggagcagttacagacgttaggtgacagagttgaatttcagaatccatagcctacactcatgctagtaatggtgagaagtgtaaacatagggataagagacaaggcagtgatctcagaggaacctaaatatagttaccatccctgtaacctttgcataattgttttttcagccttcttctctgtaaaatggggatgataatccctacgttacaggcctgttaaaaagattaaacaaacgaatgtctgtaaagttcttagcatggggtctgacaataataagatatcacaaaaaaactattgtcatcaaacctctaagtctgtgcctctgagggatgtggtatcctgatataggttggtagtcttcctaagtaagttgaatctcaggcagcagaggaaaagtccagtgaaggagaacttgaagattctaaatggatgtgcatagcacaccccttttggcagaacagtgactcaagactgtaataagcagaaattaagggaacatcttcctctggagctcctaggagacttgaaaccagtggcagagtctcaggccctgtgggatgttacattaccacaaatctagccatagcctactattaccacttttggtaggagccagctatactattattattatgaggaaactaaagctattaaagggttgagctggtattggaacccaaataatccaactttagaacctgtgctctttaccactgtttttttttttgtctccttaaatatgtacgtgcgtgtgtacctattatgcacataaatataaaattatatatctattaatatatagtatatatgttaatatagaatatcatatataaagttgcaaattgccttaaatatatttccctgtaaaactgatatttataagtttagaacatatttttttcttgcatttgaacaatgttcatgtatactttggtctcacaaatgaaacctgtttgtcattgtgcttcctaaacttgaatattttatggaccctgttgaaagacattctctgggacccttagtattgacataaataattttttgttgtaatgttactctaaaatgtagaaatatataatcaggtataagtgtattatgcttgtggctcctaaaattatttaaaaacaaattttgaaactacaaaagcaatggcattcaaattaatgacacaagtttcatgtggcaatgatgtttgctggaacgaaattgctacttgagaaatcaatatggtgtagagttacacaaaacaggatctttagagttcagcatgacagaagtaccatgtaccatgtgatgaaaacttttgctgctttttttttcctgctttttttttcctgttgaaattgctatgaaaccattcacaggatgggcagaaacagcctttgctcttggtgtgaatgcaacatttatatactcagtgtctacctttgttcctccaaaataatggtacttggtacaaattgattataaatgtgacttttcagtatttgatcagaacgggggataataagggagtcatgcagatgacactaaccagcatttcttctgctatctgcattctgtccctaagggatgtcatctggtgtcctggctttaaaaaacattcatttgctgacaactctctaatttatatctatggcgtgtattgctcccctgaacttcagatttgtgtatctaactgcctaatagacatctcggcttagatttctaaatcttacagtttacaagtcccaaacaaatcttctggccccctgacctgctccaaacctgcttgtcctgtattcgtctccatttcccagaaaggcaactccactcttcctgtcgtacaagccccaaaccgtagtcgctctttacttttctctttttctcacatcttaaatccagtcaccctgaaaatcctgttggcctaaaaatatatccagaacctgaatacttctgcctgcctccattgctggcccccactcccaaggcaccatcatttcttgcctggatgatggcagtaacctcctcatttgtctccttgttttcaccctggcattcccaattatgtagtgcaaatacagtattttacatagcaatcagagtgatgctttaaaagtaaaacacctaataggttactacagcattcacagtcttcaaccctctaaagggcccatttcagagtaaaaaccaaaacccttaccatgtccgtcaaggccctgccactgttctttagtcagttgattccagccttacttttcttcaaacaacacacaagcctcgactttgtgtaggctttgcactgcttttccctctgctgggaatcctgtttcctcagatggtcacctggcttgcacctcctggcctctgcttagatgtcactttatcagtgaggccttccctgacaatcctatttaaaaaactctgttcccaacatacttcttcctcatcactttctcacctgctttatgtttttttttttttcccatggtgtgcctatcaccatgtattagtatacacatataaatgtatatgtatttcaattgtttattacctgtctctttctactagggaatatataagttccatgaatgcagaaacttagttttttcagtatctaaaatagtgcttgtcacttattatatgtgtaataaacatttgttgaaggaatcaatgaatgcttagtttttaaaacttgtcagcagaataaaaacacgaaaggaagtattattagggagaggttgcaaatctgagggtaaaaattttataccagcgtgtaacaccaaggaatgtactatgagtacaacttagattttgtaaaatgttagaaatctttttactgccaactttcatttttatcaatctaacatcttttgaattttacagttgaacataacttctaatttctcctaaatatttgcatgtatatttacagcttatttaaaaggtaaccacggccaattgtgtgaccaccaacaccatgctggggtgttaatatagttcagattgtctgagagaaaagttctttgtaaatcagtcactcccctgattttcacttggaattcatccaattattgacagcacttagtttgtaacatttcctggactcagaagagagggaagcttgctgagctgaaaccctgatatgcagtggagatttacattcagggggaaacagtgtctgttgaactgtgttaacagctatccatgtaggaaactcgaacagtatccaaagagcacacataattgtggtgattaagccgataagctggtgacacaaggaaagaaagtacaaattgaagtttcagcaacaggtgtaaggcacgtggtctatcctttcctggtagtcttaggaaagtaataagatagcttaattacatgattaaaatactcaaagtccagctgcaacccatagtttctgcctgtgcttgcttgcttgcttttttcttattagaagtgttgagatctttagattgttatggtttacctttctgttgtcctctatttttttttttttttaagactgagtctcgctctgttgccagactggagtgcagtggcgcgatctcagctcactgcaacctccgactccctgcttcaagtgattctcctgcctcagcctcctgagtagctgggattacaggcacacaccaccacgcccagctaatttttgtatttttagtagagatggggcttcaccatgttggccaggatggtctcaatctcctgaccttgtgatctgccctccttggtcccccaaagtgctgggattacaggcgtgagccaccgcacccatcctctgttggcctctatttttttagcttttatattaaaatactgttaatataaaattaatccaagcttgtcttcacattctgctgttttttccccccagtgtaaattaatgacttactcaaaacaatttttaagtcattagctaaaacgtgtacacatcttaataatatataacaaatagtgtgttcatgaatacacagtgtcttatatacacttattatcatgtatgcgatatatttgtttgtacttcaagaacattatgaaaataagggatgaaaccatgatttgatttgcatgcataagaaaaaagagtctctttgtttaaacagaaaattgagtcgtattgaagccatacttcagcattgtaggaagcatcctgttataagcacgtctttcttttccttcctccctttcttccttcatgtttcaatagatattgattgagtacccactatgtgccaggcaataaagtacacactcagtttggcattggtatgaatgctaatttagcaatcctaggctatcctggagtggcatcttgaaagtactcagttggagtgagcttgcatttagtttttcagttgggcatgggaaagatgaggcccatttccctggatttggaatctggtggttttgcatttgccagggcaaggtgctgtgtttattctctaaaagagtctcacttacctgttagtttggcttcaaaaacttttagcaacctgaactttaattttctgttatgtgaacacacagacaccacacacacacgctatctatctatatatctatctattatctatctatctatctatcatctatctatctatctatctatctatctatctatctatctatctctgcaaggtcttatggcttatttttcttcctaagttctagacttgttttattttatcttcttattcttcctctgagttccctgttttagttaaaagtttgcattatatattgtagcaaattgtttttgaggaaatgtactatatttattcaatacaaaaagataaatgcgtacatgtctagaggactgagaagatagatactttgaaaactgccctaagattgaatgtaataggaagatgaaatgttcttaaaagaaattaaatagattaactaacttatttcccacagaccattagccagacagaaaatgataggaaagtcaatgcttacctgatcacctatttcaatatctagagggaggccagaggtttcacatctcattaccagtctttcctaatattatttctttatatcctttactttttcattggttactcataggggagatggctacctgagagagctctctatttgaaaatgtgtttatttcaataagaacaaaattatctggacatttttgtgtaggatattagacaaaatatttttatgaaagaccttgaagtctgaactttgtgtaggttttccacagtacagaaagaaggtggagtttttggctgaagctgacctgcatttaagttgagattgagtgctgtattacttctgttttgaatccttcttcaagacttgtccatcatagtcaatcccaaagctcagagtttctgaaaaggattttaggctgttaaaaaatacattgtatggtaacacttaacagtttttaagaaaaatgatacatgtgagatatgatggattttagaaattataataacaccctctggttagtgttcctttactacttctgttataaatcaggagtttgcaattttgacagctaatctttttttctgtcagcgaaaacttgagtcagcctcttaactataagctaactgaaaatgaagactctgtctcttaagatattgatatatattttccttggaattatagttcgagcctctgaatttttgtgtcttttgggctgtcataccctgtgatgaacagaataggactttgttcctttacagctggattaaagatataacttcagatacttatttaaaaattagtattgtttccataataagcaaaatagtattgttaattcatagcacaggcattatttcaaaacaaactaatgatgaaactaagatttttaacataaatctgcagtatggtatgtgttctactgtccttattccagctgttgaggatttgaagtgagaacgggccaattttagcatgtgttggaaccatccatttgtctatttgacaaagatcttagaatcttccagttgaaaaggtctttggagaccatctacttcaactcccttaatttacagttgaagggatccgtggagaaagttactccccaactactatgttaataagtacaacattgttactcagttcattgccaggcaaacctttgttaggaatttaacagttccacaaatagccaacaaatagttggcaaactttatattcttatttgtaggcagctcatcatattcaggaaataattttccccaggagtgctctgactttaacacatggaacttgttttcactgagagaacaactgaaattctttcagaagagatgttttagaatctctgttataataaaacacagtataatgttacatgcactagaatgtagtgaggtccaactttcattttgattccattatttatttgaacgctcccttcctcctcttctcttgttttgtttctttgtctccatgtttccaaaaggagttcttatcttggacaacctatttcatctttaaaatagaagtaatattgtcacgtcttcctagatctggggggctaaacccagaaattctcgtgactttcttactactcaagacagtcttaggattttttttgttttgttttttgttttttgagatggagtttcgctcttgttgcccaggctggagtgcaatggcgggatctcggctcaccgcaaccttcgcctcctgggttcaagtgattctcctggcttagcctcctaagtagctgggattacaggcatgggccaccatgcccggctaattttgtatttttagtagagaaggggtttctccgtgttggttaggctggtcttgaactcctgacctcaggtgatccgcctgcctcagcctcccaaattgctgggattacaggcgtgatccactatgcccagctaggatctttatatatttttgaatatatttattaggtatcttctaaagttgtttaaagttgcttcaaatttaattatcagattgatttctggaaacattgtctttctacctcctcagactgctggggaattgacaggaaaatttggaatcaaacacctagttattagggaatatatttcatttacttgcctggattaaccattcccctcctcccgctctagctgctatgtgtatttagacctacctttattgtaaaatattttaaaaatgtacttctatttttaaattataaaataaggcatattctctttataaaatttggaaaaatagaacaatttaaataaaatcaaatgtttataatcaggatctaaagatgatcttgctatatactggtgtttatatatttctagtattgcttctattatttcttttcatttggaattacattgatcatttctttttttctcttttgttccattgaatcaatatatcatgggcattttgtcatgtcattaaatatttttatgaaagttgacatagtgttacaaaaatgtatcatgtggataaatcacaatttaaccaatcactattgttagtcatttgtgttgtttccaaaatttgctattagaaataatgttataatgcacattcttgtgtgtatatctacgataattttcttagggtaaatacccaaatgtggaattagtcatatggtattttcatatgtaataccaaaaggtcctctagaaatttttatttcttaccatagggcccatttacctctgtcctaattatatatatatatatatgtttagagtttagagattcctcaaaaagttaaacatagaactaccataagacctagcaataccactcatatgagtagttttatgttcattatggtagttctatgtttaacttttttgaggaatctctaaactgtttttcatagcacctgtaccattttacattcccaccagcatagcacaagtgttccaatagctccacttgttccaatagtaacacttgttgtttcttattttattgatagtagacaccctaatcattataaagtgatatctaattgaaatttttatttgcatttcactgatagatagtgatgttgagcatctttgcaggtacttactggccattcgtgtatcttctctggaaaaatgtctattcaaatcctttccccatttttgaattgagctgtttgtttttcattgccattattgagttttaggagttcattatgtgtttcagatattaatcctgtgtaagatagatgatttgcaaatattttctcttattctggggtttttctttttaatctcttgaaaatgttctttttttgagaccaggtctctcattctgtcacctaggctggagttcagtggtgtgatcacagctcactgaagcctcaactcctaggctcaagcaatcctcccacctcagcctcccaactagctaggaatacaggtgtatgccaccatgcctggctaatttttaattttttgtgtagaggtgaggtttctatatgttgcccaggctggtctcgagctcctgggctcaagcaatcctcctgccttggcctcccaaagtgttgggattacaggcatgagctactatgcccagccttgaaagtgttctttgatacacaaaagttttacattctgatgaagtcaagtttatctaaatttatcaaaacacgcttggtaatggtgtataatcctttaaatatgttgctgaatttatattgctagtattttgtctaggatttttgcatcaatattcacaagaaatattgatttgtagttttcttttcttgtagcgtctttggttttgttatcagggcaatactggtcccataaaacgaggcagaaagtgttccttactcttcaattcctgagaagagtttgagaaggaatgaagttaattcttccttaaatgtttagtagaaatcaccagcagaaacctttggtcctatgcttttttgttgttgttgttggaagccttttgattattaattcagtctccttagtagttatgagtctatccagattttctgtcttcatttttcaattttagcagatagtgagttgctaggaatttgtttatttcatctagattactcagtttgttggcatacaaatgttcatagtattctattcatagtctttttcttttgttttgtaaaaccaacagcacttgcttttggtgcatccaataagtttttgtttgttgtgattttattttcatttgtcttaaagcattttctaatttattttgtcatttattatttgatctactggttaagactgcatagtttaatttccatatacttatgaattttcctattttccttctgttagtgattcctagtttcattccattgtgattggaattttttttgtatgatttcaatcttttaaaatttattgcaatttgttttgtggcttaacattattgtctgttctgtagaatgttctatgtatgcttgaaaaatgagtaatttattgttggatagagtattctgtatatgtgtgttaggtctaatttgtttacagttttgttcaaatttagtattttcttattgatgttctgtctgttgtacctgttattgaaggcaaggtattgagtcttcgactattatctcccttgtattccagtatgtagaactatttcttccttcaattctaggaatgtttgtttcacatattttggggttttgttgtttggcacataatttataattgttatatatttttgatgaattgacccttttatcagtatataatgtgtgtctttctccttttacagtttttgacttaaattctattttgtctaataatagtatagcaaccccaactatcttttggttacatttgcatgtaatgtcattttccacctatcagcctgtttccatctttcaatgtatttgtgtctttagatctaaatgaagcctcttttggatgacatatagttggatcatgtttcattttaatacttttgctaatttctgtgctttggagattttaatacatttacacttaaagtcactactgttaaggaaagatttacttctgccatttgttatttgttttcttatagcttttttgttgctaatttgctctattactgtcttatttttgttcaattgatttttttttgtagtgaaaagctttgattcctttattatttctttcgtttatattctacaggtattttttttgtggttactctcagggctatataacattctaaatttatggcaatgtaatttgcatggatactagttaaactttggtcacatacaaaactgcctctatataccttcatgttattggtatctttatacgctgtctacccaatgacataggtttataattgttatttatgcatttgtcttttaaataatgtggaaaataaaaaatagagtcacaaaccaaaattgcaatattacctgctttgtatctgcctatgtatttacctttacctgagacctttatctatttatatggcttgaagttactgtcaagcatcctttcatttgaacctgaaagactcgggttagcatttcttttagggctggtctagtggtaaaaaacagccttagcttttatcagccccgcccacacttttactgcctgagttctaaattagatgaaacaaagatgagtaccttgcttcagtccttcttgtatccctcaggcaggttagagcaaatgtacaaataatttgcaaataaagtctgttctgctgtgtttgctttgagggagggaatgggaactggaatgctctggtttcccgaccaagaccactgtcagaccagggagagggaggggcaagtatgaataaagacaccacaaaattttctattatttcgaagataggtttttttttgtttttgtttttgttttaattaggcaattgcttgtttgctgtaaacttttgagtttttttcacagctccataaaagtaggtttagacacttgctgcttgtgttttttgatgtttctgggggatgggggcaggcggtgggggtgtttaagaacttgatgcggcctggagcggtggctcacgcctgtaatcccagcactttgggaggccgaggggggcggatcacgaggtcaggagatcgagaccaccctgtctaacacggtgaaaccccggctttactaaaaatacaaaaaaattaaccgcgcatggtggcgggcccctgtagtcccagctactcgggaggctgaggcaggagaatggcttgaacccaggaggcggagcttgcgttgagctgagatcgcctcactgcactccagcctggacgacagagcgagactctgtctcaaaaaaaaaaaaaaaaaaagttgctttctagtccaccattttgctgacatcttaaattttttttttttttttttttttttgagacggagtttcgctcttttcgcccaggctggagtgcaatggcgggatctcggctcaccgcaaccttcgcctcctgggttcaagagattctcctggcccagcctcccgagtagctggcattacaggcatgtgccaccacacccggctaattttgtatttttagtagagacggggtttctccgtgttggtcaggctagtcttgaactctcgacctcaggtgatccgcccgcctcagcctcccagactgctgggattacaggcatgagccaccacgcccggccttaaagtattttttaatgtgtctaaatttttatattgtccctttaaggtatacttatgccctgcaaagtaattatacacaaaccaataagctaagaaagaatgaaaggagtaataatttttggtgctactttaactgtgaatttagagtaggaagctttttttgcaagtatattttttgtataaaattaagaaaatatataaaataattgtatcccccttttttaaatatttttacctcttactcttttcaggttctaaaatgtgacttaattatgaaggttattagcaagaagtggcatttccaaaagtttcagcactgataccactacaattacaactacaataccactgataccactgataatttgcttcttctttctctcctctgtccacatttttagagttgaagtatatttttagagttgaattttaatatttatttttggggaagtaattttgaagagtcagacatgaagggtgattgtcaaatttcttctttgtttacaatttaggttgattgttaatgacaatttgtgtactggactgctgtgatgcaatggagtctgagactgggttatggctcagctagaaagggtattgtgaccaatttatgatgtttgccatagtcctggaaggtggcagtatttatgtcaatcattttccatctttattttcagcatccctggagccccaatctaataaagtcctcaaatcacctatgtgctgctttaaattaccagctgttataaggtacttaatttgaatcatgtaaatctataataaattggggatgatttctctagtagatcattttagaggaactataatatttaatgaaagtccaagtaaagagcgtatttaaaatgtcaaaagaccataggtttatcacattgaattctttattcctttgcagtctagacatttaattcaccttgtttctgttcgggttccaaccatctttgaacacgcaaaacaatatgattcacacaactctttgacatactcagcctaaatttatacctaatgtttacctacgtaacagcagtatttcaacgccctctttttcatttactctttggtcaaagaaaatctctttcacccagtgttagcttaagtttttgatattgagcttcatgtctctgagtgtcatatctttaagtacatttcctgagttttcatttttaggcattatctactggcattccattatgaaaagataatttgtctcttctttctctcctctctccgcattaccccataatataccagactttctccaccctccagctttcttacataattatatcaaagtaatgctatacaaattatgatatagctctgttcagtgtttgcattactatacgtatgaaaagcgatcaagaactagacatataacagctacaatattttttccttttctgtgcagctcttatttaccttggagttaataatagcatttatagttatttgcttggttttctatgtacttgttaattcaaaccaaacatttaatctgttacctaaatctcttctcaggatacccagacaaatctggtattccatcatttttgtctttctgaagaggattttcctggaaatttctgacctcctgtcctgtgaacaaattatcctgtaggttttgtatcaactgtcatcatcctggcctgtcccctcaccgttaccctggggactcttcgcatctttcctctgtcctatctattgtttcctgtgtctcatcttcctgtcttagtttattcttttattttggtgacactcatccctctgtatctttcaaataaatgctactttgcaactaaatttttgaatgatcttgtatctgaaaatataccttttactttgttgatggtttcctgactaccgaattctagattgaaagtttttttcctcagtgttttgaaagaattgtttttgttttttctcctctggaagcttgtagtacactaggtaccgaaatttctctataatgtgctttgatgtgggtttatttctatccgttgtaataagctttctgtgagcactttcactcatgttctccctggggaattgtctaaattatatcattgattttaccactcctcttgtttatctttgtggaatttatacaatttgatgttggatctactggactggcctttctttcttacatttgatctctttgtatttgatattttctcgattctgtcaactttttattttttgttatattttttgtttccaagacttattttttttgttccccaaatattcctctttttttccttttagtaaaagtattttgtttttatgttatggttctcttctcttatctctctgatattaataatagatttttttaaagttttcttatttctgcatattgcatttccttcaagttgctattatacatattagtttgcttaatttttaatctttcatattagtgactttcctcagatgtcttgtagtcttttgcttatccactgacatgtaaaggtgtgggacaaagtagctcgattggagtttttgtgcataagtttgtccatatagttttgcagtatgatgatccatttgggctatttagttaggtaaacttcagagttatcatctccatatttttctacttaggcagatcagatatcccagagaaggatcctctagcctccttcctgtggagggagtacctagcatcttcagagcccccattagggaggaaaaatggggagattctggcatccattgtgcttacgttcacttaatctctctgttttcagtgtgttttccactgttaactatgcagagaccttttactttaccccttagcccttatttgaaaatgaagagggacatttaactgtataagatccagggatgcaatttggatatccacctgcttcttagatattttttcagcaaatcgttgttatttggctttattccttcacccttatctttgaagtacccataaccaccaattccttagtcttttagaatttagcagtataaatttggttggctcttacatcatggactcaattattcacccctcattcctctccaattaattaccttcttttatctttttttttaaacggtgaaacttttataataaattgattttattcgtcctctgtctttctttacttgtcatgcctcccagtctggtttcagcacccctcaactttcatttaagacacctctgtgttgataaatctagcagatatttttggcctttgaattatttgacatctgtgaagatttgccccagttaggtactttcgccttctagtttgtctacagcttctctggaagctctcagttttttctagttccatggtcttctactttcctcatgattctttcttttagagaatatcactcaagaccagtaatatcaatatatctaatatataatattagatcaatatatctagtatcaaatatatatgtatgatatataatatacatgtaacataatatataacatatctcactatattatatatgtgcatgtatctgtatacatacacaaacatgcatatgcaaatccacaaccatgacacatgccaaattgtcctgtcatgtagtttggtcacagacttttggaaaacttgctgtataatgaatgatttctcttttttaatgtgcaaaggtctggaaaacatccttagaaatatagctggtgtttcttttatttgctccatgtcaaatggcagagctggaagtgctcagttaaaccctgattccttgcagcttaattcttcagtctcagttttagagtaatgaaataccaagtggctgaattagcagattttggaatgctgtataatgttctctttataatggaaatgattgatggtattgtgtaaatgttctatgatatttggtaaaagttaataattctgttttcttatttgtaaccttatcataatttctaccatagtaatgagcagacttttagactggcaatttattgaaaatgttagtaaaataatgatatcatatgaggcagtttagtctataatctcaaatgtaatttagcagaaaatattaaatagccattttgtaaactgacagaactcaatttttaatgaattgaaatacagatggagagaaatgccaaaatggattaatagtgttataatagctgatccttttagaccagaccacactgtcttcaagatatatgcctattaaaatcttggtattctaattttaaatatgacagtagtgctattaacataaaaatatgactcgattaataagattcactttatgactatttaactctctcatagtcaggaagaatccctcagtctagtattcaagagaatcttcttaatttctagattttcgaatagaagtaggagattaaatcaaaatgccagttgttttatgaaatgaaaagaatgtctgttgttgccttttcagattaggcatattggtacttggtgttatcttcctgatattaattttatactactcctgtatttttactaagatgaatttggtttaaatgtgaaaataaattatttaaaaagagataaatcttttgcaatcaatgtcggcaatagagttgatttgcagcagtgttatctttgaaattaagtgatagtgccagtaagggttgcttagaatacttcttacagatacttatatgaattaatggaattgtacacttattacccgtgaagataaatatgatcattgaaatggtatgtgaaacattcaattcctaaattaactagaatgaataagaactttcattgagtgattttttattgtatagccgaatatactcctgagtctatagggagctttgcctttgagttgactcataaatattatgcttttcgatgaggtaatttggtcctccagtaactaaacccctgaaggggaagtctaatattgtcctgttcttgaacttccctctaaatttaggactgatacagtgaggggttaccttttaatatgcagtatttactgctttaaaaactaaattaactactcctcttggtctattgttaatgaattgagggttcagcttaaccttcacaaactgtttaaatgaagcacctgatgatatttaaactcactgtaatatttcatttaaaataaatcccagaggtacaggttctaaggttgtaagaaagccacggtgttcctatatatatgtatttatttcttttacactaggccagacctttataatttataaccaggatgatttctgtggcctttaaatgtccacagtgcttgataatttcttccttgttcatggtcctgttaggtaaaagttttacacttacaaaattagatacaaagcttattctcaagaagcatacagcctgataaccatattcagtatctccacaaggataaagaagtgatctaatggaaagagatcaagtaatgatcaaatacttcatatttagaagatcagagaaagcttcaaggagaaattgccttaaacatgtgttggaagttagtatagatgggctttggtccttttagtggactttacagtgctctgctcacctgagtccatttatagctgtggatggttcttggcatgcagatgttttcctaagtcaggcatcagcacctttttgcttttctgcctttgggctttctctggcactagaagagcttgcttggctatgctgcagtttccacaggggaatggagaggagttaacaccctcaagagcaaccctcagacagtggctgatgggaaagaatctatagatcaatggccctgcctccccagcctccttcaggagaaccatttggtggtgtgaccttcatgtttaccagagggtccctaacaggattgtgctcctgtggctcacagtagtaacttcatcattaatgcagccattattgcattttctttcttttctcgctttccattttcttatatttcttgagatcacttctgaattaaaccatctacttccaaatccttttctcagcatctacttttggtgtacccaaactaaaacggtttgttagcgttggagaaagaacagcatgaatcaagttgtgcagattaagtatagcatcagtgagtggttcagtttaactagactatcaggtttatggttccagggcaataaaattagtcaggtcacaaggaacttaaaagtcagtctaaggatttggggcttttcttcaggcattgcagactttccaaagacttagcagaaggaggtgacatgatcaggattttgcttccacatagtgacttgatggcagtctttaaaagagatcgaagatgagggagactgaaagtgtggagaacatctaggagacggttctgtcgtgctaggatctaggttaggcagtaacactagtgggaatggaaaggaaggatagtaaatgctacatttagcaatcggtttgatatggatgccacaggagagaaaggcattaaaaataatgcaatatttctagctttgactgctaactgggaggatggcaatgctttgttcaaaacagaaaacacagaggacgaacatatttaagtgagataaaacttttagtttacttctgtggcaaaatctgttagttgtctgtacaacagtctttctccctttctttttcagtatgagaatcctcattttggtcaggcctatagtgtgtccagataagagatatttcccagcttcccttgcagcaggttgtaaccatgtgactaagttctgggtaatgtgatatacaacagtgttgtgttagacttcaaggaaggctgcatgagaggaggagacccatctagaggtaagcgccttcaccttgccctcattcttactgcctagcatcccaaaacacggaagtccagccagagtctcagacttttggagcttggaagccgcatgatgggaatttttaaagactagggagaccacaccagccccaaactgcctacctccagaatttatttgtttaagagagaaataaacatcatcttctctgaggcactggtattttgggtttccttttttacataagctgttgtacctaatgctgtctgatgacacagagtatattgagcctgaattaagagcagaatatctagatggagatgttcgataggcagttagaaataaaaataaatacataaatttaataatagcaattaacatttgagtgataattatatttccaggtccttattgtgtatgcaaggaggcatacagaggcttaacagtttgcacaagatatataactgataagtggcagaggtgggatggaaaccctatactctctgatgtcacactgttaactattgtgctgtagggtgggatggagcttagaagaaaggtcacaagaatttatttttaagagaagataagttgagataattctttaaaactactaaaaacacagaagtatttatttgcatacatatttcacaaaattgttttatgacttttaaatcatttacataatatccatgagatccacagtttttacaagtaaaattatgtcaagaaagaaattcagctgtcaatctgaattatagtaattggtgaattagggaagtttattaatatttctcttgtctttttagagatgtttattaagagttctaccaggtccaaacaaatggaaaggcatcgaataactataaagttagaaaagaatttagacattatctggtgcagtgctctgcctttaagatgaggaagtgagacctgaagcagttgagtgactgaaagtggtttatcagagttagggacagaaccaagaaaataattcggccttcttattcatccttaagtttcccatatgccaggcttgaagaaagctctgttgcaattacctctaagttctcactgatcctgatccccaggatgtgaaatggttaagtattatatttagagtacttccacagcagagggggtaagtcaggcacaaatccagccatgctgactatctgttgtaagagaaaattatttgtctcaattcctctttttaaaaaattcagattatgttttaatgtgattatttggctgaagaatatcatggcataaaattcaaattcctccttagagcgtacagggccttctatgatgtgctcgcctgctgttatcacggcacttccccttgctctagccatgctgttcctggacattgttgatcatgttcctaccttagggctgtctcacttacagtcctctcttctaaatactctactattattatctgcagagctgaattcctcacttcctttatgggtagctcatacgtcatttcacaggatatattactacctggtctgtttaaatggaattgtttatttttatatgtattcattagtctgtctgactttgctagtgtcatgaagataggcactttttttttttttgctgtatattcaatgcctaaagtagtatctgtctaacatgtggtatgtattcaataaaaaatgtgttgaataaatgaagatagtacgtgagggctaacttataaaagtagtattctataatacagattgttattttagagcccacttaatagttgttactttctgttttcttaaaaaccattatggaagtactgtaatcaagaggtttaaatatattgaaggccagttactaaaaatagtttatctggagcacttcaggtatgaggccttttcagagtctgtcatctgtagtcaatgtgagctcctttgttcttcaggtattccaaatttctggaatatttctgcagtttctaactaggactaggtgcctggccaccattatcttatggtagtaaatgaccctctagtggcctgagtgagttgatgtattttacttattgttaatttggtgcaactttgaagaattgctttcagaatctaagtctttttcaatatagagagactgaaaattttatgcatacaaatttgtagtcatagaaaataataataataataatggcaaccagtgtttatagaactgtcattatgtgtctgcactgggccaagctctttacacgtgttgaggttttaagtgtgtgtcaccatcagcaggtaggggaaattttctatttagagaaaaatagaccagttcatattcttaaacagaagagacagtgcacagctctacctgccttggaggaaattgtcattttatggtcttaaggaaggagatgaaataagcataataaatagtagtaaaagcagaaacacagtgaaagagacgtaaaacacattcataacaaagccccaggtgactgaaacataacctgtggataaccagcaatgaatgtgtaataggaatgtttcagatgattttttaagacattttattaagtgaagaaatgcaagcctttttattttgcttgacaactatttaattttctagtatgaccaataatacagaaaataaagtgaaaagggtaaaatttctaaaacaaagtggacaaataaatgattttggaaagaaacccaagtacttcaagatagagagaactgcagaataatcagaatcataaaattcaatcttcatcagatggaagtttggtcattcttatttaaacagtgcaaccatcttcatttgctaagtttcctgaagagttaagactactcacaaaacagaaaattccagtagctaacatatggcagcaatgcaatgaaatggaaagaaaaatggccagtttacctgaatattgtctcaccaagacagtttttttaatattctgcaagtggctggagaattgatttgcttgtatatggtttgacagagaaacattttttttttcaatctgggaaagcaattcccagaggatttaaaatagttagagaaattcatcatgtgatttttctcttctcaatgaagctttatctatgaaaatgacttgcatacatagttagtgttgcaataatatggcacaaaataaacaattcttttaaccatggtcatatatcattgaagacacatgcatctagaagttatatgcaatttatggattttctaaatatttaaagtgtcatgaatggctggtcttagttttagtcagtatgtttttattgccagtaagttacagatacagcagacaagtgaacacaaaactgattttgtgattgacttagctgaaagatatgaaacttctaatttaaattctcaaattctataatgcgattctgtatctatttgacgttacttgtaaagcaaagagaaaaaattgctacagcgtaccttgtggaataaatgcaatgagttatcaaatcaaatgaggcaaactgaaattattttgaatcttttttgtatttgagttttcatagttatggctttctaccatttttaaactcggtttagatatcatttcttcagaaaagcttctctgatccctaccaccactaccaccatcccctttcccagtattaggtgcttcagttctacactctcataacacttctacctttcctttttggcacctgatgcccttgcaattgttagtttaaattctctcatccagcctttattacagacaccccaagggcaaggatgatgtcagtcttgttaacaacctaaggtgagtcaagcacattgctccatcagttcttccttctcctgaatcataagctttcccttctctgttggctcatcccatcaatatacaaacatgctattgtttttccttttttcaaaataactctcttgactctatgtcccccatttctaactttcttacaacttttcatcaaaactccttgaaatggttgccaatactagttatctttaattttttcctctttcatccactttagtaacccatcactctactgaaaatgcttttattaaggtcaccaatgagtgccagtggtcaattctcatctatatacattgaagattgttagcagaggttcctaatactttctcagtgaatcagctacagcttggcaactacccacgtcagttttcttccacagaaggtctgttgataactgtattactttcctagggcttccataacaaagtacctcagtttctgcttaatactgcagaacttgattctctcaagttctggtggccagaagtctgaactgaaggtattcagggccacactcactccaaaggcttcaagaaataaagaatccttccctgcttccaatttgtggtggctttcggaattccttggcttgtggatacacaactccaacctctgcctccatcttcatatggacttcttctctgtctgcgtgtgtcactcttctctatgtctcctaataggacaattgtcattagatttagaacccacccacataatccaggatgatgtcatctcaggatcttaactacatctgcaaagaccctttttccaattaaactgccattcaagtttccaggcattaggatatggacatatcttttgtgggggcaccattcagctcactgtgataacgatcccagtgttcactgcttttgttcatagtggaggtatgatataatattctcgaccagatgccaattttaccactaattaattttttaattcaacagatagttattgagtaccccttatgcgtcattataggtcctgaagagaaagtgtaagcaaatccctactctcatggagttacattctagttgagggaaaaatagaattattcttatattacttaaagtacattagtacatttcctaaagttatagaagtcattttttttttttgacataggatcttgctctgtcacccaggctggagtgcagtggtatgatcttgtttcactgcaacctctgccttccagcttcaagtgattctcctgcctcagcctcccaagtagctgggtctactggtgcccgccaccacacctggctaatttttgtatttttggtagaaacggggtttccccatgttggtgaggctggtcttgaactcctggtctcaacggatccacctacctcagcctcccaaagtgttgggattacaggcatgagccaccatgcctggatgagaagtcattttaaacttataattaagtttctaaaagtcacaattttataaaagccagaacatacacaatacaaagcaatcttttccattcagtggttggcagactgcatatcagatgtttcacccacgtgctaaagcaaaagaaaaaaaaaagtgccaaaagtcttattaaatttatgtttatctgttgacaagtgatacaatgtcatgcatttagtgtgattttaaaccccagagtaaatgagaaagtgataccatgatgaccctgatttcgctcattaatgttgtatttataccacattattagtctaattaaaataaatataaacaatgtaccttccatatcatgaagccgatttcaaactaacttctgtttcatttaacacctctcctgcttcccaccttttccgaaatacttaattatgctgttttctttgctggctgtaaattatgtagattttgttactcttactaacactatatgcctaggcacttcacccaccttaaccatcaccctgtattgtgatagcgtcttccatatgcgtactccctagtgaacaatgagctctctaataggagaggccgtatcatttcagtttttgttttcccagcactctacacgtatgtgacatgtagtgggttaaaaatgaattaaacttagtcaactgtaggcttgacaagtacaaggagcaggattccttggatgctgagtgacctagctgtatcaaccaactgtctagtattgggttcttctttgccaatttaactcagtgtccttgtctttgaaaaacagagaataataacaatgaaaggacttatggattatttgtgagacacagtgatgtgtattaagcatgcacttactgtgtacctaactcttagtaagcactctgtagatcttagtcattaactttgcttggtttttgtttttagcattattgctttaaacatctatcctgacaatgaagtggattttcacttatacaaatagcttttaattgaaacacacagaggtttcaatttggcaggacccaaggtttaaaattgtaggcagcttaataaatagaaagtataattaatggctcaaattttgaaagccattaactatattttagtgacatgacttggaagagttagctgcataaagcacacatttttataaaaagaaaggtaagtggtgatgttttctaagctttctactgtttctcccaagcacctttttttgagtggatgtcatccttaacttttcccattcttttatattttatatttgacaattcactatgttttaaaaagggtttcttgggccggatgcagtggctcacacctgtaatcccagcactttgagaagctgaggcaggtgagtcacaaggtcaggagtctgagaccagcctggccaacatggtgaaaccccatctctactaaaaatacaaaaaattagcagggcgtggtggtgagtgcctgtaatcctagatacttgggaggctaaggcaggagaatcacttgaaccagggaagaagaggttgcagtgagtcaagatcatgccattgtactccagcctgggtgacaaaagcaaaactccatctcaaaaaaaaatttttttctcattaaatatttgttatatgaatctcttctctcttcgtcaatttgttaattctgtcttcactttatcactttgaaaattgaagtcatagaatttaagcaatgaataataatggtacttatataaatgaattttgcttttatattactacactcaaaatacattttcagtaaaaattgtttgaagtgttgcctattaagatgtttttaaataaattctcttgtgtatatttaagatacaaaacattataagacacatctatatagtaaaattattactatagtggaacaaattaacatattcattatctcacatagttacccattccccctacagtgacaagaacagctatatctactcatttagcaaaaatcctgaaaaaaatatactgctattaactataatcctcatgttgcacattagatttttggacttttgttcatcctacatatttgctattttacatactttgacttgcatcttcctatttcctcctcccacctcaaccctttattccttttttaatagattccacatataagtaagatcatgcaatatttttctttctgtgtctggcttatttaatttagcataatgtcttccaggtctatccatgctgtagcaaatgataggatctcctcccttctttaaggcagaataatattcaattgtgtatgtataccacagtttatttcatccatttgtctgtggacacacaggttgctcctatatcttggccatcgtgaatagtgctgctgtgaacatggaagtgccaatgtttctctgtcataatgacttcctgtgctattaatatatacccagcaggattgctggatcttatggcagttttgtctttaattttttgaataacctccagaccattttccataatggctgtagcaatttacattcccaccaacagtttacaaaggttctcttttctccacgcccttaccaacacttgttagctcttgttttttgataacagtcatcctaacagatgtgaggtgttatctcacagtggttttcatttgcatttccccgatgattaaagattagggcaccttttcatgtaccagttagccatttttatgtcatctttggagaaatgcatattcaagttcttcgcccattttaaaattggattatatgttttcttgctattcagtgtcatgagttctttataagtcatggatattaacccgttatctgttgcagggtttacagttttaaaaaataatttgtaggttgtctttttattttattgtttcctttgctgtgcagaagcttttaagtttgatgtagtcccatttatttatttttgattttgtaggctgaattttggcataatacacaagaaataattgtcagggctaatgccaaggaggtttttccgtatttctcctaagacttttgcggtttcaggtcttaagtgtaggtcttttatttgttttgatttgatttttgtacatgatgtaagataagagtcaattttattatttcgcatgtggaaatcaagtttttgtagcactatttgttgaggagactattttttcctctttgcgtccagttggtgatcttgtcaaaaatttgttgactgtgtaagttcgggtttacttttgagctctctactctgttctctgtgtctctttttttatgctagtaccatactgttttgattactgtagctttgtaatataattttaaatcgggcagtgtgatgcctctaaccgtatttttctcagaattgctttggctattcatagtattttgtggttccccatttaaaaaatatcctattaagttttcattttctaaaaaccacactgagttattgaaaaatggagtttttagtccactagtattattttaaaatatctaattttagggattttgtgtgtgtgtgtatgtatataagaaattgttgagagacagcattgagttggggtatggatcataggctccagaaccagtcttccagaacttgaatatgggttctgctacttatagctgtacaactttgggcagaatggttaatctctctatgcctcagtttttttcatttttaaaatgaatttaataatgttatttactaacagttgtgaggattgaatgagttaaatcacttaaaacacttagaataatgctagacacatagaaagaactgaataagtattagttctgcaaattaattaatggagtgaaaaggttttttgttttgttttgttttatttttggttgtgagtacacatagataagtcccagaggcaggaagtcatgggatttttacagagttaagcagtaaaagaaagcccatgaaaatgagacttgggccaggtcttagaggttctgccctcaacattccaaacaagaggccacagtaatcccacatcccgtaggtcatctctgagatcactggcagacttcccacactcagagatttgaaccttattctataggcaaagggaaaatattgaagatagtacagaggctagtacatgggctttagcagcaaactccctggaattggcttctgattcttttctgtacctgagtttcattattgataatagtaatgattcctactttatagggtcttgcaatgattaaatgaggcaatatagctaatatattcagaacaaacttgtctaaccccagctggtcacaatggctttgaatgtttgaatgcagcccaacacaacttcataaactttcttaaaacattatgaggtttttttgcaattttttttttggttttagctcatcaactattgttagtgttactgtattttatgcgtggcccaagacaattcttctgcttccagtgtagcccagggaagccaaaagtttggacatccctgaagaacattgcctggctaatagtaattgtttaatagaaattggctattaaaaattgtgagcaaaggaatattgtgagcagatctgtgtacctttacataattctaggtaaagtgcctgatcttctatatgagaacagagagaaaatgagacgtctgtagaagagtcaagattaatgagtatttcacgcttgtgctacttttccacaaggttggcctggggacatgggtgtggaaaagggaaaaccattgctgaatttatggcagttattgctaagcctcagggggcattaataccatgggatctccaggcctcccttaggtagctagggagcccggggcatgagtagaggaccacattcagagttcatggagaagattgcctctattccatagagtacctttgtgaacattagaagagggtgccactttctttggggccatataaccctgcagcagggcacatggcatggtaaacagagcctaggactcaccccctttgctagatacctttggacaggacacaacctgagcaacacacttatgtcctggccagagagcacttgtgattacgggaaattctgcctagtaagaaaacatgtgcattatttatgtctgtacatcttttgaatttggggtgatcttatgattttctttgataaatagaatgtgatagaagtaattttatgtgacttctaatgctagaccttaagagaccttgcacctttcacttttaccctcttaaaattctgctctgggatcgctatgtaaagaagtctagtccagcctcctggaggatgagaggccatgcagaggagaactgaagtgctctaggtgacagccagcacttcctggcagctgcgtcttcataagtaatcccaggcaagatggcaagaacaactgcctagtcatagagttgctgaaccacaagatcttgtgcaataataaatgagttttaagcctctacattttgtggtagtttgttatacagcagtggataactgatatacatatgtaggccaaaagggaaggaacagaggtaattctcggtctagaagtcatctgtagtgaccgttttctctcagcttccaataaagatgcttccagtgatatggcattgagtcagaacatttccttttcatgaacagagatattactgcatcatacaagtcagtttggtctgtaggagcatcagaaatgactacagagatttccagcatagtttctgatacccaaatggcctggaaatgtctgctggcatattacctttctagttactatgtgcctcataaagacagcaacaaaagactcagcaatattaaaaatgaagaaccaagttgctggtttattctagttatcattatcactgagagtgtgctgttacaatgttgatagtgatgtacgcgtttacgaagaaatgacttctaaaaacactagctagactagaaagtcacataatgaagcagtagaaagtgtagcaggaatctgaagaattgagataaattaaaaataaatgggaggctgggtgcagtggctcatgcttgtaattccagcactttgggaggctggagcaggtggatcacctgaggtcaggagtttgagaccagcctggccaacatggcgaaaccccatctctacaaaaaatataaaaattagccaggtgtggtggtgctcacctgtaatcccagctactcagaaggctgagacaggggaatcacttgaacccaggaggtggaggttgcagtaagctgagatcccaccactgcactctagcctgggtgatagagtgagactccatgtcaaaacaaacaaacaaacaaaaaacccaaaatgaaatacctggaaaaattggaaatatatatacattatatttaccaaatggggaaaattaaataagcaggtgaatctttgtattttggtcaattttactctcatgattctgattttatgaaattattattttctttgattttgcagtgatttttcattagctggaagctacagagcaaattattttgatgccaaagtgaaaaatatggagatatttattggaataatacaaacttctttctctttctcttcttctctttctttcttttaaactaaagtctttcatgaaatgggaattaataatgaatgccagctgccttcacactggattcttgctggaactttcactccccaattcctaatgctcttcttctggtagagcagagagccatgcccaagcagtcaacagactataacctggccttgcttggtcctagaagctgaatacctacctccccacaagagatggcataagagtaagaaatgagaactacagggccgggcacggtggctcacgcctgtaatcccagccctttaggaagccgaggcgggcagatcatgaggtcaggagatcgagaccatcctggctaacactgtgaaaccccgtctctactaaaaatacaaaaataatttagcccggtgtggtggcgggcgcctgtagtcctagctactcgggaggctgagacgggagaatggcgtgaacccgggaggcggaggttgcagtgagccgagatcgcgccactgtactccagcctgggcaacagagcgagactctgtctcaagaaaaaaaaaaaagaaatgagaactacactgagtgtggtaatactgaccctgccacagaaaacttgacatctggtactatggtctctcaaatttaaagctctttcttcctaaggatgaaggagtaagggtgaaaggactgggtagaggctgggacaagggtgggaaaagacctaccctttgagattaaattaagagggtatagggtgtattacctatgctttttttttttttttgaggcagtgtcttgctctgtcacccaggctggagtgcagtggcataatctcggctcactgcaaccactgcctcctgggttcaagcgattctcttgtcttagcttcctgagtagctgggattacagatacatgccactacgcctgtctgacttttgtatttttagtagagatgggttttcactatgttggtcaggctggtcttgaactccctacctcaggtgatctgcccgcctcggcctcccaaagtgctgggattacaggcatgagccactgcgcccagcctgatgtatgctattatatgccaaaatggaaagggtattcagcttctttttatggggaaaatgtcaaattgattcagttaaaatagaagaaatattagtgagtgtatcagtagtaattatgcttgagtagcatgaaatcaaactgaatttgaatcatggctctgctacctgctagctgggtaaattgggcaaattactcaatttctaagccatagtctccttgcctgcaagataggaataatcacaggtcctgccttgcaggattactgtcagggtttaataaagcaaagcatttaaagcacttagcacattgcctagcacacagtcagtgctcactaagtggttgctactattgtggcataagtcttttatttagataacaaagcagcttacattttaatttatatgttattttaagtaatttagttaaaaccaaatctcactttatctaaaaactacaatatgattaatatgatttataattagtgtcactgttattcataaaaactatataaaatggacaaataggtcaatgttatcaggggatacagtaaattagaagcataagaaaaagtttaggataaatcatttataaccttgctaaaagggaataatattgccagagagatactttgtcagggagaattataaaatgagtacattctcctgtgttttgcgttgcccaatccttcaaattgctcaattgagtggttacttctgagtcctcattttgtgtgacttagcagcagcatatgacaaatgatcgccattccctccttgaaacatatccttcacttggctgctaggacaccacatttgcctggctttccttctccctttccgtctgttccttatcagtttttttctgattcctccttatctgcccagcctcttaatattgaaataacccgtggaacactctttagggctcttttctgactacattcactccctaggtgatcgcattcagtctcaagttgagttacaatctatgtgctgatgactcccaaatttgtatctttagtgtgtgtgtccctcctttcaatttcagacccataaaccaactgcctattttttatcttcacttgaatatccaactccacatatccaaaatcagcttcttctgtggccatcaccgtctcagttaatggcaactcttggtattcctgtttttctctcacacataacgtcatgtagttcagcagaaaaccttgtcagttctaccatctctgtgtgtgtgtatatatatatatgtgtgtgtgtgtatgtgtttgtgttccatatatatatgtagagagagagagttcaccatcacccattacacccctatgaccaccatcatcctgcttcaagccagcatcacctctctcctggattgctacaatagcctttgtctccttgcttctactcttgcccctctgtagtttgtttccaacacagcagccaatgtggtcttgttaaaatttaaattagattatgtcatttttctgctcaaaacccttcagtggctttccttttagggacctgggtaaacagcctcctattacctttctgatgccatctcttaccactttctccctggttcatcctgccccagccacagcggtctttctattgaactttaacgcaagctccatgagggcaaggatttttgtccattttgttccctgcatatctccagcatctagaccagcacttggcctaaagtaagcactcattaaatatttcttgaatatattatggacaacttctgaacccatctcttttgcacaattttcccataaaggtcattgtataaggcatcaatgtatgtatcagtctttaccagaagtctgaggtaatgatgagatatttgttcatcatcatgttatttaatgtgtttcttcctcaagattactgacacatttccccaattccccattttcctggttgctgtcatcctctgactcattcccttccccagaacttgattcctttgtttatcatacagtgtaaaacagtcctcttctcctgtgctggactaggtctggaaaagtttaatccatggcttgggaaaaaaagactggaaaaatggcattttcctgtttcctttttaaaatttcagtgctttgatgtttgattttaaaaatcatcgcaaggatagttctaggggcaaaacttaaagttggctttgttaaggtaacaccaattgccgtaatacataattctccaaatttcagtggctttacacaaaaaggacttttgcttgcttcatgcacatctagttccaacagtcatttctgatcactgggcctctaagtggctccttcaataatgcaaacctgccatcatgcaagtttgctgtggaagagggaaagagtatagaatattattgagggatgttttataggacatgtttgtgactatacatccactactattttactgtccagaatttggtcatacctgaatgctggcaagtttggggcatgtgattcacatgtatacctaggaagaagcagaaacaagtttggtgatgacccatccagagtctctaccaaactttgtattgccacactttctctctcactccttattcataagcctctgatgtgtggatcctcttcttgcttggtgttggatggaatcataatagtaatagtataaataataaatattttctgctattcactgcttatattatttaattatcaaaaactgtgaggtaggtctacttatcaccatttatagatgtggaaattgaggcattagtgtgtctaacgtcactaacttgtaagagttgaaaccaagatttgaaccaggctgtctgacttcacaatccacctccctaacaaggacactgtattgcctctcaagttttgaagagttagacctcttttcccttattatattgcttcttgaggagccaggatgaacctggaaggaactttgggaccccatttcaacttcaaatttcctccattcatttgctgatttgacttctacacttatgtctccaattcttaaccagaatgactcagggcctcccagttctcagatcagtttcagacagagtggcaacttgaggctaaagggtgaaggaatggagccctgtttgtgtaagaattctctcagagtatttcattgtgggcacttttcacagttccaactctcctaattgaaacacatttcaccaaacactccaagtgatatggtaattaaaattaaatctgttgccaaaaaaggcaaagaaaatagtataagcagtctataaactattataatatcacctgctaaagatatttattctggagaaaacaatgcctataacttataaactgatacaacagagtgctattttttagttttatcggagccaccaaaatacaatatatatcagatactgaaatgacttagaagatatcaagatgcagattttcttttttattttttcctttttttgagatggagtctcgctctgtcgcccaggctggagtgcagtggtgctatctcagctcactgcaacctccacctcccgagttcaagtgattctcctgcctcagcctcctgagtagctgggattacaggcacccaccaccacacccagctaattttttgtatttttagtagagatggtatttcaccatgttggccaagctagtcttgtactcctgaccttgtgattcacctgcctcagcctcccaaagtgctgggattacaggcgtgagccactgcgcccagccgatgcagattttcaaaggaaatgttcaactaatggatttcatcccccaacaagtgtattcaaaagtcaggtttttcgagattaaagattttgtgaggacaatttctttggaaaatagcatctgctgttatttgccaccttttatcccatggcaagggagggaagtatgtgtgtacgtacacgtgtgtgtgtgtgtgctgtgactttcttcacacactgcctataggaagaggcctcagaggagactctaggagtttattgtctcccccagacttgggagagtacagctagctcatgtctgatgtccacctgaggtatctgaaagtgaaaagctgtcaaaaagggcctttggaagctaagtagagggctgtgtttgggctgtaactgaactctactccagatgggccaaaggtctgtgactcctggggaccagacatgggacccagagaagcagacaccactgtccaaagtaattttgactcctgcttgagaggactgccagagaccgcagagcaacttcagcagtctttgagtaatggaagatgggaaaactagaggctgagggggaattagctgctggagggttagaatgaatagtccatgtcaccggagttacaatcaaaagaggacagtagaagagcacttgagaacccatgaaaatgtgtgtgtgtgtgtgtgtgtgtgtgtgtgtctgtgtctgcatgtgtgtatctgagagagagagagatgtaaacatctgcgaggccaagagagtgtgaagccattttacaatagtattagtcaagtgagaactttgcagcccgtctttcccacatctctctttcatttagaccctagagaggtcagattaccacagtccaaagtaggggaagagggatggtagtctaacctttgaataaagattcaattgctgtttaatttgttagacaaacttcagtgtactaaattgagactctgttcagcaactaatgtctttttattacctatgaatgtccagagatgtcatggagcctgccagagttttcattcgttggaaagggaaaaactttccctagtgaatggattttttaaacagtggggccaggcgcggtgactcatgcctgtaatcccagcactttgggaggccgaggtgggcagatcacttgaggttaggagttcaagaccatcttggccaacatagtgaaaccccatctctaccaaaaatacaaaaattagccaggcatggtggtgcatgcctgtaatcccagctactcaggaggctgatgcaggagaatgtctttaatctgggaggcagtgagctgagatcatgccactgcactccagcctgggcaatagatcgacactccctctcagaaaaaaaaaagaaagaaagaaagaaagaaaggcggtgagagacaaacataacattgactttggattttatcacatgatttacattcatgattacatctcatcatgcagtgcgttgattgtgcttgttatacggaatgtattgctcctcagcaaatatggattttctaatatcactaatttttaattcagaattaatatttgaatgtattaattttctgccttttagagagtaatggagtattgtataactcattgaggattgatcggtatgtaccttaaatcttaaacaatttgagaattattaacaaatctataattaagtctaccacttagagaatcttttctctggcacaataggaaagttaggttctagttgaagaaactgaagaaagaggaggcagttttgaggtctttatttggccattagcttgctttaactaagaaggtttttttttcctgtgctttttttacccccttatctgagtccttgtaaaaagaaacaatatcctcagtgtatgctaaatgcttgacagattaatttttctgcatcacaattgaaaaagttgctcttaaaccagagaaatgaatagatggttctttgtagacttacttggcattgttttcaaggagtttctctgaccatgtcacatagtggatcaatcaacagactttttcagcatccactaaatacttattattgtgcttggcaccacaggatttggaattcagtccaaataaattcaatagattataattgagtactatcccatgttagacactgtgctaggctctgagaaaattagcatgaatgattaaacccaaggtatgtagtctggttgtgaaatacatgtataactaatactgtacatagtgggatgaatgtcaaatgtggagtacaaacaaagctgagtgttagtagtgatgaggaaatgattcattctaactgaaaagattgaggactacaaaataataggtatcatttatgaataacccgagatggtacaggtactctataaagaattgatatttataagtccccttgggatagttttcatatcctcattttattggttagaggattcagaaaacttaagcagcttgtccaaatcacatagctagtagttatcagaatcagcaactagaatctgagtctgtttgatttcaaagcctatgttcttattagcaacactgtgacatctgtgcttgcaggggatcatttcagattaaaaggagcagtgtaaataaaggtacaggtttaagaaggaagtgttgacaggtaggttgtagtccattgtgactaggcatggcttagaagccctggaaagactgaaggcatattgtggaagattttgaattctatgctaagagattggactttattctaggtatagtcactaaaaaattataaaaaacaaaaaagacaaatagacaatgacaatatctaataggtgctaattatctgatgcaaatcagtgtatctcaatgtaatttaaaaattgtgctattattaatacaatgacaatattaaaaaataatacgtcatctaaatcaccttataactgagtccaccactgcaactgtttgcttttctgttcatatgcatgttggttctaagaagtacacattgggctaatgagaatagaacagaaacaaatttcatgtgtaaatgacaccattttaggaagtgaacgtcaaatgatgttagactgcacacactgaacaaataatgtgttcatattaatgaggagagagaaaaggagtgagagacgcttatcacctcacagctcactgtggcctatgcacaacaggcttctaggtcttgcatcagcctcatatcttcagtgggagtagttagcagaagtaaaaatcacattgagttaatgttaatttgaaatttattgattttggtatttaatatataactttgctttggtttcataattacataaatgttatgaccctaaggagtttataacattttaagttagcatggatttaaatacaaatatgctatatagttatacttaaggctaacatgggagacccagaaacgtgtttttctcttaagtttgaaaaatacttcatgaacaattcctactgagaaacattaacatagtacctgaaggaaaaggggctagaaggtggggacgaattccgaatgaaataggattataagcagaaacacagaaacaggaatgaagagatggttacactagagcatgaagttcgttttgtggtaagtaggcaagagagccagacaattaagaaactcatatcactgaagtttcatatcaccatagaaaggggtcaatatggactcttcaggaagataatgaaaatgtgacttaatttgagttacccccaaaacacactctgagaagaggatttgaatgaaggagttttttggggggctggtcccaggaagcactggtagaggcttggtgaagtgagacagaggaggaagggaggaccataaagagtatgttacctggccgggtgcagtggttcacacctataatcgcagcactttgggaggctaaggcaggtggatcatctgaggtcaggagtttgagaccagccaggccaatatggcgaaaccctgtctctactaaaaacagaaaaatttaaaattagccgggcgtggtggcacatgcctgtaatcccagctactcaggaggctgacacaggagaattgcttgaacccaggaggcagaggttgcagtgagctgagatcatgccactgctctccagcctgtgacagagagaaactgtgtctcgacaaaaaaacaaagtgtgttaccccaagcatgttacctctgtgggtcactagagcttaatcccactgggaactctgggagcaaatgcagaacatgtgccttggggctatcccttcaatggacagagaggctggaatgcttattcgccttcttccaccagcatttggttgagagatttcccagggcacgtagactcagcggcaggcctagcctgaggcataagaaacaaggcagtggctggaggccaaagaaagcccccaggcagagcaatgcaggcactggcagttggaagcagggctgtgtgcaagaaagtggtaaggccaagggaatatgggaggagcgtccagtgtctgctaagtgaccttttacctttttaagactgtccattttgtggacaaaggacactgacatttcagagtttctgtcatgtgccttgaattatgctgaacacttttacatttgaattttataaaaattctgtggtatatttattttctccatgagggggtggaggggatctccaatagcacataaagctcacgctcagaaagtttagtacctcttgaaggtgacactgctgagtcatgttgaagttagaattgggagaggattttgaacccaggtatttctgacccagaggcttctgattcttctatctactgatggaatggagaaactagaaagagtttggaaattacaaggatagaagataataatgaatttagattgtgccctatttttcatttatatgtttattaagaaattaatttttttctttattctaattgcacatggctaataacagtctcattttcaatgtgttaaataataaggtttttgtgtccttgagtatttattttggagatacatgacatagaaacatcttaacatttagggataatattcttttatgatagtgtttctcatagttaatctgaagtttttaatagaatcagtaataataatgacaatatccatcttatattattcttgtaggacttttcattataccaaataaattactaaattaattttagtgagtcattacaataggtatgtgacaccagtaacagtcttattattaccaacttaagaagaagctaaagttgaactcagtggcttgtctgatgtaattcagctcatctttgatgaagtcgggtctgagaactgcattatttccggatttgtttgtggaatgcaagtgtagctccctttatacaatgtgcagttctgaaaaagtgaattgttattactacaaatcttattattcaaagcaatcctattgtgaatcctttggtaaaccgaatagcttgtcttttgttcaaatgtggattttttgcatttagatttgcctgaaagtaaagagtactttggccatttttgccttggaaatcattatatttgtttcttgatgcacatcttacatcttgaggttttcctcttatggcagtcatagagattttcctttgaatgtgtctttccacttacggttgctgcaatctcctgcagcatttgtactggttggtatcatttctcaactattgatttcaattaccttatctaggtccttaggacaagaagtgagaaatatgatacccaactctaaagaaagaggttttgaagggaaatgtgctggaatgtggatagagcttttttctgttctaacatgagaatcaggactacctacattcattgatattggtgctgatagtgttattgcattcctatggacattaagaccaccaaggcctgcatatgacttgtactttcaggcctgagaatgcttgtagtttgtcagcggtttgggaatatggttcccctctgatgtgtgtccctacttagccctgtggatttaggctcctcttcttgaaatggtgccatctatctttgatcactgctgtcatttcctaataacccacagcttcagactgtttggctgtgttgctttggagtgctttttttcctgcttaccttgcatgtggttgttccagttcatctcatctgactatataagcagttacttaggaattctgttgtaatctgtctttgcattcctaacctcgtgaaactgaggcatatgcagcatgcttcagtgatgggaagttgatcaaatgctttaagtacgtgggattcattgatgtgtcgaatgttggacataagcaaccttcattctgccccttcatcttattttatattactttaaatagtagaatgtactgtattcctcgttataaatggaaatcttagaacttgataaaaatttaaaagaaattacctatagatccactacctaaagaatgccactcttaacagttttttccatttaattacctgtgtccagttcattaaaaatacatttatagcctatatataattttatattttgcttcttatatttaacaggacatgattggcatttctgaatgtatataattcataagtataattttaatatttatatactatttagaaagagttttcataccttaatttatttaaccaaacccctattacattatgttttaaatatttcaatgcatatcaccaaattgtcttccaatagtgtaataaaaattcacattcttattagcaatgtatgatagtgtctattttactgaaccttgttcctctatagctattctaattaataccattgtttctggtaatctgctggacaagaaatgccatcttcttattttaaattgcatttattaggcttatagcaaggatgaaaaattgttgtatgtttttaaaattctattctttcttataaaatttctatttatattctctgttcatttatctattagtttctcagtggttttcttattggtatgtatgagtaattttcatagtaaatatattactcctttaccatatcaactgtatatatttttctagttcttatttttaacattcaatagctgtaaatttttatgtagctagatgtatgatcctttattccacatgagtttttttttttgtttgttttcccagtgaggaaagtattcagctctaagtaacagaattcctaattaacagtgacttacacaagagagtggtttatttttcttgcataaacagaagtctggtggtaggttgtaacagcagtggtttagtttctcagtaaaaccgttttagaaccaggcttttttttctctttgttctatcatcttttatcattatcagatttttaaaaatatataagcaacttcttcattaagaaagctaaggcccagagaagttaagtgatttgtccctgctactcagctaatggagtttcctttttctgtctctacactctttttttttttttttttttttgagacggagtcttgctctgtcgcccaggctggagtgcagtggtgagatctctgctcactgcaagctccgcctcccgggctcacgccattctcctgcctcagcctccctagtagctgggactacaggtgcccaccaccacgcctggctaattttttgtatttttagtagagacggggtttcaccgtgttagccaggatggtctcgatctcctgacctcgtgatccgcctgccttggcctcccaatctgtctctacactctttctgttgcactgtgctgtcgcatatcttgctgtgcatttcacattggtacctgctattggcatacaaaacacatacaaatatgacttcgctctgtactccctcaagaggtgtccaggcaatattatgtattagcaattaacacctcagctattaaattcttttataataaaccataatttaaaataacatgggaattcagtatctgctaagttgaaaactttatttactctcattgtatttttgcagatgtgacagaactttttgatagaaagagctcaaatgtttaagagcatggttcaattcttattttatgtattaaaaactaatttgtagcaggagatcctgaaacctactgaagtgaaatatcagacaggctttgatcaacgaaagaaagaaatactctcatcaatctttgtaagcctctcattggtaaatctaaatcaacatatataaagtctatatctgtgcaaagcattcaacctgcccctgtggtaactgagctcgtaaattagttgaggagacaagagcaatagataatatttaatccacaaaagatgtaaacagtagttgaaagcaactataaattaaatgccacagagtagggcatgtctactttctaagcaatagaatacataatattttcttaacttcacttgtctatgaaccaacatcattattttttgccctaactataaagtttatttaaatattaatatattttttctttaaaataactttgaagcaatttagtttataaaacttaatcttgctgagtgataatacccatgaactcatgaattcaatcttctagctgtacttttttgtttttaactgtacatattttaacacattaaaataaatgtattaaaaaaatggtcttcatgtatcatctaaaaattatcttatgtctcagtctttgggaaacactggcttaaacaatcaattactagggagttcagatgaggaacaatagaacaaatttgcagtgattctattaaaatatatgaattaaagaattctcttgttcccctaaggccataatcaaaattatagttcagatatattgtctgctaggtaatagcatattaataaggatttcttatgtgttcatagatattttatataatttagctttaaaaacagccttcagataacagtctttcatgagtgttgaaaagacttcagtttcattcttaatctttcagtaatagatcccaggagtgaataaggttacgcatttcacttttataatcatctttgctcagtctgctgaaggtaggaatgccttaatatggcatagcacagtattttttctaggctgctttataatttgttgagaatgattgcaaatcttactaaaagcaattcagatacttcaaaaagagctcatcattcatgattaaagacacataagcctaaagaagtatctccagctaattttgaagaatcattaaaatattttgggaatcagccctcttaaacaaatataacaaaatttagaattctgtttacacttagacatttctaggcttatattcattagcccataaaatccagactatagattaaagggaaacattttaaaatgttagctgttttgaatggaaatctttctaaaatatactatgcaattctaggcctgatagtgaacaaaacatacattttctttaagactcaggatctttttttttttttttttttttgagactgagtctctctctgtcacccaggctggagtgcagtggtgcgatctcggctcaatgcaagccccgcctcccgggttcacgccattttcctgcctcagcctcccgagtagctgggactacaggtgcccaccaccacgcccggccaacttttttgtatttttagtagagacggggtttcaccgtgttagccaggatggtcttgatctcctgacctcgtgatccgcccgcctcggcctcctggtttccgttggactttattttgcagctattatgcttgtctccctaatacgcctctacttttactatccttcttcaaatgtgttactcgcagtattctaagacctcagaattacatagtggagtttgttaaaggtatcattatagcatcagaaagtggagacatcaggggcttttttcttcctacttctaattcagggtagtgttgtgaatggttgcagttgtgagaggattaaagattcattaagtgagctgtttagtgaactattttctagtttttattagttttgattctgaatgatgatcgctttattaatgcttcatcaacacactgggatttacagctttcaaaggttacttttatatgcaagattggatttggtctagactgtctgagtttactaatgtttaccatcttgagaactgataaagtgaagacattcaccaaacacttagaaaattttaaagacataccttttaactggctatgacatagcaaagaaatattctctttcttttacaactctgctatttagattctatccgtttatacttctcatcttagttgcatacaaaaattcacatgtgtacacactccccccgtacacatacagagaacaataacttttattatttcattcattcccttggggatcaaatatgtgtccaatgagaagatccaggatgtcatactaccatataccaaggagacctttgttggggaaacaagttgagaaatgatgatccgttaatgatgtccacagcgggggctgcaagacatcttactgacaagagaggaagaaaatactggaagtagtacttatatttatatcataaattaaaagtcagagggctgggatcatgcctgtaatcctgacactttgggaggccgaggtgggtggatcacttgaggtcaggagttcaagaccagcctggccaacatggtgaaacctcatctctactaaaaatacaaaaaatttgctcggtgtcattgcacgtgcctgtaatcccagctacttgggaggctgaggcaggagaattacttgaacccaggaggcagagtttgcagtgagcagagatcacgccattgcactccagcctacatgacagaacaagactccatctcagagaaaagaaaaaaaaaaagagtaaataaagacttactagtaatcaatatccagagcttacaatttagatatttagatgaggtatcttaaatgaagactatttgacaatccagtggagttcacagaagttccttctttaaatattaactttccaattattgaaatattttatgattgtggcatattttaacatatttcaacaagatgatataatgttaattttatacaagtaagactttaaaaattatggatcattagaatactttttaatgagatgaggaatgactgggaaaatattttgaattacattgaggcccacagtttttctggtgacaaagttcttgaaaatgttatttaagatgagttatatagatttacacaaaagccaggcttctgatttggttgatgttttctgtggccatctgtggcagtcagaaagcagttattttggcatgaggttcagagagcttctaggttggtgagcacatggaggtgctgtgagtgtggtgtactctgagagggcatgaaagccccttcccctttactttggcctatggatcccatccatttggctgttcctgagttgtatcctttacaacatactactaaatataaaagaagggaaaaaaaaggcaagcagttatgttgaaaaacctgaaatatactgaattagtctcaaacacaataaagtcaatgttttagtaatgagtgaaaaattaagtgcttttcaaaaggagcccatggagaaagcattctgaaatggctatttggcaaggctgtcatcattttgttttactgtatgttcttttcttaaggatctttgaattgtagactagtttacatactttataaataatctaggttaatattggcaacacatgtaacagatattatacttttataattattcagaaaattatatatacctttaatccctccccaatactcactttaataaatattaatttattaccaaaagaaggtgtgagatctaagaactctgagtcttgtagcaggtaagacatttgtaagggctacttcttaataaaattttccatttcctttagatgtttctaaaattagaagttttaaaatatattcgtttgatgtgattacttaggggctcaagcagagaatttagattgattgggcttgcaataaaaagggactttaaaaaatgacatcatcagaaagaaggcaaataatcagctctttctggatcaggaaggggaattctgacaaatatttatacttatgagacatatacatgggtgcaagagaagtgacatcggaagaaaaagtacacatttttgtatttaaaaatctatcaatattatatatgaacatctgaaagatatttatatataaatatacatgtaaatattatggcatataaacagatttatatatgtgtgtatgtatgtaggtaggtatctacctatggaatatactttttcttcagaagtcagttcttttgctttaaaactttctcctttaggaaaaaaattaacactgaattttaccagttctaatttttttttactttaggtttttgtttatctaaatgttataaataatgagcacaaaataattttatgattattatttcatggatctgtttctgatagatttgttaaattatactttaagttctgggatacatgtgcagaacatgcaggtttgttacataggtatccacatgccatggtggtctgctgcacccatcaacccgtcatctacattaggtatttctcctaatgctatccctcccctagtctctcaccccctgacaggccctggtgtttgatgttcccttctctgtgtctatgtattttcattgttcaactcccacttatgagtgagaacatgtggtgtttggttttctgttcctgtgttagtttgctgagaatgatggtttccagctccatccatgtacctgcaaaggacatgaactcatccttttttatggctgcacagtgttccatggtgtatatgtgccacattttctttatccagtctatcattgatgggcatttgtgttggttccaagtctttgctattgtgaatagtgctgcaataaacatacgtgtgcatgtgtctttatagtagaatgatttataatcctttgggtatacacccagtaatgggattgctgggtcaaatggtatttctggttctagatccttgaggaatcgccacactgtcttccacaatggttgaactaatttacactcccaccaacagtgtaaaaaccttcctatttctccacatcctctccagcatctgttgtttcctgactttttaatgatcgccattctaactggtgtgagatggtaacccactgtgattttgatttgcatttctctaatgagcagtgatgatgagctttttttcatatgtttgttggccgcataaatgtcttcttttgagaagtgtcagtatgatattggctgtgggtttgtcataaataacttattattttgagatacattccatcaataccaatttattgtgagtttttagcatgaaggggtgttgaattttattgaaggccttttctgcatctgttgagataatcatgtggtttttgtcattggttctgcttatgtaatggattacgtttattgattttcatatgttgaaccagccttgcatcccagggatgaagccgacttgatcatggtggataagctttttgatgtgttgctaattcagtttgccagtattttattgatgatttttgcattgatgttcatcagggatattggcctgaaattattttgtcattgttgtgtctctgccaggttttggtatcaggatgatgctggcctcataaaatgagttagggaggattccccccttttttttttatcgttcggaatagtttcagagggaatggtaccagctcctctttgtacctctggtagaatttggctgtgaatctgtctggtcctgggcttttttgggttggtaggctattaattactacctcaatttcagcacttgttattggtctattcagggatttgacttcttcctggtttagtcttgggagggtgtatgtgtccaggagtttatccatttcttccagattttctagtttatttgcatagaggtatttatagtattctctgatggtagtttgtacttctgtgggatcagtggtgatcgcccctttatcattgtttattgtgtctatttgattcttctgtcttttcttctttaacagtctggctagtggtttatctattttgttaatctttttaaaaaaccagctcctggattcactgatttttttgaagagtttttcttgtctttctctccttcagttctgctctgttcttagttatttcttgtcttctgctagattttgaatttgtttgctgttacttctctaggtcttttttttttattatactttaagttttaggatacatgtccacaacgtgaaggtgcaggtttgttacatatgtatacctgtgccatgttgttgtgctgcacccattaactcgtcatttagcattaggtatatctcctaatgctatcctttcccccacccccaccccacaacagtccccggtgtgtgatgttccccttcgtgtgtccatgtgttctcattgttcaattcccacctatgagtgagaacatgtggtgtctggttttttgtccttgtggtagtttgctgagaatgagggtttccagcttcatccatgtctctacaaaggatatggctgcatagtattccatggtgtatatgtgtcacattttcttaatccagtctatcattgttggacatttgggttggttccaagtctttgctattgtgaatagtgctgcaagaaacatacgtgtgcatgtgtctttatagcagcatgatttataatcctttgggtatatacccagtaatgttgggtatatacccagtaatgagcatggaatgttcttccagtaatgggatggctgggtcaaatgctatttctagttctagatccctgaggagtcgccacaccgacttccacaatggttgaactagtttacagtcccaccaacagtgtaaaagtgttccgatttctccacatcctctccagcacctgttgtttcttgactttttaatgattgccattctaactggtgtgagatggtatctcattgtggttttgatttgcatttctctgatgaccagtgatgatgagcattttttcatgtgttttttggctgcataaatgtcttcttttgagaattgtctgttcatatccttcacccactttttgatggggttgtttgtttttttcttgtaaatttgtttgagttcattgtagattctggatataagccctttgtcagttgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctagcttttcttctagggtttttatcattttagatctaacatgtaagtctttaatccatcttgaattaatttttgtataagttgtaaggaagggatccagtttcagctttctacatatggctagccagttttcccagcaccagttgttaaacagggaatcctttccccatttcttgtttttgttaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcgggctgtattttggttccatatgaactttaaagtagttttttccaattctgtgaagaaagtcattggtagcttgatggggatggcattgaatctataaattaccttgggcagtatggccattttcacgctattgattcttcctacccatgagcatggaatgttcttccatttgtttatatcctcttttatttcattgagcagtggtttgtagttctccttgaagaggtccttcacatcccttgtaagttggattcctaggtatgttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagatgatggggttttctaaatatacaatcatgtcatctgcaaacagggacaacttgacttcctcttttcctaattgattgccctttatttccttctcctgcctgattgccctgaccagaacttccaacactatgttgaataggatggtgagagagggcatccctgtttgtgccagttttcaaagggaatacttccagtttttgcccattcagtatgatattggctgtgggtttgtcatagatagctcttattattttgagatatgtcccatcaatacctaatttattgagagcttttagcatggagggtttttgaattttgtcaaaggccttttctgcatctattgagataatcatgtggtttttgtctttggttctgtttatatgctggattacgtttattgatttttgtatgttgaaccagccttgcatcccagggatgaagcccactagatcatggtggataagctttttgatgtgtcactgggtttggtttgccagtattttattgaggatttttgcatcaatgttcatcaaggatattggtctaaaattctctttttttgttgtgtctctgccaggctttggtatcaggatgatgctggcctcataaattgagttagggaggattccctctttttctattgattggaatagtttcagaaggaatggtaccagttcctccttgtacctctggtagaattcagctgtgaatccatctggtcctggactttttttggttggtaagctattaattattgcctcaatttcagagcctgttattggtctattcagagattcaacttcttcctggtttagtcttgggagggtgtatgtgtcgaggaatttatccatttcttctagattttctagtttatttgcgtagaggtatttgtagtattctctgattgtagtttgtatttctgtgggatcagtggtgatatcccctttgtcattttttattgcatctatttgattcttctctcttttcttctttatgagtcttgctagcggtctatcaattttgttgatcttttcaaaaaaccagctcctggattcattgattttttaaagggttttttgtgtctctgtttccttcagttctgctccgatcttagttatttcttgccttctgctagcttttgaatgtgtttgctcttgcttctctagttcttttaattgtgatgttagggtgtcgattttagatctttcctgctttctcttgtgggcgtttagtgctataaatttccatctaaacactgctttgaatgtgtcccagagattctggtatgttgtgtctttgttctcgttggtttcaaagaacatctttatttctgccttcatttcgttatgtacccagtagtcattcaggagcaggttgtttagtttccatgtagttgagcagttttgagtgagtttcttaatcctgagttgtagtttgattgcactgtggtctgagagacagtttgttataatttctattcttttacatttgctgaggagagctttacttccaactatgtggtcagttttggaataggtgtggtgtggtgctgaaaagaatgtatattctgttgatttggggcggagagttctgtagatgtctattaggccctcttggtgcagagctgagttccattcctggatatccttgttaactttctgtctcattgatctgtctaatgttgacagtggggtgttaaagtctcccattattaatgtgtgggagtctaagtctctttgtaggtcattcaggacttgctttatgaatctgggtgctcctgtattgggtacatatatatttaggatagttagttcttcttgttgaattgatccctttaccattatgtaatggccttctttgtctcttttgatgtttgttggtttaaagtctgttttgtctgagactaggattgcaacccctgcctttttttgttttccattggcttggtagatcttcctccatccctttattttgagcctttctgtgtttctgcacatgagatgggtttcctgaatacagcacactgatgggtcttgactctatccaatttgccagtctgtggcttttaattggagtatttagcccatttatatttaaggttagtattgttatgtgtgaatttgatcctgtcattatgatgttagctggttattttgattgttagttgatgcagtttcttcctagtgttgatggtctttacaatttggcatgtttttgcagtgcctggtaccggttgttcctttccatgtttagtgcttccttcgggagctcttttagggcaggcctagtggtgacaaaatctctcagcatttgcttgtctgtaaagtattttatttctccttcacttatgaagcttagtttggctggatatgaaattctgagttgaaaattcttttctttaagaatgttgaatagtggcccccactctgttctgacttgtagagtttctgctgagagatcagctgttagtctgatgggcttccctttgtgggtaacctgacctttctctctggctgcccttaacattttttccttcatttcaactttggtgaatctgacaattatgtgtcttggagttgctcttctcgaggaatatctttgtggcgttttctgtatttcctgaatttgaatgttggcctgccttgctagattggggaagttctcctggataatatcctgcagagtgttttccaacttggttccattctccccgtcactttcaggtacacaaattggacgtagatttggtcttttcacatagtcccatattccttggaggctttgttgatttctttttattcttttttctctaaacttctcttcacgcttcatttcatttatttcatcttccattgctgataccctttcttccagttgattgcattggttactgaggcttgtgcttttgtcacgtagtttttgtgccttggttttcagctccatcaggtcctttaaggacttctctgcattggttattctagttatccattcgtctaattttttttcaaagtttttaacttctttgccattggttcaaacttattcctttagctcaaagtagtttgatcatctgaaaccttcttctctcaacttgtcaaagtcattttctgtccagctttgttccattgctggtgacgagctgcgttcctttggaggaggagcggtgctctgatttttagagtttccggtttttctgctctgttttttccccatctttgtgattttatctacctttcgtctttgatgatggtgatgtacagatgggtttttggtgtggatgtcctttctgtttgttagttttccttctaacagtcaggaccctcagctgcaggtctgttggagttttctggaggtccactccagaccctgttttcctgggtttcagcagtggtggctgcagaacagcagatattggtgaaccacaaatgctgctgcctgatcgttcctctggaagttttgtctcagaggagtacccggctgtgtgaggtgtcagtccgcccctactcgggggtgcctcccagttaggctactcaggggttggggacccacttgaggaggcattctgcccattctcagatctcaaactgagtgctgggagaaccactactctctttaaagctgtcagacagggacatttaagtctgcagaggttattgctatcttttgtttgtctgtgccctgccccccagaggtggagcctacagaggcaggcaggcctccttgagctgtggtgggctccacccagttcgagcttcctggctgctttgtttacctactcaagcctgagcaatggcaggcgcccctccccccagcctcgctgccaccttgctgtttgatctcaggctgctgtgctagcaatgagcgaggttccgtgggcgtaggaccctccgagccagttgcgggatataatctcctggtgtgccatttgataagcctgttggaaaagcgcagtattaaggtgggagtgatccgattttccaggtgccatctgtcacccctttctttgactaggaaaaggaattccctgatcctttgtgcttcccgggtgaggcgatgcctctccctgctttggctcacgcatggtgcgctgcccccactgtcctgcacccactgtctggcactccccagtgaggtgaacccggttggaaatgcagaaatcacctgtcttctgtgtcactcaccctgggagctgtagactggagctgtttctattcggctatcttggctccaccccttctctagttcttttaatagtgatgttaggatgttgattttagatctttccagcattctcctgtgggcatttagtgcttcacatttcccctaaacactgctttagctgtgtcccaaggattctggtacgttgtgtcattgttctcattagtttcgaagaacttatttatttctgccttaatttcattatatatccagcagtcactcaggaacaggttgtccagtttccatgtaggtgtgtggtttttaatgagtttctttatcctgagttctaatttgattgcactgtggtctgagagactgtttgttatcatttctgttcttttgcatttactgatgagtgttttacttccaataatgtggtcaattttagaataagtgtgatgtggtgctgagaagaatgtatattctgtagatttggggtggagagttctgtagatgcctattaggtctgcttggtccggagctgagttcaagtcctgaatatcctttttaatttcctgtcttgttgatctgtctaatattgacagtggggtgttaaattcatccactattattgtgtgggagtctatgtctctttagaggtctctgggaacttgctttatgaatctgggtgctcctatattgggtgcatatatatttaggatagttagctcttcttgttgcattgattcctttaccattatgtaatgcccttctttttattttctgatctttcttcgtttaaagtctgttttatcagagactaggattgcaacccctgctttttttttttttgctttccatttttttgggaaatcttcctgcattcctttattttgagcctctgtgtgtctttttttgggggggggcgttgggggcaccgtctcactctgtcaccgaggctggagtgcagtggctcgatcttggctcactgcaacctccgcctcccgggttcaagcaattctctgcctcagcctcctgagtagctgagattacaggcacatgccaccacacttggctaactgtcgtatttttagtagagttggggttttatcatgttgaccaggctggtcttgaactctagaccttgtgatccacccgccttggcctcccaaagtgctgggattacaggcgtgagctgtcacgcccagcctctatgtgtgtcattacatgtgtgtcattacatgggtctcctgaatacagcaccccgatgggtcttgactctttatccaatttgtcagcctgtgtctttgaattggaggatttagcccatttacatttaaggttaatattgttatgtgtgaatttgatcctggcattatgatgctagctggttattttagttgatgcagtttcttcatagtatcgatggtctttacaattcggtatgtttttgcagtggctggtatcggttttttctttccatatttagtgcttccttcagcagctcttgcaaggcaggcctggtggtgacaaaatctctcagcatttgcttgtctgtaaaggattttttttctcctttgcttatgaaccttagtttgcctgtatatgaaattcagggttgaaaattgttttctttaagaatgttgaatattggcccccactctcttctggcttgtagggtttctgcagagagatctgctgttagtctgatgtgcttcactgtgtgggtaacctgacctttctctctggatgcccttaacattttttccttcgtttcaaccttggtgaatctgacgattacgtgtcttggggttgctcttctcggggagtatctttgtggtgttctctctacttcctgaatttgaatgttggcctgtctagctaggttggggaagttctggataatatcctgaggagtgttttccaactgggttccattctccctgtcactttcaggtacaccaatcagttgtaggtttggtcttttcacatagtcccatatttcttggaggctctgttcattccttttcattctctttttctctaatcttgtcttcatgctttatttcattaagttgatcttcaatctctgatatcctttcttctgcttgatcaattcacctattgataaggtatcatgcttcacgaagttctcgtgctgtgtttttcagctccatcaggtcatctatgttcttctctaaactggttattctagttagcaattcctctaaccttttttcaaggttcttagcttccttgtattaggttagagcacgcttctttagctcggaggagtttgttatttctcaccctctgaagcctacttctgtcaattcatcaaactcattctccatccagttttgttcccttgctggtgaggagttgtaatcctttggaggagaagaggcattctggtttttggaattttcagcctttttgagctgttttttattcatttttgtggatttatctacctttggtctttgctgttggtgaccttctgatggggtttttgtgtggacatcctttttgttgatgttcatgctattcctttctgtttgttagttttccttctgtcaggctcctctgctgcacgtctgctggggtttgctggaggtccactgcagaccctgtttgccggggtatcaccagcagagaccgcaggacagcaaagattgctgtcttttccttcctctggaagcatggtttcagaggggcatctgccagatgctagccggagctctcctatatgagatgtctgtttactccctctggaaggtgtctcccagtcaggagatacggggatcgaggactcacttggggaggcagtctgtcccttagcagagctcaagtgctgtgctagaagatcttctctcttcagagctagcaggcagtaacgtttgtctgctgaagctgcgaccatagccgcccctacccccaggtgctctgtcccaggaagatgggagttttatctataaacccctgactggggctgctgcttttttttcagagattccctgcctagggtggaggaatctagagaggcagtctggctacagtggctttgccaaactgtggtggactctgcccagttcagacttcccggtggctttgtttacactgtgatgggaaaactgcctactcaagcgtcagtaatggtggacgccccttcccccaccaagctcgagcatcccaggtcagcttcagactgctgtgctggcagcaagaatttcaagccagtggatcttagcttgctgggctctgtgggggtgggatctgctgaactagaccacttggttccctggcttcagccccctttccagggaagtgaacagttctgtcttgctggcattcgaggtgccactggggtatgtaaaaaactcttgcaggtagctcggtgtcttcccaaaaggccgcccagttttgtgcttgaaacccagggccctggtggtgtaggcacctgagggaatctcctggtctgtgggtttctatgaccatgggaaaagtgtagtatctgggcgggaatgcactgtccctcagggcacaatccctgtgggcttcccttggctaggggagggagttccccaaccccttgggcttcccggatgaggcaacgctccaccctgcttcggctagccctccgtgggctgcacctactgtctaaccagtcccaatgagatgagccaggtacctcagttggaaatgctgaaatcacccgccttctacattgatctcactgggagatgtagaccggagctgttcctatttggccatcttgccagccctttctgatagattttgacatgctgaatgacaacagcattatgagccttttcttatttaaatactggcattatgccttctatgtgaggtttaatgggcttcagttacaatagagggttcctaggggcattattaacatttagaatgatgtctctaagtagtatctttgctgcttctgttaattgatggcactgttatcatgaattatggtgcaacattctaagcaacaaaataaaagttcatgcgaattttactaatttttgtttcattgatttatgaattcaagcatacaaatgttaaaacaaaaatgaaccttaggagtgccttctaaggttctaaggttagaaggtactctttctaacgtgtagttatctgacataggaaactacctttaggggaaaattattgaggggtaaaacatgaaaaatctcttctaaaaatgattaacttattaatcttgaaaatgtatacaaatgggacagcaaggttttaaaaataattcactatttttgcttgggaaaataaaagaaataaaagaaataaaatcagcattattttctttttgttagctatgatgttcagcatgatttacatgatttaaaatttgcaaaggagacaactgttggtctgcattgacttattaaaagtatttccttaagaaccaactcaggaaatcttaattagcattcaggggagtttcaacaaattttaagtttctgttgaataaatttcttccttataattctaactaattttaatattttgattttcttctgtgtgtaataatctagcaactgattactgtttagaataagcaatctgttcaatctttgtgaggaatatttacttctgtaatgataggattgttacagtcatattttttgctttatttttatttagttctgtttgcaatgcattttttcaaacattcatttgttcgttcctgttttattcatttactaagcatttacagaatgcttactgtaaaattggcattgtttttaatacttaggaaaacaatttccagcatatgttgaatgctttatatgtactactaagtgcattagttaattatcttttttaatccccacaatcatatactgggaaatagcctatttattaatgtgggccttgggtaaaaagagatgaatacattgtaatcacttttcttggtaagttcacagtctaatggagttggacccagaaaaataattaattaaaattttatgggataagtgttgtacaaaagcttgtgttcatacttggaccttcataagaaggactatctaattgtgcctgaaggagttagaaaaggtgttacagagggaatgacatttgaggtgagtcttaattgttaaatagaaatttgtccagggaatgaaggcagaaacactgcttatagcaatcatgaaatgatgaaggagcctggtatttggtggtcctggtgagtgagctgcgtggcattaaactcaggtgtttttgtgtatgtgtgtatgtaggtgtgagtgtgggactgtgtgtgtggtctgggcctggaagatgtaagaaggtaggaagggaggataatgaggctggagaggtagattcggactttatagtcaagaccctcactaagaggtttatttatttatatttttaaaagttttattttatttttaattgacacatagtaattatacatatttatggagtagaacgtgatgtttcaatacatgtatacaatatgtaatgatcaacctcaaatatttattatatctttgtggtgagaatattcaaaatcccatattctagctactttgaagtatgtaatgtattatttattgttaactacagtcaccctactgtgcaatagaactggaattcattcctcctatctaactgtaactttatactggctgaccaccctctccacatccacctgtagcctcctgcctttcccagccgctggtaaccactattctattctcaacttacatgagatcaacttttttagatttcacatatacgtgaggtcatggggtaattatttttctatgtttggcttattttacttatggtgccctccagttcatccatattgttgcaagtgacagaactgtcttgttttttaaggctgaatagtattccattgtgtatggacaccaaatttttcaatctgttcatatgttgatagacacttaggttgattctctttcttggctattgtgaataatgcttctaacaaacttggagtgcagatgtctctttgacattctgatttcattttctttggatagatacctagaagtaggattaaaggatcatatggtagttctatttttaaatttttcagaaacctccatactgtcgtctatgatagcttaactacttttcatatccactaacagtgtgtaagagttcccctttcttcacatccttgccagcatttgttatcttttgtctttttaatgatggcctttctaactggagtgagatgatgtctccttttagtttttatatgcatttccctgatgattattgatggtgagcatgttttcatgcacttgttggccacttgtatgtcttcttttgggaaatgcttcttcagatcttttgcccattttatagttggattattttattattattattttttacttttttttgctttggagctgcttgagttccttatattttctggatattaaccccttgttagatgcatagctggcaaatattttttttcccattttgccagtttgtctgttcattctgttgattgtttccctttgctgtgcagaagcttttgtgtttcatttaatccaatttgtctgtttttattttcgttgcctgtgattttgaggtcttatccaaaaaaaccttgcccagctaatgttatgttatgaagtgtttgttttcttctagtagtttcatagttttggatcttacatttatttcattgtggccagaaatgttatttgatacaatttcaatttttaaaattttgttaagacttgttttgtagtctaacatgtggtctatcctggaaaatgttccatatgctattgagaagaatgtatattctacagatgttggaatgttccataaatgtcctttaggttcatttggttagaatgcagtttaactctgatgtatctttgttgattttctgcttggatggatctgtccatcactgaaagtggggtattaaagtcttctaccgttaatgttattgcagtctatctttttctttaggtctattaacatttactttatatatttaggtgctctgatgttgggtgcatacatatttacaattttatttcctcttcctatatagacccctttatcattatacaatatatttttgttgcttttcacagtttttgacttaaagtctattttatctgcaatgaatgttgccacctctgttctttttggtttccatttgcatggaaagtctttttccatttcttcacttttaggctatgtatttacttacaggtaaagtgagtttcttgtaggcagcatgtatttaaatttattcagccactctatgttttctaattgcagaatttaatccatttatgttcaaggtaattgttgataggtaagggtgtactcctgccattttgttatttttttttccagttgttttgtagatcttttctttctttttctcttactttccttttttgtgattaggtggttttctctaatagtgtgttttgattccttgtttcttatttgtattttgttttttataggtttttactttgtggttaccgtgaggcttgcataaagcatcttacagttataacacattattttaaactgataacaacttaccttaaaaagaaaagaatcacacaaaaaaccccagtatactttaactccattccctccaatattttgaagtgttgatgtcacaatttacatctttttatgttgcctataccataattaattaatataattatttttaatagtttttcttttagtcttcatattaaagatacaagtggtttacacaccatgattacagtattagagtaaatattaaattaagtctagtttgtctgcaaagttacttttatcagtgagttttataccttcagatagtttcacacagtagcatctttttgcacattagcatcttttcacacattagcatccttttctttcagtttgagggactccctttagcatttttttttttaagaacaggtctgatagcaattaattgttcatcttggaaggtctttatctctccttcatttctgatggaaagctttggtggatacagtatttttggcagcttttctaactctagcactatgaatatatcatcccactccctttgggcctacaaggttcctcttgaggagtctgctgccagatgtattggaattcccttatatgttatttgctccttttctcttactgctttcaggatcttctctttgttttcaacctttcagagtctgatataacactaccccaagacctttcagagtcttggggtagtgttatttggtttgaatctgattggtgacctttaaaactttcctgtacctgaatattcactaaaaagttttaaatttgaggatcaatttgaatgaaaacatgagccatgcctctatataaatgaatatttagaaaatattttagaagtcatgagattaacaactttagaagaggtaagttgaaccaactgctgaatatatctgtctgatatattcttttggagtttattgtctcactttaaaaattaccaattagaaatattgtctttataaaaactagtagcaatggtaagtttattagaattaaactgtagaactgaaaagaaacatatcactgttttaaattttttaaacaacaaatatactgagtttcctgaatattatgcaactgcatgctatctagtcttgactactgagctactaatcactttgtagcttagaaatgaataaatgagtaaaccttcatttattaccttttgttttcttgagacaaagtctccctctgtcacccaggctggagtacagtggcgcaatctcagctcattgcaacctctgcttcccaggctcaagcgattctcatgccttagcctccctagtagctgggattacaagtatgcaccaccacgcccagctaactttttgtatttttagtagggaaagggtttcactatgttggccaggctggtctcgaactcctggcctcaagtgatccgcccacctcagcctcccaaagtgttgggattacaggcgtgagccaccatgcccggcgtattacctttctttctataatttgactcacagtcagttggtactgattctgccactaacctggtgggcagaaacagtgagcaatatctgacttaatattttaatgaggaacaaaaatagagtggattaactaaacagagaggaataaataaggtaatttggtctaatcctttcatccttctattaagaaatgtttctttgtattaaaacacatattcaactttattattatccatacctgtatcatttttgcagaatcacagtaaaaggccaagatgtggcagaaagagtgaattatagctcaggctgatggcataattgagactgtcagtctctcaggtaccacagaggaagtagagagtattgactactaggcagtgagagttaacatcagaataatctttctgcagtggtctcttgtgtccagagaattgggaggcgggaaggggactggacagagtttggctactggaagggcctggtaagtagcattagttaagcatagtaggagttcaaatgcacaagcgaagagggtactatcatgagattaagaaaacaggaagcttcaagattccagggagttcaatcaaaacatacaaaggttgggatgaattagagtggcttgtgatgactctctgggcactgggggcaatgagatcaccaagtgttctctaagaaaatcagtcatctgtggcatgatttcagcaagttctcaaggctagcacaacactgttcattgagtaagaggtaaactattactacgttttgaaattttaaagttgtagcacaagattttacatagaaaacatcaggctcttgttatttacattattcagatctgtaagaatagttccgtgtccaagaacttgcttccttgcttcctccacacaaatttgtataggtctacttctttctaggtatttttttaaagaaaaaattgttttcagaatgatttttatactgtttcatttaaaaagtattcaaaattatactttttatacttgctctaacaatgactccatacactggcatcattatcgttaatattttatatattaattttaattttactcattggaggtttgaagtctaatttaaaaattaaaatgttagaattgtaatttaaagcaacatttgtaaatgaaggttcaaactagccgaatgctgtaagatgttaagggatacttttcttattgcactggaattgaaaactaaaactaagggcaaagaggtatcagatgccccatattgtaaagggagcttccagtggtcaaagactcactccatttagtttaaatgcctcccgattaggccttgctttttcctgctattacccactcccatgattatggttgaagggtaggtaccctagaaagcagactccgagataaaggtaaagattagcatgcaggatattactcagggaacatttttaggataaaaacctgtgaaagaatggaaaaggaggcaaaactgagtagtgggagaagttgaactctgttgtagtctcaacaaagccctcaggtgaacctttaggaagctgagatggcccttcaaagttgtcttgagttggggcaaggcctgggcctttatatccccataagtatcagcactgggcagaggaccaagactcatatccccaagatattggatatgagccacccagggaaggggcatgatctagagtgaggcagctgttttctgctgaggtaattcttgaaggggctgccagctaaggactatctgctgtcatttgaattggtgttcctttataggaaatgttctgtttctctctggctgctttcaagcttttttttctttgtgtttagttttcagaagtttaattatagcatggattttttaaaaaatttatcttatttgtcttatcttatttggggttcacttcatgaatctgttggtctatctctttcacaaaatttgtgacattgtcagctattgtgtctttcagtactccttcagggcctactctctttctcaacttctgggatcttttggttttgtcccatgggtttctgaggctctgttcattttaggagactctgggtcctatttaaatcccttattttagtaggtagtaactctgttaggtttacatcgtaggtcctagcctactttagtgggcagtagttctaaggacaatttaattttccaagattttttggtcttattttggtgggccttgtgtatctggtgctggtggggctcccaggggtctatactgtgatgcctgaggggacagaacacatttttctaggctaggcttctttatgtttctaggtggggaaaagaaagtctctggtctgactggatgaagagtgcttccaggcctagctacttattgtggtggagattcccctccacacctccctcaccagcatctcccacccacaagtatcctggtgaaggaggggattctcaggcctggtggaaaagaaatgacttctgaggccagaagcttgttgagacaggatgcctcctgtctgtgggagatggaaagcccttcctgggctgggtgcttgtggtaagattccccagtgcctgtgctccccagccatcagtgtcccttggtgttggagaggaaagtcaggtccgtagatcatcctggcaggtgcttgttgaggcctgatgccccgtgctggtgctgtcctgtgtcttctggtaggagaggggagtctcagaccctgttgagaaggagaacatttttcctgctggttcatcagcttatcttcagtggggctcctcttcaatcccagggaggactgagcctacttgggctgccttctgttgctacattggatgtcagggaatgctggccctgggtcaccttcttccttttggtgggaggttgtaagatgccctgcaactatgctgttcctccagacctgggttctctaatcagttcaccctccttttgcacctttcagagttctcctttggttgcctctcgcattatctccagcgtttacagttgtatttagcaggagtgggtgggaggaggaaccagaaaaaacaaattatgctatcttcaccagacttcagcttcatctgagagggcagaattttgcaaaatagaatatcgtaatctctcatcaacttgtaaaaaattttaaaaaaaatcttcaacatcatgattctgatgtttaaatattatgtattataaaaataacaacatatactttatagatttatttactatagttatatctttttttaaataagatacaaggtcttgctttatcacccaggatggagttcaatggcgcaatcatagctcactgtaacctcaaactcctgggctcaagcaatattcttgtctcattctcctgagtagctaggactaataagtgcatgccaccatgcccagcaatgtatttgtttatttatttattgtagagacagagtctctctatgttgcacagactggaactcctgggctcaagcaatcctcctgcctcagcctccaaaagtgctgggattacgccaccacacctggcctatagttatataatttaatgtgactattttacttacctgtttatttccagcaatcgttccagaacagccacaaacagtgactacctgaaaaatggttgttaaataattaaattataatttgtattctttataattggcatagaggtttcagtaatttgcccaaaattatataactattgatgaaactaaggattaatattaaatacttcttttggtagacaccacatctattgcatctggaataccatatgcaaattctcttattacctattgctgcatctgttttatttctggtctttagaagtctcagagtgacattagaattacaactagttttagtaagtattatttagttatcctgagagatttgttaaataataataatttttaaaagcctctgtagtcagtaatcagcttctcaccaatgataatacttctgtctgagattaatatcagtgcttttcaatgcagcagactaaaactaatctctattatagaatccacagctggcctgatggaactgtaatacaaaagtaattggtattttttgatgtccagaggatgcaaattataatttgtctcctgtgtacagaaaaaaagtgtgtcttgtatggtaaataattaaacttgatactcataaagttatatttttccatgtcttaaaggagatgactattttatacttacagtcgatataaatataataatgtatttatttcatccttgaacaatgtaactaacattttactatatattaatagaagccaactacaatttgaaattaaataattagacttatttaggaaagaaaaattatggttttttatttgctacttcaggttatgatgaagattctctatttgattgtcctaaagtcaagaatgaggagtgctaacgatagaaaacttaggacaaatgaaaacatatattttactttcattttgtgtattttgcaataagcatataaaatcttaggttagccagtttgcatttatttgatgaaagccaaactttaatgtagtatttattattgttttcataaatctaaatttagctcaagtctttcagcattgataattaagaaatatatgccctctttaatagcgatgtatgtttaattgttcatattacctgaagtcatactgagaattttcatctttttaaatgtcaaaatttggctaaggttatcaggatattaaatgtaatatttcaaaggagtatgatctcttatagataattccagattttgtgagatcaaaattgctgattataataatgttagtaaataatatgggaaaggtatggcgaaatatttaaatttttacaattttaagttgtatgatgtatgtaaatgctattttttctggtaactttggtttaaaaaccagtaatactgcctttgacattggtgttaactggatacattgctttttgtgggcattggatatccatctattttgaaataatttgggagaaataaaataattccttaagatatagtctagcatactaaaaagaacatttgtttgatgttgggtgaaaggactcaagcattggattgaatagttacttaccagcccatgaccttgggcaaataacttaacctcactatagcctcagtttcatcatttgttataggaaaagtaaaattcccaatttgcaagattatttggaggattaagatatcataaagatcaaatcttaaacattgcctgatacataatagatgcttagaaaattgtcttcaggatctatttgtatattccattatttggttgttattttgggcatattttctaccttgataagcttactaaagtatgtatcagctggtccactggcttggtgattcagagcataactttctaatggaaatgaatcatacaagagctcattttatgatttttataagctggtcacgtcatgagttagatttgtgcaagaagttagttcgaacttcttgatgatccaagcattgcgttagggtgaatgcagagccaggtcagcttctgcatgagccagcatactttagatgtgtaacaagactttaacaaactggaagaagaatattgctttaaaatgatgtgtccagattggaaaaagaagaaatggaaacatatgttccattgaattttcattaatttattgtaagtagaattggcactactagagaaagtcttcatatactacagtagtttaaaaaagagaaatacagaaacagggattatataatttccactttattccttactctatattccttactatattacttacactttattcctttctctataagctggccacgtcatgagttagatttgtgcaagaagttagttcaaatttcttgatgatccaagcattgcattagggtgaatgcagagccaggtcagcttctgcatgagccagcatactttagatgtgtaacaagactttaacaaactggaagaagaatattgctttaaaatgatgtgtgtagattggaaaaagaagaaaaggaaacatacgttccattgaattttcattaatttattgtaagtagaactggcactactagagaaagtcttcatatgctacagtagtttaaaaaagagaaatacagaaacagggattatataatttccacttcattccttactctgacttttttgtgggttggagggtatggaacttggcttctcttatgggaggtgcttaagagtgtgaactttctagtaacattacatggcttcaaatactggtgccagcctttggtctcgaacatgttacttaacctctccgtgttccaattttttaacatataaagtggaaatagaaaatggtacctacttcattagcttctttgggggactgaattagctagtaatacgcctggcatctaacaaaaatgataaatgtaagctatgttattttttagttaggattcggggtataaatgtaaatttgagtaattatctggtgattacttttagccattgcattccatttctctttagccttccattacacttgtacaaaagcagtgggtgcctagtacaatgtttggcatacatgaagcgtcttaatggttggttttagatgaatggaagcagaaagcttagaattatcatggggacatgatatttagccttgaaattcttattgagctgaagtattcttacctatctttgtgggttttttgatagattttccatatctttctagtaagttaatatcttctcaagttttttatttttatttttatttttttttgagacggagtttcgctcctgttgcccaggctggagtgcaatggggcgatcttggctcaccgcaacctccacctcccaggttcaagcgattctcctgcctcagcctccctagtagctgggattacaggcatgtgccgccacgcctggcttattttgtatttttagtagagacagggtttctccatgttggtcacactggtctcgaactcccgacctcaggtgatccacccgccttggcctcccaaagtgctgagattacaggtgggagccaccatgcccagcctatcttctcaagtttttaaaccttaagcttctaaagtatactttaaattttcaagaaatttaattagaaagtagtggaaaatttcttactctaatcttttctagccaagtttttcctttgcatttaagttcaagacctgtcatgctttgtgtctaacaaacatgaaaagaaagtggttaaagagacttacctttagttgagatagttttactatttttacattaaaagaagaccattaaaaagtttatatatttgatatctgtcagaaattgaaactaaatatcttttcatgtataggtgaaaatgtttcattgatgtagtttacatttacatcagaagcaccccattgaactgaaatctcatctaacataccaaaacatttgattcagattatttacaaacatagaataatactgatgatttaggtgttctccaagctatacttatgcatgctaaatttcagctaattttgacttattttaataaacatattttaatatgcattttaaaatagttattaaactcttaaattttaaaagtacatatgtccttttacccataatactttggagaatttttttttaatttttaatttttgtgggtacatagtagatgtgtgtgtatatatatagaagtacatgagattatttgatacaggcatgcagtgtgtaataatcccatcagggtaaatggggtatccatcacctcaaacatttagcctttgtgttacaaacaatctaattatactcttttagttatttttaaatatacaactaaattattatttactatagtcaccctgttgtgctatcaaatattagttcttactcattctttctattgtttttacccattaactatccccacttcctctccacccctcgaataccctttccagtgtctggtaaccacccttcttttctccatgtccatgagttcaattattttaatttttagctcccacaaataagtgagaacatgcaaaatttgtctttctgtgcctggcttatttcccttaacataatgatctccagttccatccttgttgttgcaaataacagattctcattctttattctgacggaatactactccattgtgtagctgtaccatgttttctttatccattcatctgttgatggatgcttaggttgcttccaaatcttggctattgtgaatagtgctgcaacaaatacaaaagtgcagatatctctttgaaatactgattttctttctttggggtatacctaggggtgtgattgctatcttttgggtataatgtaggagtggggttgctggatcatatggtagctctgtttttgtttttttttgtgaaatctctaaactgttttccctagtggttgtacaatttacattcccaccaacagtatataaggatcccctttttaaagaacttattttatagaagccccagtatgtggatacacacacacatacacagacacacacacacaaacacacaaatttttactagaacattatctctaacagcaaaactggaaacaatgtaagtgcccatcagtaatgggagtagttttactcaaactttggaatctcatagggcgttacatattatttcattagttagagtcatggtatattgataaaagagaaatttatgttgcgtggcaaatttatttttgtcataacctcagaagccttaactatttgcatatatttataagaacatggaggccaggcgtggtggctcacgcctgtaatcccagcactttgggaggctgaggcgggcgaatcacgaggtcgggaaatcaggatcatcctggctaacacggtgaaaccccgtctctactaaaaatacaaaaaattagccgggcgtggtggcaggcacctgtagtcccagctacttgggaggctgaggcaggagaatgacgtgaacccaggaggcggagcttgcagtgagccgagatcgtgccacttgcactccagcctgggcaacagagcaagactccgtctcaaaaaaaaaaaaaaaaaaaaaagaccatggagaaaagtatggaagggaatggtagataagaggagttgagtttgtttaatatacttgattctttaacatgttcaaatgagtatgtattattttatattttatataaatataatttattatacttacatgttttatgttttttcattaacaaagtaaacactctgctatattgatcattcttcaaatggaaacagaagaacaggggccatccttatgaccatctgcactaagagagttagcctctgaaggaatgtgagatttaggctagccatcatcagtgaccagtctgtttaaaacatacctgttcaatcaggtcccagcgggaaacagatgatgcagtcaaattacgataattcaagagctggagccaggtgtagtgtaggagaaactcaaggagtttttcatggaccaggggccaccaacagcacagctgttgccacttgaggcacaaagagacaaggagagggggaggatgtcagaacccagaaaaagtcatgttgtaaagaaccttgattagaatggtgaccttctttcaagggacatagtccattcacggtaagcttacaggaagtgaaccagggaagaaaatgttgaatgcattctaatctctcctgtcatctgccagggctccccactgactgaacccaactagagacagatgttaagagagagccttttgatgtcaagtacctagatcagcagccttgggcagagaacaagggcaagtatagagaatgggttttgaggagtaaacaggagctatctggcataaaatagccaactttttattttattttttttttttgagacagagtttcattcttgtcgcccaggctggagtgcagtggcgtgatctcggcccaccgcaacctccacctcctgggttcaaacaatctcatgcctcagcctcctgagtagctgggattacaggcgtgtgccaccacacaaggctaatttttgtatttttagtagagacggggtttcaccatgttagccagggtggtctcaaactcctggcctcaggtgatctgcccaccttggcctcccaaagtgctgggattataggtatgagacaccatgcccagccccaatattctttttgaattaaataatcaaaataacccagaagaggaaaacatagataatatgcaaaatattgatatccatttactttatgggcttacataattattttttaattgacctaagcccaaacacaaaattaaaaaagaaaatctgaagatggcattgttcctcaccctcttctgtacataagtcctaagttcttccttaaactcccatgagggcatagcagtgaacatctcagagtggggacagaaaactattcctaaagatgaacatggccccagacccacaaaacgccagactttggacttggtctgaaatagtggaggttttctgttaagtcctagcttgtttccaaggaatgacactgtaaatcaggtcatggaatgggaagctgacatttactgacccttggcatgtgccaggctccatgacatacattcatgtaagttatcacttttactcctctcagcaaacctgtactgtgaccaatatggtcacatgaatgtatgccatggagcctggcacatgtcaggtttgctgagaggagtaaaagtgattactctttaagaaacagaaactccaagagtttaatttggagtttaaggaactttctcaaggtcaatgatagagtctggaattggagctaggtctgcttggctacatcgtggcacagcctcacttggctgcaagatggtaaaggagtcattatctattatcagaggtctctcacctgtcccagaaatatggctttccccttcccctctctctcattcccttatcttccattcattcccttagttatatatttaacaagtatttattcagtacctactgtgtcaggaatcatgcattgtaccattgatatcaatgaatatggcctctgccttcatggattttacagcttaataagaattctcaggggattcatcgtatggatttccactagccccaagtccttttcatttgaggtcatttgcatctcagtcttcctatatctttattaagactgagaattattttttggcctatttgtttaaataaaagtgtaatataaaaattgtaataaacctttttaaaaatctcacttgctagttcattattttagagaattgaggatactataatattataagaaatatgaaatactggaactaggtaagataatatttttaaaggtgctttctggttttattgaaacaaatcagccagctcccccaaaaatgtggatatatgggtacatgttgaggcttatgttttaatcaggctaaaagcgtatcacattctctcaaataagcatatctttcatttcttaaattgaaaatttatttgtatttattcaaaacctttcttgtcaaagacaagttaaaactgctgttcaagtgtcttgtataattataaccataaaactaataaacatttcaactaattttttccctattcagatatgcttgttcactcttgggaaagccccagattgggttactgaagtaatctcatttttgtaactgagccagtattatcattatcaaaattacaattgatctacagtatagtgtcataaagggtgactggtatgtagcacattctgatttctctcattttgcattagatgcattgcataatagaactgtaggaattgcctgctaatgctttagttcaccctttaacaattaagttaggcaatcttgggtaaagcaacattcagtaggctccatgcatgttgttttctataaccacctttggatgcaattttggggagtgggagggctgcaatacacacacagagacacatacatatatttataatttgttaagaggaagttactattaaacatctaagttgacatattgtatggtgggttcttctgggtctgatcctagacaagtgagttaacaacatctttgatcctctttagctttctacttttgtaaaataaaggggttggaccaaataagtggggtttttgtttgtttgtttatttgtttagcttttagagttttttttgcccatgctacgatattcctagaagtcactgagtacctagtaaggcaaaccaggaccagctgtagctcctcccttgtactttaacaacagtaattctgttttgttttatatgtgaatcatcccaagtaagacttccaatctctgatgccttttcacctatttattagtagtaggggtcattgtattctatttttggcttcatagtgaatgacagcttgtacaaacaacacagatactggaataatcagtcttttcttcaaattctgtagtagcatgaactgtaaagtattaatcatgtgtttatgcctggtttctacatgtgaatccgttaagcctattcttaattttctcgcttcgtcagcttcaaagcaggaaattacaccattgcccaaaatctccaccattctgttgattttgtttgggaggtgtaaatctagtaaagcatagacagaggcctgttgccagattgatagctgtatttgtctgcgtagattgtattttcacagctgtcaggtgagatggttgcttcctatataaagtggttctagaatcatgcatgtgcttgggattttaatttatcagattttttagcacttcctacttaaagagcttcaaactctagggaatataatgtatgccattctgaaaggtggtatttcagcttttgtatctttggggataacatgttgtgaatgaaattggtgttttaaatagagctcctggggaagtttttgccaacagtccttttgatatcccatgtgctctattgtaataagaaagcagaataaataaactaaactaggtggtcaggattctgttaggatgaaaacaagtataatttcctttataatgatgaaaagcaaacaaaactctgtacgaatagttttaatcaatgtttaaagactggtttcccagactcttgtgtgtttgacagatagtcttgggtggggtagaaatggagtggaaaaacaaacaattactgtggagataataaaaattactgggcaaaaagaaaaaaaatatttgaaatacttcttttttttttttttttaaaagacagagtcttgctctgttgtccaggctggagtgcagtggcacaatctcggctcactgccacctctgcctcccaggttcaagtgactctcctgcctcagcctcccggctcatggttgacataagttacctctcccagcatttttcatttgtattttgagaaaaacataaattaatgtgttattgaaaactgccgtgatcatttttcatttaggctaattattccaggaaagggattcctatattgtattcactttttttggttttaatactttaatagtgagtatttatagctatagaaatttgatacttttaattaaaaaatttgaaactaggttcaaatgaaagaaaaaattcttataaactttaaaaatgtaaccacttgtttagggtattggaaatcaattctccatatttgacactatcaaattagcttcagataacccttttcttcattttgtgttcatgttgttttcactttgtaaacagtaaaactccatctccttgcgtgaagttattttagggggaagaaaaagtgcaatacacagattcattatcttgtaatgactcattttagttttgcattgaatcaatctttgagacaattactgtaacttgattttttccttccctccactggtaataaaagagacattttatttcagggaaatgtgaagtaaaatagtcttgcttcataagcatgctcagagaagagatttttaaatcttgttttaaaaatagtggcatcatgttcatgaacttcaagttttctttgttccttttcttcttttcctttttctgtgaaactcaaggattaataggaagcatgtccaaaattccctctaggaagaaatttagatagggacataaatatattttaggcattcttactaagcatttccaaataagctttaagagtttcttaagtaatctttgattttataggaagaaaaagggtcaaagtttgctttcttcacaaacttcagtaaacaaatccctcttgtattaatgaagaaattgactaaacctaccaattatctcactattataaaacatgtcttgaaaatttattagatgcaggccaaaccattgaactcagaccttgcctttaagaagcttccatctaattaggatatatctcaatctattggagataatgaagtagaaactaaattattattaattttagacacacaaaagtcatttcacttctgtaaaatggaagaagtaacgtgaagctacctgactaatgaatgttggataaccagttattggagtgctttgtggaggtaaagtaataactacaaataacaataaagtttcacctttacttgcgtatttttatgtcacttttgctgaagaaaagtgccttgacatttttactagtaaagttaacttttttgttattttttagagaatagaaatggataaaatagacaaatttgatggattctttggaaaaatcattattggatttatagttatcggaacgtttttgaatatgatcaaacagtttaaattaagattctattacatggatagtaatacacatggaattaccttaaaagtgattgtgtactatgtagaatatcacaattttgtaaaatagttctatagcgaagttaaaatattactggatatgcttatgtaaaatacatgaacacacagttgacataaactaacttgatgattggccagaactggaattccaattcttacacctacccatccacccacatctattggacaagtgcctggttaaacagatgggccttgggctgtgctctcaaaacaggcaacctccacctttattgagcaaaacattggatgaaaatagactatattgtcttattgtgctactgaacatggtaatttaagtgaagagctcctatttattattgttgttggttgttaaaaatacctttttccttatgaatgaatatgtgaaaattggaggacaacagatggagtcccagggaactggaaaacctatagatagggaggtaattctcagtcaaatatgaaaataaaaaatcagcaggagtgtgaaatttcatgtggttttataaatgcatgtagctaagattttagaaaatgtttggtttagcctacagacatgggttcatcatgaaatttctcttttccactaaagggtatgagaccaagtagaattctcgaagtctgtcctcatgccccttcaataagttaccacttcaaaagctacaaagctggattcagggcaggaccttaagttctggctaccgtctgtgtaaatatcacacacttacatgtggtaaagtcagagggacttgcagacctgagtgatacttatgacatcagaagtgagttttgtttatggttgattaatgacattgctacttgggccatgtttgtgacaacagcactgagggcaattagcaagagcaacagttagacagtcccatacttggaagattatatgagactaaatttgacactcttaatattgacatctcgtaaatagcatttggtctctatgtattttcatgatattctctttaatgtaacaacaatcagtaaactgtcacatatctaacctcatggaactcacatatctaacctcattgaatcattaacaatgatatttgcacctcttaaattatgaaatgggtggtctgtgggcagcatgctaaaattcaagtaaaagacttcctactcctttttcctaaattatttttttagtcttttggtaactcagttttcacaaagaaggggagtttggttgctacctactttccctgtaatactgcttggctatttttcagtggcaagaaataattcctgtgatacttaagaactctatggaataaagctcagtatagtgtatattgaattatgctttctggttattatatttggataaatttaggcataaggttgtttaatacttcagcagaaacctgcaatggaacttcctaaaaatttgaccttgtgaaagaaatccaaatggaattgttttatatttttttagctcctataaatgtgtgtgcggggttaataaataaataggtaagaaatagcacagcattgtttaacgtttatttctttcctcaaaataaaaagttaatagaaaaagtaatacattgttattatttaagagttatttcttactgcaaaatgttttgtgatagctttgtttcattgtgtttaacttaatttaaattactataatacttttttgttacatcgtcctttgaaatcattgaaattgactaaataatattgttctattctacttgataaaatggagagctcagaagattaatttagatacagaattgagaataaaacagtctcaatttgtgcttaattttattagaaggaaatatattataaaaatagccatttgaagagaaaaaagataaaagtagtgaaatattttaattttcaaactctcataaaatagtaatacaggctgtctttaaatgaaagtaaatattttgtgtttatgtatgtatatgagacatatgatcattattagctttatcttgaattactctgatatactatatttcttatacatattatttaatgtcttttgttgtgttttgttttaaacagcaaatgccagtcttcttggaggaggaggtggtaagtcctgaacatcacttaacttaaaatacattttaattgttataccaactacaagatatttagtaagttctgtgacacttaaaagaaaattaattttgctgtagtcatcaattacaaaaatgttaatctttcaaaaataatttataatataaataccttggtttgcttaaatgttattttaattgacttcgagatatatacagtactcttgtcaaactttgtatttctgcttttggcataaggtgtaacagctataagctatatgaacacacatgtaatacatgtgtgtgcatagttacagagtaactatgtacatattacagagttacttttaatatgaattctaaaacaacagaacatttggaggctatggtttctttttccactataatgactttcttttgcttttcatgactttgtagcctgagagcttaatatatcagccacttactttgaaaaataaaaaagaaattactgttgacactctgctttttctttctgctcagttagaggagaaagagaaggagatcaaagtgagctgagggagacagagattcctgtactgggaatttttttgatactaaaatcttgtaactatttgtatttttacttctaggttaggaagatgaaagctttcatagtcccagtatatataatatagtaggagagaaaaaagtatacgattagaacagagtccttttcatataaggcccagatggacataactaggtttgtttcctctttccctgtcactctctttctcccttcctttcttgctctttcttttttcttacacacagttgaaacagataggattgtgcagagccttaggctttcatcaggaggtttcattgtaatttttatttggaaattaagcatttaacctttgtttctctgtaagaacagttgatttttaaaaaacagaatcttgaaaataagaaaaatagaaaagtgtttgaactaggaagtgctcttcgtattatcacatgtcagtgcatgttctgtaccagagtatcatgaaatgagtgtgggatttgaaattggacttactgtgtggagaccaggaaagcattactaaatatctccaagcctcagttacctcatctttaaagtatgaggataatattaactatctaaagtgtttattgggagaattaaacaaaaatatttgccaagtaactaagtaatagaacagtgggggattcataaatgtctatttcttttcttctttcctaagttattttagaaaatatgaatttgtaggatgtttcattgcacttgttattttatttggggggaactagaagggaaaattttccttagaagttgaatttccagtaattttttctctctgtctcttgtaataggtgaagaaaacatgattaagttaaattgtccatagtgctgattttcttacaagatatattagtattttaagaaacctcacgaatattgttaatagcatagaggaaagttaaaattgagtctatgtaaacacattcatcaacttaaaacaacaaattaggtagacgattcagttattgcttttgagtatttcaaaaaattgacttgactaattatattagttaaaatcactttagccactataacagaaaaagtaaaaaacattaaaatccacaataacagtagtttaaaggagatataaatgtatttctgtctcatgtaaaggtagtctagatacaggctggaatggttgtgtgatgaatcagagactcagctcttacttttctgttctttcctagtgcatggctttcatacttagatgacctcagggtacaggatggctgctggagctctagccatcacaaatatggcacaggtcaggagaaataggaaaggcaaaacatgaaaaaaagtgggctcccaaacatgagtcagttttctttaagcagatttccctggaatcccacattgtctttgaatctggacagtattcattcctagcatgtagtcttttattccaagaagcaatgcactcatcagaaaaaattaccgttctgttcactaaggaggaaggggagaatggaggttgaggaaaacagtgtaatgtacctgccatggtggttacctctatattgtcaaactgatttctttaaatatatgtatgtattgttggtgtgtatagaactgactccagtgatttggcttgtattttcttatgattcctctcttctctgtgagaagatttatgaatttctagcaatgataagacattcaggaataggccaactcagttttctatttagctaaagtctttattttagtgacttcctctagatggttgattttgctcaatttgtcacgatttataatttttgaataataaaattagcaactcagcatcatcataaagataaattacaagtatttaagatggttgtaatttctttcattaaagtaggtcatcgacaggtttaaatttatttatgcacttctggagatgtcaagattgctctaaaacacgtgtctgatttttggaaagctgcatttaaaaattaaatttaaggaatatttttagccttctctgagctgatttttgaccttatgattctatgacaaatctttttaatcctctcagtgatatttgtaaagtaacagctagtaatcatctaataagaagcgattgaattgatgtaattctcttggatttaatcaaacaattccttttttcaacatgaattaaaatcccttcaaaggtccatcaagagaataattttttaattgactaaacaatttgatcaagaaaatttgacaccacatacaaaaataataatgggacctaagtccccttctttagatcctcaggagggcttcccccatattctatatgagtagtacctgatagtgaaatgtagacaaaattattgtatgcaaaattgtattagccataaaatcttagcattttgttgttcttttctgagtgcttaccaccaataagactgatcccctgaaagacttaaaaaatggtcacatatcatcctctcagtgctgattttaaagtgagagatttactttacattgatgtgaattttcatctttgagctagatatcaatctttctatgaatgtattgccactgactgcagttcattgtagtgagcataggtgatgtgattacttctactcagtcatttcagttaaaatttgataacttttaccaattttaccaatttgcttggtaaaattgatcacttctgttcatagtttctagataggttgaaggcagagacagttatgtactaatttcttaatatatagctggtctatagtgactgaattgtacttttcaggaggcatttatattaatgttaaaaatctttgaagttccgttaatttttttgacaaactttccattattattaccaacagtaccctgtatattattttacctgttgttattttaatggttgagagaaacttcttcaaagttgcatagcttatagggcaaagttggaatgagaagacagcgttcttgactgccactccagggctccttgccctggcactgtggtttttaacatgcctctgctctccaggtttgcttttctatgcagagatgggtaattctgtttacaccaggaaaaataagtgagaggacaggaaaacatacagttaagatacggatgttgcattccttggcttattttcacaagtctcaagatctactgatagcttgaaagtcgatacaatggcactgtcttacagtactcttggattgctgcccagattcatatacttttttgtgcatttgagattcagtcttagaaaacactgcatttcagatacatgttcacccatctgtaataagaatgttgtacatgcacaaggtcctgtgatgctggtacttttggaatatatagtaaaatataaatcattgtagccagtcttaaattacataaagaagtagaattagaaagaaaaatcagaactgaagagctaattcctcacttccttttggatcattatataataggaacaaaatttacggtctcttactttagataatatcttttgtttttcattgacgtaatagttaacacaaaactagaacctgctgatagaacccaagcaggatgttgtttatgggatgtgcttcctcctccagtctgtcaaagcacttgagggataatgctagacatttaaaatgacggttcctgacagagtggtaacttactgtcttttgtacacatagctttatgactgccattttaatcatatatacatacacagagataaaaaataaatatatatatttgcatcaatgctgtaatttgataccttattcctgagttgattctgtggcaggttaatagataagtactgttgtctaataagcaagtgctgttatctatgcagtcagccccagctgcaatgcatgcaaagccatttgtccaacgcgagaacagagaggacactgtgagccttcccacctctgatggcttcctgctctccttctgccccttagagtaggcccaaagatggacaaggttcagtgccttgtgttagtacctgctcctctaatctccctcatttctgatttggacagttctacttgcagagaggattcattatgcttgtctgttattaatgtcccttcatacaatgaggctgtttgtgtgacatactaaaattcatgcttgaaaaggaataaaattataacctgggtgataggtgataggtgcaccaaaatctcagcctttgccattacacaattcatccatgtaaccataaaacacttgtacaccaaaagctattgaaataaaaaaaaagaaaaaaagaagagtgaaatcataaaccatgtgctgttatatcatagatagtatttgtgcatctccacacacccatcatctgtttctaaacacaagcacacatatgtgcatacattcattcagcaaatattaattgagttactattgtttgtcagtattgattattgattgggcagtaaacacagccttttccctgtggccaatcatgatccctgttcagctgaattactagagcaattatagttgtctacattctttcagatgttccaaggattctgctggcatagtcttttgagttaaaatgatgctttaacattaatagaatgggcattggatgtcttctttaaaaggcagagcagatatcctgaaaacaactaatttcacaaaaaatctgagttgctacctggaattcctaatgtgaagagcaatgtgtttaaagggctttttgagtgtgtttaagagggaatgatttcataaattttgtcttaagcattcacaagcagagtggagcgccctctcacctccctccacatacacaacggctttcccagcatatatcactccagcgctcaacatcctgcagtgattctgtttcgctcttgttaaacctccagatgtggctgggcttcaggcatgctgggaggaatctaggatagcagtcagcagggagggactgaggcagtttacagagggtagagtgttgggggttacccctcaggagagtcagtcaagcatggctagtagtgactttgccagctggcctgtgctcagcaggggaggggccccagccatgggcctggggaacagcaacagcctttcagtcctgagagagcagcatggcaggagaaactcaggggctctggcctttttactcaggcagggagcagagatgcaggaaaggatgtgatgctaggccacagaaaatagggtttaaatcttaactgcctcggccaggcacggtggctcatgcctgtaatttcagtacttcgggaggccagggtaggaggattatttgagaccaggagtttgagaccagcttgggcaacatactgacacctcatctctacaaaaaataatcaaaaattagccaggtgaggttgtgcatgcctgtggtcccagctacttggaagactgaggtgggaggatcgcttgagctctggacgttgaggctgcagtgagccgtgatcacaccactgcactccagcctggccatcagagtgagaccctgtctcttaaaaaaaaaatcctgactgccttaggtgggattgatcctgggcactgtgggcggataagcctgctaaaggaggccaggaggcccagatatgaggaagaagagggaaggtggttagggaccaggagccaggccaggtctgacaatgctgagttacacactgagccaacctacctttgccctccctccttccctcctccccgtcttctgtcctccctccctcctgcctcccttccttctttgctttcttccttcctttccctgtttccctccttccttccttcttttctttttgtctttctcagtcaacagcaactattgattacttcttgtatactagccttgaaatcagtgtaggtaagattcttagaactaagtgcagccagaggcataagtacttatttacacattaatattttaagaactaaataggttcttcaagcagggaaaatgaaacagaacaaaggaagtcaacagcttatagtggtcagggaaggcttcccagaagaggtgacatgggagcagtcttgaatgatgagtagtagttttcaggaagcagaaggtcatgatctattcagatgtatttcctactctttgctgtagagatcttgctctgccatctcctcactgttctgccatcatatcatccaggtcttggttaagctgttttctttgacagtcccagcatgccacttaaaatggagtgaaaagtgttagggcagaactgaagagaggaactctggtgctggtgatgtgggtagcaaacctccatcagagcaacctgggcaaagtctggtggtcatcgccagtgcgagctcctccccgctttactttctcttgtgattacctcacctgcttctcagtctagggaccatctctacagctgctcactccagttggatttctagtatgtgttttcttcattccacatgaacttgtctagttctttctcttaaaagtttaacttagccctgattgctctaatcttgcctgctttttgtcattaagccttccagatgctcttcgtggtagaggaaggtgaggtggggagggttcaaaatccaagccatgcatctgccttgaactcttctattgtaatggcaattccaaggacataatttgtttattacacttctaactttggttactgtgatcccttcattctaaaactaaacttcaaagttattcatcatgtttactacacatgctcccacttctaagtgaacctccctgttgaaagggcaaccctatgcagattaaatgctccttctcattgtagccatacctgaacctggaagtgtgtattccccaattaaggcagaaatttcctgagagtgagtaatttcatattcatctttatagccctggcttattctatcacatatagtaggtgctttgagatattactgtctctcatcccggattctcaacatgtttatatagttcggttttgaccagtttactttggaaagttaatctctttatcttcaagtgatttctaaatgaaaaaaaaaaacaaaaacccaaacttcagaaatgcttttaacaggcaacctgaggattatattcatatttatacagtaattatttttatcatagtattatcttttatttttaaaaagtttgtatagccaggatctcataattttctttaaatatatttactttaaatgggcaataaagagaacaatatgtaattgaatagatggggaatgaaatacagagaatttacattctacagatcacatggaaagagggaaagcctattgtttcattcatgttttaccatattgagggtatttaaccagttatatcattctcctttttcatagtttgattttaatttattaataatttgtcttttacatactacaggtaacttgtcattgacatcatattactaatatgtatactagtgttatcctacaatacgtttctatttttttttttagcttcaataatatagaaaaattgtatgtgttggtgttcttaactggatactcttttaaggtcacttgtttccattttacttttgatttttagagtttgcgtttttaaaatgagttttataattggtatgtattatttatatttgtatgtttcataattaactctttttaaaaaaatagaggtttagtcattctttcagaaaatgttgagattagcaaatcatgctcaaagataggaattaaaggttgtaaagaaaaagaaataaaaataatggaagccctcttttcagatgtggaaatacgttggtaaaaattctaggctcttataagttctctcactgtgttgggctagctaaatgatacctaaatggttggaagttcagataatatctataaacaaatattttaaagttaggaagtactctaacaggtgccaggatatgtctacatatcttcctaattacatagtagctatagtataatgcttgtgtagcttatctacttgcgttaaaggtaaaatctttttaaaactataaaaaagagaagtttattgagttcccgatttaaatatctctcatccccaaagaatctctgaatgtgacttgttggtacacagtaggaaacaagtttcaagcaaaatactgcaggtcaagcctgttatgttttgggatgactacattatattccttcagtttatggcacagaattgtttttttaactgtatctgatgtagctccacagtaatacaaggtggggcaatttcttagggagccacttttataatcttttttgtttttggcactgttaagaatcctcttcttcatttacccctcaaactgaagatactgtagggatgaatgaatctggccagttcttgatggcaacaaattcaagatctccagggtcctgtcacaggcactgtgggtccctcgggttacatgatcccttattgctgcagctctctttggtcaaaagtcattatttttttaatgagttaggacaaatttattgttttgtatactagtttcctgttctaaaatgatggttataatggtacctaactactttacaggtgtggaataactaattgcccactgtaaaatgttgttgaactacaaagtgttagataaatgagtatcactctacttgtcattattattaatattatagtgcaaatctgaaagatgaaagttgctggataattgcaagatatggtgatggtgtatccaaataaaggggaataacctgaattgttggataacacaaatccagatatctgtgtgtagtagaagagtttgttttacaaaaagattatatagatagctgtgctttaattaacccctcaaaaatctgaggatttttcctacaaatatggatagaggaatattctaacagtagttcatttcatcggtatgtatagtggtcatcataaggaagcgtctttcaagtatttaattgcccagagtaaaaaataattatatactagagtatgaggaattccagcttcatgcaacattaccagtctaggagaaggtgagcttaatgtagtcttcaggacaggacacgtgatgaggccatctcttaaggtatgtgaaaagaagccagaagcagtagcatttttctattcaggcacatgcttggcactggggaggaacaagggatcccacagaatagagttaatggcccacccatgtgtatgtccagcaggcagtcaggcctggaaaaagaagtagggaaagaaaaacctagcagaagcttagagtacacaagggaagggtggtgctgcaatctggaaggtgacagggaagaccaggtatcctcatggggacacctgaccctgagtttaaatggcagcaggagagacctggcaatagtctggagccctctgaggtcagtatatagaccccaggtctgaaagggtgacccaagtcagattagctaagagaaggttgaggctgctagagaatctgagtctccaaaactggctttgagagtggggctgaatggagcttatgcatggggagaatcagtggattcagctatgaacaactgggagagagatgcaagaagactcagaagtgtacaatattgggacgttctccaggagaagatgaacaagaagtgatgtctgaggagttgtagctaaaatactctctcagcttctgccacatggttatttctgaccaacaaaaagctctcagaaatagccatgaggggcacaaagccctcactaggctaaaaatccactaactctgcaacttcctagatgctgaacacaccaaaggcctcacacttacaaatgtggtatgatgtccatgcctgcagggtcagctttgcagaacagaccaaaaagacttttacaaagctccaggtttcatttctagcatgattggaaaaagcataattttctagtcagattttgttaaacaaggaataattctacatctccattagtacaaaagccttgctctgtcattagattatctctacttaagaatcttctagcaggcctctctgcatgccctggatggttgggcactatccctactgtgtctccatcaaagtcagtgcattttcttaggtaactatctctctttcctctaagattatagatttcacaatgacatggactgtttctattgtgttcacttgctgaaacctcagaatcttgtagaaaatttgacatataataggcacctaccaactagctgttggacagatggctaaagaaataatggtaataactaacgtttatggggtgctgatctgtgccaggcactgtgtaagaattgcacatacattatctatgttaattatctcaatattctgagtagatagatattattattcttctcattttacagatggaagatcaaaagctcagtgaggttaggatgaataaaatattgggcagacccagtatttaagcaaagactctctccaactccaaatcccccttttaatcattgtactgtaagttcacgagttcaaattaacttagtattacttatgggaataaggagtatattcatggatttatatgtctctaaaccttcttattctgattttttctgggcaacagattttcttctttgaatttccaactcatccttatgtctaattctcatcctctggaaatagctttacccctcagagttatttcctgggaatagaagaatcagtggtgctaagctaggaatttctaggcttgtctctccttctttctcagtttgaatatgatacagtatccgttatttaaccttaattctgataaaatagtattttcaataatcagaaattctgaggatcttgttgtatttataaataacagaaataaactataaagaagtcctctttgacttttctcaattccatttttctttcacacagacaatcattattcggtgtacaactttttatttgtcatagttttatatacatatgtatctgcaaataacaggcaatattgtttaaaaatgttgcataaatatattatgggcattctaaaatttgtttttattttattattttgctaagcattgtttaaaaatgtattcatgtagatatagaaaccactaattacaaaatgattactctaaggatactttcagtttaattgagaatggctttatgcctataaaattcagttctgtttttgaaaagtagcttttaggaacatatgtaccagttatacaagaatatatcttcatagtcctggtacagctagtctttctaatgaagatgataaaagttggaaaatttgaagtatgtacagtatatagctttggaaggcagcagcagtactaaatttcaactcccacaagtttagatgtgccagggtagtatatctggataatatttagattggtgctcttaaatctgtctagtgtttctttgcatatatcaaggaatacctgtttttggcctaaaaattttatgccaatctttatacccaaacgccaatggttaattcatcctttaaaaaataatacaagataactttgataaaacacctagaaagttcttatgtttgtctcttttcccttgaacagggagaagaactctattacaagtattatcttaaatatactctgaattagtggttctaaaatttgaatatgcatcagaattgcttggagggcttgttaaaacacagattactgggccttatgcccagaatttctgttttagtaagtctgaggtgaagtccatgaatttgcatttctaacaagttccgttttaatgctgaccctgccaatctggggaccacactttaagaattactgctctaaataaaagtgaataaagagaggattttaggttatggcagagtgaggagattggtaaatcctctctccaaaaaaagcagctataaggctggacacaaaatctccaacaaaataaaatcataaccattttagtactcttaacatctaaatagaatataacaatttgagaaggatttacgcttcaaaaactgctgaacttcatagttggaatctatggcaaccttgctcccaccctctccatttggttgtgtggaaaatctgcaagggttgggagtgttggggggtgggcaggttgtgcctctgtagtcaaacaagactcatagactttgagtggtgagtgattaatacgccctgaagagttgtcagtgaaagtgatgatcttggccagatgagggccaaaagcctgaagttatggttgtggttgggaccaatatatttctggctaccactgagcacatgcacagtggagaccaaagagaccctaagctttttatgtactcttgtccaaacctgaggctgtacacatttgcataggagccacaaaaggccaagaagaatataaaagccagagaagacttgtaaatggccttaaccgtggaatgcacttccctacccatataaagatctgtgaacagagaatggaagtctatctggctctagatatttgtgcaaaaggactatccagtcattggctgaaaacttacaatgaatcaggagtaacccttgggaagccagaattaaaaataaaaagcaagaataaaaaaaaatccaggcaaagatgtcagagactgctgatcatgaaggagacgtattttacagatttaagcctgggtaagttaccaaacaactccaaaaccttccagcaccgataactttcagataaaaaataatcatgttctggccaggcctggtgggtcacgcctgtaatcccagcattttgggaggctgaggtggacagacaacgaggtcaggaaagcaaaactgttttggctaacacagtgaaaccctgcctccactaaaaaatacaaaaaattagccggacgtggtggcacgtgcctgcagtcccagctactcgtgaggctgaggcaggagaatcacttgaacccaggaggcggaggttgcagtgagctgagatcacgccacggcactccagcctgggtgacagagcgagactctgtctcaaaaaagaaattaataataataatcgtgttccagagttgcgatactatatcattcaaaacacttttaaaaaatgggacattcaaataaacaggaatctgtgactagtattcagagagaaaaaaacagtcaaaaagtagaatggtgattactgtagaccagtgggggtgaagaaggaatagggagttattatttaatgggtacagggtttcagtttgggaagatggaaaaagttctggagatgcagggtagtgatggttacagttgagttttggccattatttcttcaaatatttattctctttcctctctttctggggctcctgttacatatatgttgtaaaaaaatatgcaaataaacaggtacttgtgactaaaactcagaaagtaaaaacagctgaaaagtagaatggtgatcaccagagaccagtggggcgaagaaggaataaggagttattgtgtaacgaatacaaggtttctgtttgggaagaagaagaatttctggagatgcagaattgtgtgaatgtctttaatgttactgacctgtactattaaaaatggcccaaatggccaagttaatgttatttatatatatatacatatttaccacaataaaaaatgtagacaatagaaactatgactgagtgtctccagatgttggatttagcaaaaatttcagagaattatattatattgccattttaaatatagttaagaaactaaaggatacatatatttaaagaattaaaggaaagtgccacaacaatgaatcaatagattctccactccccactatgttgatggccataaggatggtggcccatgtccgtgatacagtttgctgatgctgcagggaacaacatggaccttgtttttctatgattgagtgcgctggcctgtttgttgtctccctgagaaatcagctcaggggcttgcctttgttttacttaactcagaaatttctgagggctggagtggcctcctgaaagtatttaaaggcaaatatactagctacagcctcctgagataagggatgtgaaatcatgcaaacattagacatacagaaaagcctgggaaagaagaggcatggagggagagaagtgatttgaaaggctttcacatgtgccaggaaatctacaaagccacagataagcccagggctggattcatcttcagaaaagactcaagaaacaagagtttcacctctggttcaccgttaggatcagtgaaaacaggaagtgaaggctaaggaagagttataaatagcctgaataagtattgaagaaatgcctcaacatacagtcagtctgcaaagatgggagattttcttttctctttttttctcttttcctcttctcttctcttctcttttcctttctgctccttttcttttctttcggctctaggcatttaaggaaatacctgtcaaattgttatttgaccactaagctaacagagcagagacctcagtgaccacacttaacaaagaacacagtcttcatgcaaacggtttagaaaaatcactgaacaatcaaaacccatgacagcggccaacaataaacccaagggagggagagagagcagaatctgattttcagagatttgacattagaatattaaaagttcacttttcatcagaaaattacaaggcaagcacctccatgttccaggcaccgttctaggtagtagcaatatacctatgaacaacgtggacaaaaatccttgctcttgtgaagttggcattttattaaataaatatatttattcactaaggccttaatttttcagcatcttattatggtaattttcaaacacatagaaaattaaaacaattacacagtgaattgttcatatgtttaccacccagattctacctttgacattttactatatttgtcctatcttgtatctatccatgtagccacctatttatccatctaccaatccatcctttttgcttatagcattatatttaagaccacacaatgaaaacaacctaaatgttcaatagtaggggatttgttaaataaatttatgtatttgcactcaatggaatcatatgcaaccattaaaacttataattttcagactgaggaaaatctgtatctagttttaggagaaagcaggatattaaactactgtgcatttttattttaacactatgtaacaaactatacaaatcaaaagaaccataagctattgtagaaaaaggaaggatactttatctgttaggctagagggttttttgtaaccatttttttctttccccttttttgattttcattaatgttgttactgcattatttattccatacatacatttacaattttttaattgggacagtaaaatcattaactgtaatgtgcatccaaactatttagcaggacatggagaaaattgtaatatatttgattaactaattgcatattggatattttctagtgcctagatatacaaagatgaataaaatgagctattccttgcccaatagaagttcacaatatgttagagactatatatttccataaaagaataagtatatgatgaacaataattgtgctgtgtatgttatgtagtgattaagagtggattttgaactgattctttagatttgcttccaagacccatttcataccagctgtttgatatttggcaagttatttaacctcactttgcctgagtttcttatctctaatgaagttaaaattacttcctactcctcacatttatgtgaggagtaaatgagttaatacaagttaaaagctcagaataatctctggcacattataaatagtaaacaaatgttagctatttagttattattttaaatattagcatattgttaagatttcatgttaatatattggtattaagattctataatacgttagatttttcttcagaacttctactgattatgtatttatacatattttagtgcatatatgctgatacagtgaagtaaaggtaacatatttatgtttggatgatcagatattaaagttgcaaattttacttcagcccaatatatttatattcccttttaaaagtctttattggcaaaacatagttaaaatattccaacccttagaaacataaggtggaactcatttctaacttaaaaattatttaagactattttagggtacagactgattctcttagaaagtgttctgctttctattatcttagcgttggtgtttaagttgtataaatttatggcagcgtttggaactagctcaaggtttacatttgatcaggatatgtggtcagattaaaagcagtttttccttagctctaagcctaatgtcaatagaaaactatattgaaaagaaaaatgtctcttgagttttcagaatatgttgtgtaattccatggtaaatacaaatataaatattgtgattaataaaatgagaaaaacatgagaatttagatgcttgcttcctaagttaccaaagtgaaaagaggacatttatttttgtttgtctttacctcactttcacaaggaatttcagatggaacagttgccagtttataattctcctcttgaatattttagtgtcattaaatgggaataatttggatcacatacaagattatgatggaaatgatagaatgatgtaatgactttggagcgagttttgtcttgtctcaggagaactcataattggattgtgtttatggaagaagatgaagaagaagagacccaaaaatggaataacccttttatcttcatctgactctctattcttgtcacagtttttatcttcaggagggcacaaatagcctctatctgatttccctatcccatgcatagggttttcttaaagttttttcacaaagaagaatttatttttaaaaattctgttctattcttcatgtgttatttttaaatgagtttcacagagatactctgaagctgaagaggttgtttttaataatctgatgttacatgataagtactggaaaaaggtggatgcagggagtgggtggtatgataaaatgctgtgggtgtaggtcctgaactgcaggttggtaaatgtttttttggtaagtcaggagataatttaagcttacttatgtgattgctctattccccataatcctttgcaatgcttggtgagacagaatgaaagaactccaggtcttagctgtttgttagtgaactgctttttcttagagctgatgcttttggttatcaaggaagtctggatagtgatgaagacaagtgttgacaggagggaggctgaagattagggttatttttttgagtaagaaaacatgtaacttaattgtacacttaaaaataactgaaagagtgtatttggatagtttgtaatgtaaaagggtaaatgcttgaggggatggacaccccattctccatgatgctgttatttcacattgcatgtctatatcaaaacatctcatgtaccccataaatatatacacctactaagtacccacaagcattaaacatttaaaaattaaaaaatatatatgtgcatactctttaggaaaaaagaccactcccagttcagctaatatctgtgatctttttggatattttactcctgaaaatggcttcgatggcttcattagaaacaacctaaaatatttcttttccatagtgaataaattctgaaagatatttctcctcataaaatttaactaattaacctaatgccatccttggaatatttaaacgctatgtctgttgtgtttggtttaggaaaagacaaccctagaacccaatttttttcagattttgcactataaatttattcatatatattaaacaaagttgctgacagaaaaaaaaaaagttgtatatcctattacatgtgtgatttagtaatatcctttaggacacaataacaattatgaggtacaataaaatttcattctgtgcagagcttttcatggaacctctaacctcaattcttccatagcactgtactacaccacgcagtaaagaaacattttttcaacttatttagtatttgaggtataaaatctggagggggaaaaatgaggatttcagttggatttgaaatgagatggagagttaatgaaacagagagatacaggcgggattccttgggctgtcaagagtagggaagattgaagaggcaaaaatgaattcaaagtgcataggcagatgcaaagatatccatgaaggtctatcatccatgatattaactagagcaaataggcaaattttcttttccaaaaggaagctatatttaaagaaaaattaaacataaggggaaacttgagagtgatttgtaggaattcacatcaagcgggtggtcctgtttcttagcccatgctgaagcattccccatctgtcatctgaagggaaagagcattgaattcgtagtatgggagtttcccctgtggaggaatgagaagatgcagtgtgcagctaacaaccaaggcttgggggtggaagatgggaagaatctgaagagcatggaggtattagggccatgttagactgaatgaatgaaataaatacgggttagagaaaagtggagggaggaaaaagtaaaatcagtcaagaattctaattgcttactcatttggaaatgaatggacacttatgaatgagacctcgctgcccagaagataggaagtagcttagaagttgtttcctgatggataaagcagtgtgcagattccagtcacttgggtctgttcttgcttctcatgagcacacacctcacacgtacttgacctgagaggagatgctcttgttggaaactaagatttttttgtcctctcgtgcctcacattatgcagtcgctggaggtgaaagatcaaagctggaaaagtcatctttgaaggggaaacacctttcctcactcatgtttacgatttttttctgtcttggtttcatagaaaaactatgcaggtagccagagccctaagttgttgtgccatctgtaaacctgacatcatgtgcaaataacaacagatgatggaatttcacctagggtctgatcgtgcccagggagacttcataggctccaaatgcctgcttttatcttatacatcgagaagccattcaaactttcagggctctgccaacttggcaagaagaagagttggcaagcttcccatgctagttttcttttagtttgaaagttttgaagtgggtctgaggttgtgataaatgcttgtgaggtctcttatttgttgactgtaagcttttcatcatttgacatgaatgagaaacatcattcctttgcaaggatattcccttttttctgtttctttaaagttatcttagagacttctcagttactgtatgaaaccataaattctctgagcaaatgcctgttttgacagagagctttaaagatacatggcaaaagtttaaacaggtcctaactgatgggatttaaatactgtatatagtaattaaatagttgtgctaataaaaccctaaagcactgcttgcatttttcttctttaatctctcaaatttttctccaagactcaaaattcatgaattaaatgagttagccaagggaaatataattgtgttaaatttcctaagtgctttacacactgatgaaaaaatttaaagtttataataaatctacaaattataggtgggggctcattttaccacatagcttctttaaaatgaaactcccaagcatggtaaagaaattgcatataaatacttgctgcagaagtaagaatacataaaaaaactcactatgtacttgagtctatttgatttgttatgtttagatggctcccatatgaataaaataacattacaacaaagcattttatgactttttcatatggattgattatatattgtgcatctcaaataatctctatctcctttaatattcctctataagtcaccattacatagttttagttcttacataatgggatgctattaaatttcttctcccccttttcttaaaaacaaaaacaaaaacagaaacaagaataaaaaaacactccccaaaatgctatgctatctttttaaattttacaacatttttagccatgggcttcatatctagctcaaggtttattgtctttctactttttctaaatgatttaaggcttctctttctcactggacttaccataaagtgacttcttgctcttctgtcactttctgaaccaaaatttctagcctcattacactgtgagagacttaggaccaggggcagaagagaagccttgactctctttgaggactagcataacatgatatgaacatagcaggccactgatatgtgagcatcccataaataaaagagaattatcgccaagaagcccttactcagccagactacatttccagtttctcttgcatctaagtggaggcttgcatctagttttcaccattggaatgtcagataaaatgatgtatgttctttctagcctgttaggaagcagatgtgacttctccatgctgcctttccctgtcagctgactggctatagaagactctctggacatcacaatgtcatcctagccacaagatcaaaaagagtagagtttctgtgtcaccatgtggagaaaagttatccaccaatctgaaacaattacgttagactactgcatgggcacaaaataaacctctgttctgttaaaccactgaattttttttatcgcaggtaatgttatcttcactaatacagggaagaagtcctgctgcttgtcagacttagtagggcccactaatcctgttgaacccagaagaacaggagcaaagctgctctagtgtgttgaatggcgccaataccttgtgaatgagagaagtctgcttgaccaaaagacctaggatacaatggatgccttctacaacttcctcttagtgactataaaacagagaaaagcctcttctaggacttccatggtagattttccactgcttaagcaatagcatctgcttagtgaatatgtctgctaaagaaaaatccagacaagttaatattcacattttatttaagaatattctagatgaggaagcaataattgaacaactagaagtgtaggctgtcattaaattagagctaatagaggaactggaagagaactttatcaaaaagagaagtgctctcaagaagactgaagaaaatcgtgaaaaaagagcattcaaaagtattctggaacttaaactgaaaattctacaaagctcaatagatgagctgaaaaagaaagtcactgtgttatttatcatgtaagattaatgttaggaataacacataaaagaaatatttcacaatacagtgcaaaaatcgaaaaaaatccacttaattgtaaaactagctctgaaaaactgtggggaatatatatggagagatccaatatttccacttcttgctctgtatacaaaggaattgaaattagtgtgccaaagagatatctgcactcccatgtttattgtaccattattcacatagccaagatatggaagcaacccagtatctatccgtagttgaatgaataaagaatatgtgagatacacacacacgcacacacacacacacacacacacacacacacacgatggaatattatacacccttaaaaaagaagaaaattctggcatttgtgacaacatggatggacctggaacattatgacattatgctaaatgaaataagccaggcacagaaagacaaatactgcatgatctcacttatatgtggcatctgtaaaagtcagtctcacagaaacagagagtgaaaaactggttagcagaggctggatggggatttggagagaagaggagctgttgattgaaggatactaaattccatttagactggaggaataagttttagtgatctatttcactgcatggcaaatgaattataaggtattatgtatttcaaaattgctaaaagaattgatttttaatgttcccatcacagaaaagaagttggtaaggtgatagatatgttaattagcttgatctttctacagtgtatacatagatcaaaacattacattgtacattatatattatataatatattttatataaaatataatttattttatatattatatactttatataaaatataatatactttatagtatctattttatatctataaaatcattatctctcaaataaataaataaataaataagaaagaaatttacctagagagcaaaatgccacatttataaacctttaaagcacttgggtatcatattttgcttaacaagtattgctcacctcagagtcttaaaatgttctatttaataatactattattttatctttcaacatttaatttttaaaaatgtaatttttcactctgatgataatttcttttgctgtgcagaagctctttagtttaattagatcccatttgtcaattttggcttttgttgccattgcttttggtgtttagtcatgaagtctttgcccatgcctgtgtcctgaatggtattgcctaggttttcttctagggtttttatggttttaggtcttacgtttaagtctttaatccatcttgagttaatttttgtataaggtgtaaggaagaggtccaatttcagttttctgcatatggctagccagttttcccagcacagtttattaaatagggaatcttttccccaattcttgtttttgtcaggtttgtcaaagatcagatggttgtagatgtgtggtgttatttctgagggctctgttctgttccattggtctatatatctgttttggtaccagtaccatgctgttttggttactgtggccttgtagtatagtttgaagtcagataacatgatggctccagctttgacaacctacagaatgggagaaaatttttgaaatctatccatctgacaaagggctaatatccagaatctacaaggaacttaaataaatttacaagaaaaaaagaaccccatcaaaaagtggacaaaagatatgaatggacacttctcaaaagaagacgtttatgcagccaacaaacatatgagaaaaagctcatcatcactggtcattagagaaatgcaaatcaaaatcacagtgggataccatctcatgccagttagaatggtgatcattaaaaagtcaggaaagaacagatgctggagaggatgtggagaaataggaaggcttttacactgttagtgggagtgtaaattatttcaaccattgtagaagacagtatggcaatcccttaaggatctagaaccagaaataccatttgacccagcaatcccattactgggtatatacccaaaggattataaatcattctgctataaagacacatgcacacgtatgtttattgcagcactattcccaataacaaagacttggaaccaacccaaatgcccatcaatgatagactggataaagaaaatgtggcacatatacaccatggaatactgtgcagccataaaaaggatgagttcatgtcctttgcaggtacatggatgaagctggaaaccatcattctcagcaaagtaacacaggaacagaaaaccaaacaccatgtgttttcactcataagtgggagttgagcaatgagaacacgtggacacaaggaggggaacatcacacaccggggcctgtcagtgggtgggggactaggggagggatagcattaggagaaatacctaatgtagatgatggattgatgggtgcagcaaaccaccatggcatgtgtatacctgtgtaacaaacctgcatgttctgcacatgtatcccagaacttaaagtatagcagaaaagtttaatttgatgtattgtatataggatgaggtagaagttcatttttttccacatgtatgccatttatcagtgccatatactaaaaaaagtatccttttcccgttgattttaaatgcagctttcatgatgtattctatccttttctggtatatattttctgggctctttttttttaaccaatattttgtctattccagtagccatatcatgctatttggttatgatgtcttcgagactgttataatgtttggtgaaaaaagtactgtcagtactgttttcttttttgtaaacatttttgactttctattcattaattgaattttaaaatcatttgtcagtttacaatggttactggaaaacattgacgttgtaattctatttttcattgcttactttacatattttatatgatttaacacttttaaaaataaagatattatacctccattatgaaattaatttttacatgttttataatttatattgcttttgtaagtaggactttttaaaatatccactattatttgattattattgctattattgaaatgctgctgacttttttatatgtatatttgaatccagctactgtatttaattatctaactaactcaacttctttcttaaattggaaacaaagactgtcttttcttcacaatatttttacaaattatgtcatttttagagtcatttcattagatagaacttcaaaggcaatattgaaataagtatgataaagcagccttctttatttttttctttatgtgaatggaaatcatttcagtgttgtcctgtatttggtgtttgctgttggactttcataaatagtctttaagatgaatcttcctatccatatgttaagtagagttttattacagatggctactgaatattactaaatgccttttaggtgtttattaatacaattacatcatttttctcttcttatttgttagagaaggttatggtatcctagaatcagagagagaaaaagtcaagaaggaaagagtggcacctttatataaaaatataaagcctggcttatgccctggtgaaacattcagcaagggagataagactaaagtgtttatatcagcactcataggatataattcacatgaaattatgcagttaagagaggaagcacagatatgagtgaggtctggatttcacaggaaaggctttttgaaaaatcacaatccttaaagctggaacaagataggacaagcttattcatgacattatgaaagcagagaaaagattaaagaactgaaaattgcatatatgtggtggcgaaaaagttattcagcccctagaaatgaaaatactggtgactttaaatatatgaaaacaatacaaaagataatttgttcttcttcactagagatagacaagagaatgactaaagtactaagttaaacaaagaaaattatagcaatgtgaagtgttagtcactggaatcttttacctcccaacacagttttctgcaattttaaaaactttctcttctgcttgaaagcagggacaaggagacctttcttagaatcaagattcattgattttatgaagtatattcagaaaaaccagttctgctgcttagtgatctgtttactcctgaaatcctgaagtgtcccaaactgtagggaataagatcagaatgtgtagggtttttagaacctagaacaccatgaaattgcacaaactagggggaaaaggactgaacaggcacttttcaaagaagacatacatgcagccaaaaagcatatgaaaaaatgttcaacatcactaattattagagaaatgcaaatgaaagccacaatgagataccatctcacaagtcagaatggctattgttaaaaagacaaaaaataacaggtgctggtgaggttgctgagaaaagaggatacttacatactgcttgtgtttttgtaaattagttcagccactgtggaaagcagtttggcgattcctcaaagagctaaaaacagaattaccattcaacccagcaaccccattattgggtatatacccaaaggaatataaattgtcctaacataaagacacatgcatatgtatgttaatcgcagcactattcataatagcaaagacatagaatcagcctaaatgtccattaatgatagactggataaagaaaacatggtacatatacaccatggcatactatgcagccataaaaggaacgagatcgtatcctttgcagaaatacggatggagttggaggccattatctgttcctgcatttgcaggaacagaaaaccgaataccacatgttttcacctataagtgggagctaaacaatgagaaaacatggacacaaagaggcaaacaacagacacgggggccttctggaaagtggagggagggagaaggagtgaatcagaaaaaatatctgtcaggtactatgcttggtacctgggtggctaaataacctgtacagcaaaccctgtgacatgagtttacatgtatagcaaacctgcacgtgtacccctacacctaaagtaaaagttttttttaagtgcacaaactagaggcttcttttaaaagatggtggagtgtaaagccaatttatttgcactagcttcttttgaaacccaacaaaaacaacaaaaaagaaagaaaactcaagaaaaccatcagtttatttaccatgattcattatgcctgaattctttactctgatttatttctttgatgcttatccttgagtaggtttgtttgcttgttggtttgaaagacaagctcaagatatttcactgtttgaggttttttttgttattattttttttttttctgtttctacagcttcttttctggcctagttgaactacttttattgatcagaattggcatgttacaatctacatactaatccacatataatctttcgctccttgctcctagtttttcatcttccctggtgaactaccgattctttataattcagctcaaatattaataccacctactttgtgtaaactttcctgacttccccaggtagagctgactcttccctcttttgctacctttgtacctttaccatttctttatcttccacctgtaatgataggcttttactttgtttttttcttgtttgttatagaccaagttgggatcagtccctgctctacttacctcctccctgagaagcttctttcttcaatcaggggcaatcttaaacaggacattagcactagatacacacagacacagatacacacacagacatgcacgcgtgcgtgcgcgcacacacacacacacacgcacacacacaccccccaaataggttttcttgaagttttacagaaaattcctggggagacatggaagaggattaacatgatgcactccaaagcacagacttaataaaagtgcattggctacctctatttttccccaagcaaaatacctcatgtttttctttctcataatgtcatctcttccatatgctttctaaaatgtgcccttcctcattctaagcaggttagttgtcaccctcagcttgcataagccacccagcagagcaaaagcctctgttgtttctaaaacctgccctcttgggggcctcttccttccccttaggttgcttatcacagtctccagtatttgaaaattcatctctcttcttttggggagccagtaaatagcaacaggagattaagctgctaataataactaacatttatagttagcttattgtatgccaggcagcatactaagtactttctatattacattaaataagattatctttatatccctctacctgcaggtttgtctcctacggaagactgtaagcatttgcacagtgatgactatattatttttttctgtattcttaatacttagcaacatgcctggcacatagtaagcacttcataaatgcttgttggatgaatagtgtgtatgcattgatgtgatgtaattggtggtgagaagaatcagcctgttcacagtaactttagtcatagttctttttatatttgttttttgttttcacttcaccatggttgtcttccactattcatcatgtagtcagtacaagccctggttgtcactctgttagccatggatattttcagctcttatattctgacaactaattattccatgggaagtcttttaatcaggattctctttgtttatattgaaatgactaatatctttctcacacatctcatttcagcaatatgagttgatgctgtattttggatcatgtattttagaccaggtggccaggcagcagcactccccaccaatgcagacaggttaggttttcagtctgtgcttggtgcatctctagggggttaatgaagccttcccgtcgaagccgctgtgatgagaggacaggcaggactcctgctccctccccacctgctctgagttctaatccgagcagctcttcttctgtctggtttacatattcatcttttgggtgaaatggtgttaaatataatatatttgaaaacgattgggttaaaaaagctattctatttaaaatatcaagatggccatacataacacagatagataggtcctcaacattagcaggttgggtagtgtagtcaactgctgaaaataaatacagcacaacccaacaaaacacctttcccctcaaacactaacaaagtaaaataaaataaaagcaaaaccctgaaacccaagcagaaatgtaaagctgaagagacattttctagattggtcagtcacagcagtgtattcagaaggcagttcttcctccgggtttgagaggcctgtagccatgtatacagaaactatcttgggtaaggtgcctctactctgtcgggcttactatttaagatccttagtgggtgtcagaggcctttggcctgtactgcacaggtcttttcttgtttgtggaacgtcaaattcattttctctccaacaggccttttggtttcttaaaactctccggttcttgtccctgcacgtttttccctctcaatggcatttgactcaggttgccagtcattaatttccttgtatggaattaaggagatcttctggtccattctgtggctagaggcaataagagaacccatcctcatagatctagtctcaacatgaagcattagaatgtaaactcccaactctagaatataaataaggtcactgaggacagggatttctaactgttttattcatagatgtttccctacctcctagagcagtgtttagtaatctgtaggcactcagtaaatattgtttaaatgaatgaaggaaggaaataccggtctcacagtcacgccttttatacttttgagaatgaatttctcaactgtcttatccctcgatctgttattaactatgctaaaaatatttcctggctttgagtagcattgtagaaggtcctcttccattttccgattttcatagatgatcttccattaaaaaaagacgctggcatgtttctgctgtagaaaaaaggaagcaaagggatagttacaactccttctactcttctcccccagaaaaacctttcgaggcctcaccaatagatggcttgctttctcctccaatcaccagcagacagaggggccctggtgtactgctgtgttctccacaccaagggggaaatgaataatgtgtgagattcctctctggaatgttgagtgtctcaaccttccttctacaattatattttctgcttcacggtgatgacagcatcacctgtgggttcagaatcagagacctccagcttctgtccccattttggggtaatgtatgtgccacctttcttggattttatttaatcagtgagtctcctccccaggagattggggactcaactatctctaaacattttctcatcttttcttcacctagggttcctgggctcctgttgggcctcactggaagctcctagggttaaaccaaccttgggcattaatttcagtgtctgttctccacagtcacaaaaatatggacctctagttacacttcataaaatagcagagatcctacctagtccactgacagatgtcagcatagcatcctcttctagaaatttactagcttatgttttctgggtacccccaaattctatagcaagatctaattctcagtgcagatcttaacaccgtatctgagtattttgtgtctatatgagtttgcctattcataagagtccagcgaatggtattaaacatccccttttgtctcctgcaattgcccttagatccttcctgaggatatgccagtctagttatgagaggtgatccggacgttgttcatctagagttaatctggacattgttctagataaaacacacataaaaccatgaactctaaaatgtcctcagtcctttaaggatgatagaatgtgcttataggttatagctaggttgattatataatttattatttaaaacatgacaccttgaaagcaaaagggaacggtatttataattacattgcctcagaagtcataaaccaggacctgtagtcactctggttatggcagaaatcttgcattggaaaatctttccttcaacttatttcaccctacatggtgaaaattttttaaaactcttctttaaagtagtctttcaccttaaggattcactttttccgaaccaccaatgtcctttccgatataattatgtggtctaattcacccattccttcacattgttcatgttcttaaccactttctctatctttactagagttggctagggctctagagatgtcctaagctttttcttgaatagcagctgactggacaagtgaagactttcttttctaacttatcctaataaattggaatctcacttttgttttgtttcaacgccaaatgaggactagcagtggcaagataagggtggaacagaggaggaaaaggaaggacaggataaaggaaggaagcctaccacttacgtatacatcacacctgggatgctcatgctcttgtcccctgcctgcgttagccttggactcactgctcccttgagatgccactaagagggaaagggagagcatatttagaacactcaccccaccccaactttaccaccttcactgatgctcctcaagtccttaaccttctcgctagcttccccagcctccttcctggtcttgagcagcattcatgcggagtctcaaatcagagccccttgccctgcttcctcacttgcctcatactgtctctgtattgctttcctcttgcaagaactcgttcaccacactaggagaaaagcctagaagaaccctattcttattgctttatggatgagaatgtaaggggttaggaagagcccccattttcttatctttatgttgaaaacgcagggtgatatgtggtcttgacacatcaatttagaattccgaatttattttctcatcaaaacccctttataactggccatttggtttcaaaatactacaagtagtacccactggatatattagctatattggtgtttaaatagatgtttatattcttatctatcagtctaattaccatgtataatagtatttccatacaaaaatctgagcttagttcctcaagattgctcagataaaatttggggagattgtctatttataattaggtctatctcccttttttgctagttctcatttgaatacattcaattccaagctgttaaaagttagcaatgctaatgatagtgatgatcactaatgtttattaagcagccttcatgtagcaggtgctgcgttagttactatattgtcattataattcatatctcactgtgatgaaagtattatttccatattacagatgaggaaagtgaggcacagtgaagaagagtgaggggcttaagcttatgtaatgaataaatgataaagctaagattcatgcccaggcttgtcagactctgaaattggcatatttttacaatgccatgtggccacctgtgcctggccatattttaccatgtgttaccacgctggtgtgtctattttaggttaggagcaattttagagagaagcagtgccctaatctgcatcttcaatgccatttaggtatgttagttaggacagttggatgctaaagcacttaaagtaacttttaggtcatttgcattttccaacagtggtaaatgaagatatcaaataaatcatatattccctttgatttggagttgcttgctatgttctctcccttctgctggtttttcattcattgcagccaatagctattggattcatgttgttggctaaatctaccctttttctaatcatgcttcctgaaggttggagggggaaatatttgccataaaattgatttctaagggcagggcaatgagtaaggccgatatcggaatgttgatagaaaaaagcccttcttttgtcttgttggctgtaaaatatcttgcatggcccagagtacaatgaacttaaaatacaaggagagcgcagtgcaagtcaccatgatgactctgacatcagtattttccatatctcttttaacccaattgtgactttgtagaatgtaaattgcatagaaaatatattttttcatactgtctctaaatcctagtttcctttcttgtcatattcttttttttatttttcaattaaaataggatcctgttttcctttcttttcatagtctttttttatttctcaattaaaacaggatgggtaaaaaggacacaaattctgccattgcaaatgatctatcagttttgggggacatactgactcaatgaagatccagtgttgtctttcaaaatttcatttacattccgctcattcacacttttaattgttattcccttaaaaattaataaataaaaggagccatcttgtttacatatttctgcactttttttcttcatagacagaagtctttcaaatctgattcatatttcttttcagattgcactcttaagttcaactcttcacggacgtctataatattccttatctcagctagttctccagaatatgcttatgaaacagaaaaggttcccttgtccccctcacagggcatgtggtgggggtgtggctcacttcttcagtgtcctgctgctgaaacctctaggggagcatacaaactgacaggctgtggggctccaaacccacgacagtgtctaggggtgaacgctgagggccccagtgggctgaagccccagtgggcgtgtgttacagggtgcttttttagtttagccatttgtaggtggcttgtattagctcagttagactgtggtcttaattgcagagacaaagggctttctgtatcctgggactcttgccttggtgttgtacggatcatatgtggacttggagaatgagtgcaaggttttattgagtggaagtagctttcagcagatgggggagccagaagggagatggttttcccctagagttgggcctccgcttggcggactgggctctcctccaactgccccagccaaactccatgtcgttctgctggttggtggcctgctggcctgccgacgtctgtcagtttgttcttctcgacgtccagccacctgtgtgttctccgctgatgtgctcctctccatatccagttgcttctgtgtttgcctgctagggtctcgcaggttttcgtaggcacacgatgggggtgtggcagaccagggtggtcttgggaaatgcaacatttgggcagaaaatgcctgtcttcacctaggtccatacgggtggaaccctagccagggaccatgctctcctcctagcacttcccttcctgccttctgtatcatttaaagggaccactctcttcccttcccagcactcccatatcacttacaaccaacctctgattatataggcaaaaaaaaccatggttctagtgaacaacctgaaaaccacaaataaaagatgcatcaacgaattatactgacattataggaagatatgcaaatgtactatttctatggaatgaatactctggggacaatgtctcacgctgtgcattatggaatcatgaatttcagcagtttcatttttctgtgttttacattaaaatagcaaagaaagagtacatgtctagaaaactatttcttagtgacctgttagacacatgccagaatgtctaatgtttttcacatgtggttcacctgagcctgtaagatttgataatgcaccattctgaaataaatgagtgcctctaaatgtagtaacacttctcatgtccacttaaaggtcaattatttcaaccattatggtttaggaaaatgggctggttaaataagctgagtaaaataagcagcccagctcaccaagaaaggacctgatttgagagaaatgggactaggcttgcttttctcaagtccatcctcaatagccatcagtatcatataaactaaaatcttatataatcttattttaatctcaatataagataaaatctgacctttaataagccccactgtctacactttttttttttttttgagatggagtttcaccctcattgcccaggctggagagcaatggcatgatcttggctcactgcaacctctgcctcctgggttcaagtgattctcctgcctcagcctcccaagtagctgggattacaggcatgcgccaccacacctggctgattttgtgttgttgcttttttttttttagtagagacagggtttctgtttttttttttttcagtagagatggtttctccatgttggtcaggctggtctccaactccagacctctggtgatccacccgcctcggcctcccaaagtgctgggattacaggtgtgagccaccgtgcctggactgaagtctacactccttaacatggtgtacaaagttcctgatctcgccactgccagcttttatagcttttttgcttatcctctctgtctactacttttagccacctgaactgctaatatttccttccaatgtcctttgctttcttagccctatgtctttgttaggctgacttttctttttctccttgagatgtctttttttctttttgcgggggttgggggggcccaacatttctcgatctcatttgtggattattttcaggatcactgtgttgtccagaaaacggacatggaccattgattaggttgggttgggctgtcttctctaatccaacagtaatagaataaccaacacttacagagtaatgtgagaggctcttggtacatcctgtaggtgcaagttatctaatttgacccctctacccaccctatggaggaaggtatatgaggctgggtcttatgtaataataactagagcacggattaggtactggcttttcagtatcttttcctcccatgcctttatccctatatctgcatgtataactaggtccagaggtgggtaaaccttgatgagttcattcacttctcatattcagtgattgctcaggaaagggcacgagattgggttgtgatctagagggcactaggggagctattaggtaggttgcctttacctagaaagatgagatcgtctgtatgagagcattttgcacactgaaaaagccatcatgctagttttaggcttcaagtaacaagaaacccaaaagattaaacaacaagatttattatctcacatcacaagaagttcagagataaggcagttccaggattagttaattcattagttaataacaataaatatataattaagaacccaggtctcttttcatctttctgccctgccacacttagtgtattggcttttgtcttcagggttttcacctcgtgtttttgatatggctaccacgactcctagactacctcattacacagcatttacaggccaggataggctcctcttcatgtcattatatgacaataattttcatgtcctttttaaagcataaaataaaaattcccacacacctccaataaaactttctgttctgtcccataagctagaactgcatctcttgcccattcctgagcagtcagtgaaaatggaagtgaaatgacatgattgccaagactgatcaaggtttattccctagaaggattgagtttcccagaggcacatagtcattcaatgtttgaatgaaattgggattttggtaaaagaagaaggggctaggtcatgtctttttattaactagtggtacctgccacagcactatacaaatatgagctctcatttttaatattagtatatcaatgtttaatatatggcagtggtttcagaaagattcatttttgagataatttttaagcaaagagggtaatagtgttttctttcccatgttttaggttgggttgcctcagaagcagaacctaaaacaatgatttgagtgcgactagtttatttggaaggtagaggcggaggggaagtgatacaaggatatagggaagagaatggattatcactgggtgaccgaagctcattgccataggggcactctgagaaatggtacagaattacatgcagagttatccctcagaaggaggaagggagctggggtaattgtaccccagcttttgccagttatctgttgagaaactcagggaagtgtgttaatgtccccagggcccttgtgatatggtgttttgcagcttgtggggaagctttcaggcaaagacatacagatattggaagctaaaagtcccagggaactgataaggctcaggggatgtgagaccaacaacaactgccacattcctttatgtccataacacaaaataaagagcagaaatgtcacagagcctgcaaagggatggagatttgtttcgtcaagaagggaaagaagcactttcatattttttatttagctctcaaatggggtactttctaaagctgtgtgatttatgtatgtattatagccagttgtttccctgcacactgcttacattcatgttatattctggcagaaaaaatctgattttaattgctctaaaaatacatgttcttatctgcaggatttgtattgaggcttactgagagcagcttaaaggtcaaaaccttatatttaaactattagctctaattgttagcggagtacattttaatgttacagagttggttaaactgctggtatccttccaccttccaagatgattaagagcgcggaaaaataatttatcttaaatttttaagtgtgtgtttaattttctcatttatggcatacgtaacagaatggcaattaattattaagtctaaagaaagagaatcattgttcaaaatcagtacactatgcttcatttaactcctataaatatcacattctagagacataaacttgcgcagtcagtagcaaaaggtggttgttaataatctgttagtcactgtgtacactcaattggccaagcattttctccacttattcttttgttattttctcttttattgtcccaagaatacaaagcaattagccaaaattatatgacaatctctggaaattattttattttccatttgtggtttggggacagggaaggtaggaggaggagggatggaaagaacttgtcaaaaattgaggcaggtgtagtagattgaaatagtaggatctcaaaacatgtccatatcctaacctctggaacctgtgaatgtgaccttatttggagaaatggtctctgcggatacaattaaggatctcaagaggaaataatcctggattcagggtgggcttaaagtcagatgtacatttgaaacacagggatacacagggaaggtcagagggatactggagacacagtatcccagaggacaagagcttgtgaagatggtcacagagattggagtcatgtggtcccaagcaaagggatgcctggagtgaccagaagctggaattagcaaggaagattcttccctgtaccttctgaggtagtacagccctactgacacattgattttggacctctggcctccagagatgtgacagaataaatttatgttgtttcaagtcaccagttgtgtggtaatttgttacagaaacccaagaaaacttatatagcaggtattttattagtggtagtaatgataatggaggtaacgttttgcctataattttatagtttaccagatgttctcatctatgattatcagagtcaaatggtaagctgaatgatacatagaaattaaatgtcctgccccagctatagccataagcagtccagtatctcagacacagagccactagcccacaagaagctacctccgggaagggaaggttgaggagcttcctcaagcctctaaggagtaacaaatcctggtggaaagttttttctccccaccccatattttctaaagccagccttataaaagctgtgcttccattttctcattaaacgttcctctcagccagcactcgacgttcactgtgtggacacattccaatgagttttgtttttttctttaccatatggtgatttcaatttgtactcactgtagattcattcatttctttattaaatgcacatttacttcatacttcccaaaggcctaacctgtgcttatgctgaaggacaatagcagtataatgattttagtacccatgtttcttagaaacgtagccttcacattttgtgcacaaaacaatcctgtataactaatcttttttttttttttttttgagatggagtcttgctctgtcacccaggctggagtgcaatggcgcaatctcggctcactgcaacctccgcctcccgggttcagccattctcctgcctcagcctcccaagtagctgggactacaggcgcccgccaccatgcccggctaattttttttttttttttatttagtagagacggggtttcaccgtgttagccaggatggtctcgaactcctgacctcgtgatccgcacgtctcagcctcccaaagtgctgggattacaggcttgagccacaactaatcatttttaacaaaaaaatttaaggacaagatttgtgcagtattaagagccattacttattactgtgtgactgagatcatttatagtcattcaatgtttgagcaggttagttttcattagcagtttctcccccctcttggttaagagagtgaatgtttcagatgtggtgacttggttgcctgttgttcaaatatacgctactggcagtttctcaaaatgtcaatcacttcatctctgctttaatttactacatatattgctcagagtgctgaattaatgatgtgaacttgaagtttcaggtcttcaagtaatccctgggtgatgcatcgggattaggcctttgtagtagaaattatggacatgcgtgctgagctttttgtgtcttgctattttttcagccttgtatgaagggccaaaagatgtgaagccttattaaacccagtttatgggaatctgttgttttggactgagctcctgcaactaggcccataccagaccaaaccagaatggagtcactcttgctgggtgccatgtaataaccaaactgaatgaccagttttccaaaaaacaggagatttcacagcaaccaatcagaaagggctcagtctacctaaagcctggaggataaggaaattctgtctactttaaccttataaggaaagtaactttgaaatgaccaatctgcttttcgttctttatttcttgatccttatttctgctttctttagcaatttctgtctataaagtcaacacctgctgctcggctcatgggagtttctcctgttttgtagacaggatgctgctcaattctgaatcgctaacaaaagccagttctatctttaaacctcagttagtgaaaattttgttttttgacaagctataagaagcacatagccacatgacttatgattatacatttttagattatttcttaactattaagattctcaaaaatgtttaggaaaataaatgacctctaggtttaggtttatggtggactaagtggtgaaccatttgatcttgaaaaaagaaaaagaggatgaaaagtaacaaagttgcactcatccctgatttctaaacatctggtcatattaaaagattctcatgtattccagaacttaaagtataattaaaaaacaagtttctcttttttaacttttaatcctaaatagtatgtagttttaaattctcatatactattgtatacctcttttactacaatcatcactttctttgcaaatattttcattggaatcactagtaaagccatatattgccttattcacagtccaggtaaagaatttgagagccttcttacctgtgtttggacattcattttttggatatactttaatgtgtccacatggatatacttttggatacgctttaatgtgtccacatggtaacttgaagcaatagcaactatgtttaacttatcaaattttccataaaccaatttgatggtcaatccctgtaatatttagttcttcttctgcacaagatatgttcttgttacaagtctttctacttattaaaaaaaataccagttaaaagagaaggacatttaggctctatcttttaaaacctaaattattaattacacgtatgtttcttgaggatggtgtggagatccagctgtgaaagcctaaaacacaggaagggccacaccgtcagattcgagcgttgctttatctggaagggtaatttcattttcctcagtgtgagtggtgaacaaagaggaactaaaggtagagaccagatggagaactgggtcacttttctgggtcttgttgtatttggatttttattctttgactcaagttttgtttcagatgtggtgaactttaagaaaggaggatatgctgacgttcaaatataaatatgtattatgttcttacttttatccatgcttctgttttcctccactggtataaaaattgccttaaatatagaaaagaaatttttttctacttaataatgtatgttatgtataattgggatcaatgaataatctcgttgatcaagagtgtcttcaaatacagatgtattttagaagggaatggagattgctttatgtttagcatttcaatgtgtagcatttcaattgagcatctactttggatcagatcctcagagtctaaaaatagttttaaaataatttcttcattttcaaggggcttaacattaattgatggggagtaggggaaggatagtttttgaacagaaaaataaaagacagttactaaagagaactatgaaatatattgttgtccttggagacagagtctaaaaatagttttaaaataatttcttcattttcaaggggcttaacattaattgatggggagtaggggaaggatagtttttgaacagaaaaataaaagacagttactaaagagaactatgaaatatattgttgtccttggagacagaattagggacaatagatgaaagaggcaaggagagaggttctgacttattaccagaataagcttgataatgatccaagcataaaaaacgatagaatgactctgtctattgggagctgatgagtactttctagttagaaatatttatgcagaaaatgaatgattttatctgagtactactacttggtttagaggattgaaggaactgccaagattcctttagaatttgagattgtatttttgaattagttaggcatctttataggagttatcttggctgggcgcagtggctcacgcctgtaatcccagcactttgggaggctgaggcgggcggatcacctgagatcaggagttcaagaccagcctggccaacatggtgaaaccccatctctactaaaaatacaaaaaattagctgggcgtagtggcgggcacttgtaatcccagctactccgaaggctgaggcaggagaactgcttgaatccaggaggcagaggttgcagtgagccgagatggcgccattgtactccagcctgtgcaacaagagtgaaactccgtctcaaaaaaaaaaaaaaaaaaaaaaaagagttatccttttctccttgaagtcttgccaaggacttgggtgggcactgtgttggttaggtagctaggaagctgtggttgattaactgttaaagtcttgagtatatagtgaagaagaagaaacagggcagaattaattatgcattaaggcctcccagtatcttccgttagctgctgtgattttaccaggaccctcactttccttcactttccttggattagatggtcaggtggcactgaagtgacttgtaccaacaggcttaagcatgagaactaacctgatcatattatatcctaagaaggtattctagaattgaatttgtagaagatttcactagttcttcaagtatatatttttagattcaagtattaaagttagcactaatgtaattcactttgtttatggagaattgtttacttattagaatctataaaatagttttgatctaatggaaacaggcctgttggttataggagggaaatgtatcatggtttgacaaaaaaataaaaaataaaggagctggggcatgacagctcttagaagtaaaatcatttgaactatttgtcattgggagaaattacctacagtatcaaagagttgtcacaaagaactttcccctgatacccaacaacatatatgtgtatatatatatgcacaacgttgacttccagtgatctccatttaatataaaataattatctgtgacaattattctttaaaaatgcattctccattaacataagtggaatttcgactagccaacactttgaacttttatgtctcaagtggaggagtttactgggtacagaaaaatgaaggaaaatccatagcctgaatagaagagaaatgagcttagttttatattatactttaggaagaataaagaataatatatgagagttggaggtgtagagaacatatgtgaaatagttggcaattatttattttattccctttgaggacagttcatctttatacataagtattaacatggttaaatgcaaggaatctttaggagcaaaatgataataagaggttatttttatctttgaacaaaatctaacctaactgggctgaaacccaataggtaacattggtgtgtgtgtgtgtgtgtgtgtgtgtgtgtgtgtgtgcatgcatgtgtgcctgcatttatgtgtgcatgtatacattaagtcacattttttatatttgtttcacttttgattgaaggcagatattgttggagaacagatctatttgtgaaaccttattgggaacatccaaattggcaaaatgacttggtgcccatctgcagtaaattaagatgtacatctgactaggttggggcttcatgccagtgcctgtctcaacatgttcagtttttaactgaattctgtcaaaattccgagtcagataataattaatgccacagacatttaatgcatctttattatgcaagtgcctgtctttgtgactgtagatttagtcagaaagggtcagggtggcttcctggccatgatattagcctagagctctccctactccctccaacccccttccttctgttttctgttcactctcattctaccctgggattgatcactgggatagtggttggaaaatgttacttcattggtgaagaaagctcatatgagatctatgttgtttgaaagcattatatggtgtcctagttaggattcttccaaaagcaaaacctgacacagtgactcagatatgatagtttatttgataggtagttccaggaaacaagaatgagggagagtgaggcagctttaaaaaaaggattttaatgagcagattaaggataagggtaactaggactaagtcctgctatagatcttgtataaaatagcctcagaattgtctacacctagggacagggaagttgagtatttgttcacttaccccattcttcattgttggtgttttctcttgggggtgtttaatctctggcactttcagcctgccctaaacatggactgagcaggtggagaggcagaaagacacaagtgctttaagttggggagctgttggtgtgtataggaaccagatagcttcaggtgaactcagaggtgggctaagaggacgtgaagcagggcatcaccaatgtaagttccatgcggtttctattgaaaaggagcttcagggctctattaatgtatagaatgtctacttctgttttctccagctcatctacttgtctcaaaccaactaaatgaccaaaaggaaaagttggaaatggcaccagtggttcatcctgctcattttccagcatagtccgaaggtagacaattctcatactttgcccattttagacagtcttcctcaggatacagatggcaggaaggaaacaggaacctctcagaaatccgatgcagctccttactagatctctattttcaccttctttgcctcttctcaaatgtggatctcaaaataccatctgcttaattgacctaatagcaattgtagtggtagtgctatttgctatcttttctcgagtgcttaccatgttcccaccattattttagcactgttctgtataaataatcagaacaatcccatgaaggggatactataatataatgatcccattttaaaacatgaaaagaaactgaggtagagaacgattacctgtccaaggtctcaaccgtgggagggggtggagcatatgacctgagtaagctgtctagagtctctcgtacactgaaaccaatgcacccttttctcagggctaaacccagctcttggccccagggcaggactagaatatccctggtcctcatgccagaaggcttgtgaatcaaaggctggagcaatggaggagagatggcaacttattgtcacaagccttccctctgttacacttcctctcttcagtccattctccatgcatcatctgaaatgatatttaaaatgcagaaatcagatcacaatacacccctgcctaacactctctaatgagtcctactgcacttagagcaaaatccacaatttgctcagctactatgagcctgctcttgcctgtcttctagtcttcacctcccacctctctacgcatgactctctcagctctaaccacaccggccttctttctattccaggcgcataaggaactgatacccacctcaggacatgactatgtcccactcactccttcgtacattgtcatctcactgtcctcttgttatccttcagatgtcagctcagatgctgcctcctcagacaggcttctgctgaccgcccccctctcttactctaggcatcttattaccctcttctgttttctgtatagcatgtatcccattctgaaaaagtacctcatttattttcgagcctacatgtttattatctctttccgtgctccccacaacccagtctccaaatgtaagctccgtgagagtcaggactttgtgtgttctgtttcgctggtgtgtccctagtgcctagaacttcctggcacataatgagcattcagtaaacatttcacatatgactggctaactgctgagtaaggaaatgagtgaatgaatgaacaatggattaaaaatgtagatactttatcttagacaaaatttggcaacagtagaaatcaagacctttctctgtccagcttatgtgactctgttcaaaattatctcaattgtgtacaatattttgagctacaaacatttttctcctcaaaatctcatttttttcttttatttaggggaaggaaaaggcatagcagttgtttcctgaagcagttgttcccacatacacaagttgacacctcttttagcttttctgaccaagtttcaataatcatacacagaattttagaaataccttcttctggccatcctcccttgactcctgcttttccagtgggagatggagctgggaggtggtggtagaagaagggagagtgttgggggagtgagggaaggacctgtgtgaaaaggattggatttgaccatttagggaagggggacaatatgaaggccctgaaaaccagctattaatgatggggctcatttctgcacaggtaaatatatcagcactcatgccactaagatattttataaaaatgcttcctgaaacaaagtagttacttctaagtttccctagggaataacttttttaaaaattaaaaagatgcattcaacgtatgtgccataaatcctctatttttgataagcactgataactcaaagataatgctgctaatgtatagacaatttactttgttttcttcagagaaattgagaacttaggtcttgctttgtacacaaatacagaggtaacaaattctgataaagatgtgaatcatatttttttccactggttagtagagaggtagattgggaggaaagcattagatgtaatggcagctgtggcccgttcctggatgctaagcaaatctgtttcacatgtgaacatgttgggatcttttacattttgagaccgttttgcccttcttttaaaggtccttatagtctcataactcacagagaattatggtttagtttcagttaccagtaatattgtaaatatattcacatacatttttaaagacattatggcaatgtccttaattaataacatagccatcattttataaagagtcccaatttattaaaaataaaaccctaaaaccaaaaatgatgggataacatctttatgttgcccttgtttgcattcaggatgtttccaagtttatcatgtctgtgacctcagttacgtttacttccccagatggttttttaccacatgagcaattaatataattggagactatgaagtgtttatgtcaaggcaagaagcagtagcagcttcaatgtggtgactttgcaggcagtcaaacatatttcactgtgtgcttccaacctaacccttcccctgcccttccccttctatttttatattaaacagaaaaagagagttcacaaaggtgctcagaaactggcagtttctttcagaatgtggtatatttctaatttccatatatttccttcaagtggaatggccctgggagcacaattaccttcaatcttgacaggtataaaaaggccaatcctgccagtctctgattgaaatgttagatcaacttttctgaatctggcatgatgggtgacaaaagacagggatgttgctgggtcaggtgaagatgttgccataatcccttttacctattttgagcttctgagcaagaaaatcctatatcaaggtacattagcaccacctgctatcagcacccttagagaggctggcaacagagaggttctttaacttttataaccgtgctctacattaggagaggctcaaggaaagaaaaatcaggcataatctctgaagactttataatgagctcatgttctcattcttcatatagattccatttttctgtatgaaaatggtctgccaactgtccataattagccccatcttacttcacctggcaatatctagtgcttatgaattctgttggtagggaatatctttatgtggtgaatgcattctgcaaaaagtatacatcaaaaattgtaaatcatattacatcttaattacagaattgattcctctgaataataagcttataataaagccttgctagggtggtttcatatccttaaatccaaaatattgtgtttgttctttcactatcaatttgtatagactttatgtgacaataggtactctgaaaggggagcacacatatattaatttgcatttgatgacatactttttagaggtgcatttaaggtcttcccatttggtctggcaagttctgtctgcatggatctctcatccccaggatatttttagtgctccctctctgtttcttcctcttatctcccttcagagtccatcttgtcggggaagtcttctccgaccatctcatataaacctcccacccataccatgctttacttttctcctattacttataattacaaggcatattatgaacttattttctatcttccctgaactaaactctataaaactgggttttttctttaacttactgttgtatcttcagacctaggacagtgcctagcacatgtacacacagcacacatcacacacacacacacacactatataatgaatgcatggatatgtgaacaaaatgatgtgcttgagagggaatggtgtctataaaaccgccggtattatcagattcattttgtgtggttatgtttcctgaggagaaagagacgtattactgtttacttttggtttttatgtttatctgttataatagcatatggtatatctggtatatctaactgctcaagtcttaaatgtcttaaaaatattgattaatagatcctttaaataatatgattctaagactcatctgttctgatcatcataatactacaggggaaccacaagtcatcaaatggcatgaaactcaaaactacagaatgtaatctgggagacttataggcccaattttaataaaccacataatgtttttaaaatgtataatttcattgttaacatttgagaaattcagtatattgcacataaatatctggattcccagcctttcttgaatagcctgaacgtctgctgacgcgagacacctatgcctgcatggcatcagttagctggagctgaatgtgggtgtgttgaccgcagtcgccatcacacccttttgtctttccctcaccgcactcctatgtatattttgccaatatggcactgtcagtgtttggtgtggtatccctgctgtaaatcaagctaatccataggcatcacttcatgtgctgctctttatttatttactgaaatggagttgaaaatatttgttgaggttaaggaaaaactatgttctttgttgcactttaaacattctaaatattttggattagagaaaagaaaagggagcttatactaagtttttattttcctgaaaataatccataacttaatgttctatgtactgaaggagtttgggtgttcacaaatacacatatttatcaaaattcaatgaatgaatacttaacatttgtgcatttcattgtatgtaaatgtaatataaagtggaagcaaatgttgaactataattaatcatatgcatgcaaaagtatttaaggagaatttttctgtgtctgaaaatctctttgaaatgtaccaaaatcagatggattaaacaatggattgaaggatggttagattaatagatatgtgataaaagaagcacaatagaatagtcatgggagaatccaggtagtgggtacatcggattttactctacagttctttcaactttgctgcataattgaaaattttataataggatatagggtaaaataatctgcaattaaatatgacaattttcatactgttcctgctttctggaaagtttttttctaaactaaatgtacaattttacataatgaattaatgaaatggtaaattattataattttcagattctgctgtaggtttaattttaaaataatcttttattttaaaacaaccaattatgatttggagatgtaattatgggatttttaaatttttctgtattgtcccttttgtaccttattttcttcctctgtcctatacaatgatcaccccttattctcaaggcatacattccaagacccctagtggatgccagaaaccacagatagcaccaaaccctatatgtattatgttttcctatctgatgatgtaagtgactaatggactggtagtgtatacagagtggacatgctggacaaagtgatgattcaaatcccaggcaggacagaacagaacagcatgaaatttataactagttggcacaacatgcaatttataactatattttcacacaaccactctatctcaaataatattccctggtctctttaagttttacatcttttaagctcctatatgtagtttatgaattaattttaactggttattgttttactctacactttttaaggtgaagccatttaggattttaatgttttaatcatacatagtttttaaaataattggcatattgatataatgaaaagttctgtttttctctcatggactatttcttccatacatttagaaacttctattttacagttataaataggaggttgtagaactattaaaagtaacttaattgtaaatgcagatgctcctcaacttgcaatagggttatatcctgataatcataagttgaaaatatcattaagtcaaaaattttaagatagtattatatcaaaacaccacttacgttacaatatcagatgtctttgaagcacaagtccttctctctgtagataatacttagggaagatcatggatttcatttctcctcgttttctaacatttctctttcctatcagtctcctttgcatccagatgaagtcttatcaaaaagaatttccctcaaacttgtccatatcattacaatttagtagaccccaagtcagtcaattcaactaatattcactaaatgtctatttggctggcttcttcctgggaatctggacacaaataagacattatccctgctctaaaggaagtctcctgctcctataaaaggctaatgtggcaaaaagcagacactgacaaacattaagtggaggaatgttccatgttgatatactatccactttctgatgactcttttcgaaactattgttaggttgataaatatattcttggatatttattattaagtagctgaaataaaaatgattccttcttttttttttttttagaaaatagggtagggctcagcatgtgaattttgtttttaaatcattttaattttactttttatgggtggcagcatagtatggtagaatgagcaaaatgagtttaaaatcagacagattctgtcttctaatcttattaattcagtgatctagatctcagcaacttatttaaatctcccatgtctctcttttttcggctataaggcatgggtaatatagctatatgtgtgagaattaaaattttagtagaataatgagtaaaagtttcgagtccatatggtaggaacccagtaagtagtgagcactcttattattgttgcaatgatgatgatggtgataatgatgatgatttccatttgagttgcttgagaatcacaccctgagacaaagattctcctataagtaatttatgtgagaggtaatctcaaggaacactgataggggagtgaaaaagtagggcagagaaggaaaaaagccaataaggaaggcaactggagcttaatgatgctgtggcattctgagagtcaagtgtacagaatttcccactagagataagggagctggagtatttatccgtcaactcctggcagtcattagttgagggctactctgtgggggtattaattccttggcatttacagccttccacttgcataggcagagtggtgtttggcaggcagagaagctttcaggcaatgaaatacaagtgctaacagttggaagtcagctcggcctgcctgaaatggtaagagctgagggcatatgggtggagcactaatagtatctgtccagatgatgatgatgacgatgagaccacttgatgaagatgggaacactatattcactctctgagagatgaaatgtaagtgtagctgattaaatgtagggagaagcctgtctaggaaaaaagacactgtggtctctgcccactcatacacacaatttaccctacaggtttgagattattcttgcccaggccaatgaatcattttattgggcacagagttctatgcaggtatcctgtctggtacctgggtgggttttgggtattgttggctgctccttggatctgggagtccagttttcattcctctgaactcacttcctaaagctgtgtgcatttagctagcagccttggtctcaggtgatctagtcattacagcctacaggatcagattcagctgtaacccaaaggtcatgagcagaaggaacagctccaccagtcccttgcattgtttgaggagattttttaccatcttccagtttaattatgagatgtggcttctgggcaagaaagcaagtgagatctactttctgcattttgttttgttgataattgaatcatagtaattaagtaatcatgccgggtgtaagcaataacttttatgaacattaagatagtgcatttcataacatctaaatgctttgtttgttaaagttcacttttgagaaattgcaatcagtgttgggaaaacactattaatttgaaggtgtggaagagagagataaggtacctcatttagaattgtatatgtcaggtaactattatctctgggaagcagtgaaggtgtcttatttaataaatctcagaatctatacaagccataaaccagtatttacatatatgggtatagagatatctgtatacatgtgcacatatattattttagccatgttctagacacttaacaaagatgggattgcattgactggccgcttgtagtgtaaaagagaaaatgtaaactgtaatcagtgtttcatttaaatttataaatgcactgtattttttattttgatgaatgggaacaaattattaaggtaataatacattagctataactatgtttaaataagtccagggaatcaggtctccctattaattttcaaagtgtaagatgctatccatccacattgtagatattaggaactgttgaaactctatgtaaatatagtaaaaatttgttgcaaatggaaatatgaagtaattgctagaactttttttttgtattgatagcattaagtattaaggctagctgttgcagtagctataacctagttatagcaatatgcatgtggttgactggtatgtgctttgccacaaaatagaagaaagaatcctccaggagaaatattttgcaaatctgcttttcaacagtaattagaagatgggtgatattttgctactgttcataagtgtttctcttaatattttgactggttcaaaggaaagaagggccaatatccatcatatattgttagggaacatgttttaggattgcagagtgagaaaatagagactacatcttgctatccacattttccacttttctctcagacagatcctgattgtcatccctgtttagcctcctgcctttttactcaactcttccccctacctggatggcttttccttcttttgatcccaactttcccttcctttgatctcagctaaactccttcagttagcctacacttccatcttttattctctcaacttttcttttccatagggtcataattatactgcacataacttgggtatcctctaatcattacaaataatagccattgttcctagcaaaaatgtgtgtttatggcagcaattacattttatgtatctttggttagtccctgcacagtgttagcttatagtaggtgctcacccaatatctgtattttctcttttttttttcaagatctaaatacaattatatttttaaacgttgggtccaggctttacataaaaatatcatcctactttgccccctaagtttctaaaatatcacgtacttttcccccaacatctgcagccatccagaaatttgttggaaacttttttgcattattttaattcctaatccctgcctctttgggctcagtgacaaacaatcaaaaccaccaaaaatgtggttcactcgaagtcagatgagagagcctggctcaattaatcttataggatgtaagcagtgctgcatcaactggctccatgcaggagggacacgtgaaggatctcatcaaccagttatctatataatcctcatgataaatgtgcatgcatggcagaaactgaatcaggtccccataaacaaagtccatcatacagatcacatactcccagatctttgtttctgatctgatctatctcttccagggtcataaatcccttcaggcagatgttgtataaggcttattctttgagctgttgtattttgcttcagtcaactgagctgcaaatcgagtctggctaggtgttggatggtagagcaaaactggaactttttcctgatgtgacagcagtggctcctgatctggctgtctcctcgccagagctagcctggtgggactgagatacgtgaagcagagagatgtcatccgaggagtggaattatcagactgcactgtaattgcttgttgaatcagttatctgttattgcttaacaaaccactccaaaacttggtggcttaaaacaacttactatttcccatgatcctgtagcttggttgggctcagctgggagattctcctcgattgtgtacctgaggtcactcatacagttgcattcagctgagaacttaagaggggctggaatttccaaaatggcttctctttttccagcgtctcctctgtatggctctaatcatcctgcagtctcgtgtggacttggcatcaccatgctgggctccaagatgggggagtgaaagtaccagtcctcctgagggatagagtagtaatcccagatattacttccactgcatttggttgctcaaagcaaatcaaaaggccaactcagaattaaagtgatggtaaaatagactacacctcttgataagaggagaggcaaagccacgtcgcaaaggggcttgtgtaaaaaattggaggaattattggggccatatttggagacttggccccttcacattttgtatctgactttctcataagacttttatttcttcagagcaagggctatgccttcttcacgttttcagaatcagagtatgaaaaatatttgctgtttcttgagtaaatgattactccatgatagttttccctctaccccaactgccaattataaactcagatttacattcagaatactggtgtgaagcatttctactatatctttttttttcaatcattttcaccttttgcatttatcttataaatctaacactataaaatacattatctggccgggcgcggtggctcacgcctgtaatcccagcactttgggaggctgaggcgggcggatcacgaggtcaggagatcgagaccatcccggctaaaacggtgaaaccccgtctctactaaaaatacaaaaaattagccgggcgtagtggcgggcgcctgttgtcccagctacttgggaggctgaggcgggagaatggcgtgaacccgggaggcggagcttgcagtgagccgagatcccgccactgcactccagcctgggcgacagagtgagactccgtctcaaaaaaaaaaaaaaaaaaaaaatacattatcttagttttttttttttagattagaatgctggcaattcactgggaagtgatccctggaagtattaaatgaacagaggagtgggagaagtaaaaaagggaatggatgaggctaaaaaaagggtgacaagcaaattaacctggagcaactggggttgtttctactggggaactctgcacgtgcctcggagctatcccacctgaagggtgagagcactggaggacatgaatttcccagaagttatggtgctccatgattacaggcaaagcaagcccactctagtggccagagagagccctcaggcaaagagacacatgttctagaagtcataccaacagcactgaatggtccaagtcatggagatctgggcagtgcaccagcaatgactgccatgcacaccattctcgtctgagacattatcagagaacaaaccacactcaatttattggtggtatcaagtatctaatgagtttataggctgggctagaatctatatttggggggagaggaggaattacttaagaaggtagtttcttcatatgttctttgacccctttaactgttaatatcatattgtcctaacaaaataatgaaatagaaaaaagtagacctaagaataaatactgtatatactagttttcttttaaattaaaattattaatgtgttttgtaaactgttcttatcacctgttttatatgtaaataagtaatatttttacatcaagcatttttaattgtttattgccttgctgtaaaattgattgttatgattattttagtaatttttatgtgatttcttttaaatcacatagggataattatgcttggcagattacttctacttttttttttcagatgttttcaaggcagagtcagaattaataaattttagccctctgcccaatccatgataagaaggtaagatttagtcattgattcactcagcatttaccaggtatttatcttatgtcagtcactgtgctaggtgctagagatgcaaaaaggaatacaatgtgatctttgcccttgaaaaactcaaatcttagagtcattcaaatatcactgtggtgaaatctcttaatttatcaccattgttagtaatgcatagtattactgacacattgataaccattttcatatcaatcacacctttttataaccataaccattttcatatgaattacaccttttttttttttttaagatggagtcttgctctgtcacccaggctggagtgcagtggtgccatcttggctcactgcaacctccacctcccaggttcaagcaattcttctgcctcctgagtagctgggattacaggcgggtgccaccatgtccagctaatttttgtatttttagtatagacggggtttcaccatgttggccagtctggtctggaactcctgacctcaggtgatccgcctgcctcggcttcccaaagtgttgggattacaggtgtgagccactgcacccagcccaattacacctttaagcccatgtagtcaatcattcagctccacctctaatttaatggccttcctttccctgtcccttccttcccttccctgtctcttccttcactttccttcccttctctttctgctatagactgaatgtttgtgtccctctgaaaatttttatgttgaaatcctaataccctatgtgattgtattaggaggtggggcctttggaagataattaggtcatttggagacctccctccctcttcagccatgcgaggtcacagtgagaagagaagacataagtctgtgaaccagaaagcagtctctcaccagacaccaaatctgccagtgccttgaacttagacgttcctaccaccagaactgtgagaaataaatttccccctcctactaaatagttttagctaaaaggagtaccaagaaaagccctgtctcctatttggaaagaaacataagggctttggactctaaattcacaaaagcagcatttatagtttacatctattgttgcacatcattgtaactccagtgcctggaaaagtatctgatcatagtcagtattcaatggccttaggtggaaactgaaagcaaggaggcatagtagagtgtgattagaggtgttgactggagatttgcatgttttatcagtagcagtttttttttttttttgaggcctaatgatgctctgcttcctcatgaatttcattccaaatgaagacagtaactaattgcattattttttgaactgcttatatttgctgttaccctttcttttatgcagaagatattcaagttggagagggaaattatgatttttttttcctttttcaatgaatgtaactgttaataggtttggatgagtaacttctgtgatataaggtctccgtacaagcagttatcatgctctgtcagtctttctatgcaattttatcatgtagattgttttgggaaacatgaaaattaagatttaatttgtcctaggaattggatccaaaatgtaatggaattggttccttaatgcagtgcatagttgtagagtatagtgtaaattaaatcaacttgtgcttcaataatctctttattagttttcaaatattgatttaaataatgatattaaattgtgtatagttgaaaagatggcattgctttcactgcaatagatgaatgtcatgaaaatgttcttctcttgtaatggaatcagatgtagaacatgataaagaacagttctcttcacacctcataatttctgacatagtaagttatgttgaggaaaataggcacattatattgacaatatatttttgtttacaaatatgccaggtggcctggtgtacagattgattgagggtgatcactactgcccatcacaactattaccttttgcaaagatggccgaagtggaagggaaaacttccctgcacaacttttgtggtggattactgttgagatatagctatgcattggatgttttggaaaaggaatatataagaatagacctttgtatttattgaggaaaattaaaattataaaagataaaaaggcaacttaatattctctcatttaaattttaattaactttcaattttgaatggtgttttcctgagctgttatccagtttctgctctaaagttggctgtaattttataacattcttttgatgactgtatgtgcatgaatatgtctgtagttattttgaaggtaaaactctacttatttcacttttttgagtgaagtattaaattgttttcaagatagcagtgactgaatattgcacttaatacaaatgtttaatttctttaatcctttttacagataaaagtatatgctttttatccttttccttaaaatgacaaaggcttctcctcagggagatcagaaagcataatgactggcatgctgaacctggtatctgaacatttgttttttattctttatttcatgtgaccttggaataattcagtggctcctagattttctcaaaaatgactcaatttttcattcatttcatttaaatgaccctttgagttatctcgtatgctacctgtttttatctttataatacagtaaaatttaaactattcatatctctatgtgggggtgggggtgggggcagataagggtcatagagaaggcacctctttctcagaaaagtagcaaatgaccaccctccatcccaaaatagatttagctacaagaagagtaaagtgcacatggaagaacaaaaaagccttttggtgtacaaggatttcagactttgttgggcttcagcatcagtagagagtcttattaaaaacactgtcatacatcacttaaagacaaggatatgttctgaaaaaaacagatcattaggcaattatgttgttgtgtgaacatcatagagtgaaccgacaaaagcctagatgggatagcctactatgtacctaggctatatggtatagcctgctgctcctaggctacaaacttgtacagcatgttactgtagtgaatactgtaggcaattgtaacaaaatggtaagtattgtgtgtctaagcatatctaaacatagaaaaggtacagtaaaaatttgacacaaaagattaagaaatggtaattgtgtatagggcacttaccatgaatggagcttgcaggactgaaagttgctttggatgagtcagtgagttagtggtgagtgaatgtgaaggactaggacattgctgtatactactgtagacttttataaacacagtgaacttaggctacgttaaatgtattaaaaatattttttctttccccaataataaattaactatagcttattgtaacttttttatgttatatacttttaattatttttaacttttttactattttgtaataatacttagattaaaacacaaatacattgtacagttgtacaaaatttttttctttatatccttattttataagcttttttctatattaaaatttctttttttttacttaatttttttttgttaaaaactaatacagaaacactcacactagtccaggcatacacaggaccagggtcatcaatatcactgtcttccacctccacatcttttcccagtggaatgtcttcagggccaatacatgcatggaactgtcatctcctatgataatagtgtcttcttctggaatacctcctaaaggacctgcctgaggctgttttctagttaacttttttttttttttttttttagtaagtagaagaattatactctgaaacagcaatcaatagtatggtagatacagaaagcagtaacatagtctttcattatcaattattatgtactgtaaataattgtatgtactatacttttgtatgactggcagcacagtaggtttgtttacatcagtatcattcattgtgctatgatgtcatgatggctatggcatttctatgcaatgggaacttttcagctccactataatcttatgggatcaccttgtatatgcagtccatcaatgatcaaaatgttatgtagtgcatgactgcacctactccaaaactacagaagtggaatttagagtcatgggaagctggataatgaccatcaaagttggtcttacatgaggtaggacctggtccaatttgaagtaagaaatcagggaactttccttcaacacttatttccttccatggtctaagacatttcaaaattctgagcatggttttccatttatcacagagtttaagttactattcagtgttgaaattcctggccctcaatggcattatgaatcagctgttcatagaactcaactttcttgaatgggccatttcccaggtcttctacagctgttttgctcatttttaatcccttcatttgccagcttaatatttgctagctgctgttattggggaattcagtttttcccccatgtccctatcttttgccagtttttctcttcattcctcaaaatcagtagttctcctttctcaaaggttgcctatgaatcatccatgatttgtatatcaccctttgggaaacacgaatattttcagaaccctcatttctctgtcgttaaatgaggtcaataatgactgctgacgtttcctttgactctgaagggcgtggtcaggctagatgagaaaattcttacagaatgtggtgtgctgtgctgctgtcgccactttgctgggagactgaagctcagacagctaagcgatttgccagggctgtgcaacccatctgtggtgggaattccagaattccaacctggagaatctgacttactcttttggagaacattatatttgataaactggaatcattgttttgagtgctcccatggctctgtaggccaaaacagtagaacttatgacagtagtttggtcttcaggaactccacttaaccccaaactaccctccagttttcagagagcactggggaaaagggagggatgagtgtgtattgaattatctgaattctgccacttatgcctaagagatatgtatgagagaatctttacattttgtacacattattctaaaattccttttagtccttaaacaactctcagggggaaaatagtacagaattaaaataaaagttcttaacatttgtccctgaatatatttttagaaaaagtatacttgaaatctgatcacctataaggaaagatttatcaggagagtttaaatttttatatttactcatattaaatgcatgtgtgttttgagaccaaggttttttgtttgttttaatattttggggagacatacttccttcaaatatataggttagaggtagggggtagggatggttagtggtataaaaaaaaacagaaagaatgaataagacatactgtttgatagtacagcaaggtgactgtagtcaacaatgacttaattgtatattttaaaaaactacaagagtgtaattgggttagggtttgtaacacaaagaataaatgcttgaggggagggataccccattctccatgatgtgattattttacattgcatatgcccgtatcaaaacatctcatgtactccacaaacatatacactatgtacccccaaaaacttaaagaatatataagtttaaattagaattcccccaaattctagtagtagaatatattcttttaaaattctagtagaatttgggagaattctaatttaaaccaattctggtgttcctgagttatgtgagctcctccaagttccactgttttgtcattgccaactcagggagtcaaatatgtacttatttagcattttctgagccaggtactggctctgagaggtacatactttcatttaattcttcaagagaattaaaagcaaacggagcccatatgttatagacaaggaaactgaggttctgagatgttgagtagcttactcaaggttgacctgagactctaaattaggttcatcctccttgaagacacctatattccttttgttctcataaaatagcacatccagccagcattccatcccagatattggcactaaggagaggcgtgggaaagggcatggacactttctgttaggtacatgggggacgttgtgctctagcttatacatgactgtaaaggcgcaaatgaaaactcttcctttattagtacattttcttttgcatggttatctgggatgagtatgtggtgaggtggggctgtgggaggaagctgctgcaattagttttgcctcaggtagaatgctgacatcagttgtaatgagattaaaatcttctactcagctgttgcttgaaatattctattgtgttctcatccaactattttaactaattgaagtgacttaaccatataattattttcaaatgtttacaattacttttagataaatataaatgaatgtttgcctgcatatgaacaacaaaaggaataatctggtaccttcacccaaatagtcaaaccctctaagatattggtagaaacatcagagtgtatcagtgaaggtcaaaggacacaaataggcatttttaaatactaaaatgaaatattactttcagttccaccaaaatggagtagcctcattccttccgggttctctcccttataactaaaaatttctagatacagtgctacgaagatggcaaggaagtctctcaaagatcaaaagaagagggtgaactgctaggaatttttggaacttgaactacaaagcagtgagttccttgaatttttgtgttatctgtcatatatcctgagctaggtgctacagaagcctccaaactgccagaactgccagaaagtacagataaagaagctccaagaaagtcttgttttctttaggcaaaggaccaggtgaagggtggctttacaccagaaaatttttggcagtatctgccaaacaccactggaaaactcacatcttactccctccatgatttcagtggtgctaaacagaatttgatcccgtcattcccatacattgatactgttagacttgatgagttacatgggtatattgttattttctagagcagctgctaggaaaactatccaaagcaatatacttttgaaaagataaagaaatcaagatagaaatttttaatatgatcaagtcacccaaaggaaagtaagagaaacagaggaaacaaagagaaaacaagtaataaaatgacagtcttaagccctagtatgttaataaacccaattttattactttaaatttaaatgatctatggaaatgcaagggacccaggatagtttaaacagttttgaaatgaaagaaccaagtttgaatacttagattttctgattttaaaactgtaaaactatggtaatgaagacaacatggggctggcctaaggataaacagatagattgatggaatagaattaagagtccagaaataaagccttccattgatgtccaattgatttgcaaccagagtgccaagacaattcaatgggagaaagaatagtgtttttgacaaatggtactgggttaactggatatccacatgcaaaagaatgaagttagatcccttccttacaccatatataaaaattaactccgaatggatcatagatctaagtggaagaactaaagctataaaactctcagaagaaagcataggtgtaaaattcatgaccttgcgcaatgaattcttagatatgataccaaaagtacaagcactgacaacaaaaagaaagatacatacactggactttatctaaattgaaacttttgtgtttcaaatcacaccacaaagaaagtaaaatacaggtcacaaaatgggagaaaatatttgtaaagcatacatctgataagaaacttgtatccaaaatacataaagtactcatatacctcattaattaaaagacagataacacaattttggattaggcaagggttctgaatagatatttctccatataagttattcaaattgctaataagcacatgaaaagatgctgaacatcattagctctcagggaaatgtaaatcaaaaccacaatgagaagccactttcattcagtaggatagctattaccaaaaaagacagataataagaattgttgaccaagataaggagaaattagaacacttacccattgctggtgggattgtaagatggtgcagtcactgtgaaaaatggtatagcagttcatcaaattgttaaacatagaattactatattagctggcaattctactcataggtatatacccaagagattaaaaaaatttacataaaaacttgcacattaattttcataccagtgttattcataatagccccaaaatggaacaacttaaatgtccatcatctcatgaatggataaacaaaatatatccataaaatggaaaattgttcatgcttaaaaaggaatcaagtactgatacaagacaaatgaactttggaaaacttacgctgaatgaaaaaaaagctagtcataaaagactacatattgtatgattccatttatatgaaatgtctagaataggcaaatctgtagaggccgtaagcagattactgattgttgggggaaatagggagtgaatacaaatggcatgagtttctttggcggatgaagaaaatgttcagaaattgattgtggtgatggttgaaagagtctatgaacatacaaaaaccatttaatcgtgtatttttaaagggcctggtatgtgaatcaataaagctaaaaatgtaaatggtctaaataaactaattaaaagacagattttgacataatagataaaaaacatgacccaaccatatgctgtctataaaaaatttgcttcaaatacaacaatataggtaggtagaaagtaaaagcatggaaaaatatataccatgtaaacatgaatttaagaaaaaaattgttatattcttaccgataaacttcagaggagagaaacattattagagctaaagagagacattgtataattataaaaagaacaatttatcaggaaaacataactattgcaaatgtgtgcacatcaaataatagtgcctggaaatatgtgaagcaaaatgaaacattacatctaaattttcttaaattctttaaaccttactccacgtataatagtctttaattatggcataaactaaaagatttatgtctatactaagtttcattcctgaaagagctgcttctgtctttttatcctcaaaatacaatactgtattaggtattgaagtgtttgtgtatgtgtatgtgtgtatttataccatatagacaaggtctatgattctgtaatcatagaacttacagtgatgtgatccttttcaagcttcatattataacacacacacagacacaaagattcacaaatgtactgaatcgatttaattccatgagttgtaacgttcttgataccatatttgttctaaagcagcatttcttagtaattaaaatgaatgagaagatctctacctaaagagatagtatgaactttaaaagcagaagcagagttcagtatttatatttggtagcaataaactacctgttagaaatatttatcaagtgaagatataattgcctgctttgtctgtgaacctcataagtacaaaaattgtgttctttgaatttacactttttaagggatgtatgttaaacattttagcagtgtatttttttaaattaaaatatatgaatttaatttacacaaataatttattttacataaaaacattctagctagcatctagcagttttaataccttatacattttaatcatatctgctagaacaagtaatctctagagtggtcagctatggaagaggataaagttagtagacctactaactttatagctcatatatattttggttatatactcgaattcctattactcgatgcttcaagcattatcttttaacctctgtatacaaaattagaatgtcagcacgtttacacttttctacttgttctccctctactttctgtttttataacttactgatactaaaatgttcaaagcttatagtatttttatgttctgtaactataattctcacacttttttctttagttatatacataaatcattttagggctgacctccaaatttttacaatagactctccattctataagttgactggaataatttctaacaacatgaatcatgcatgacttgtacataccctttgggaaataccaggattctcagaggttttacttgtgtcattaaatggagactgtaatggctgctaccatttctcttctctgtctctccggtgtgaaacagggctcaggggtacacataaggctgcaatctggtcctttttcttttctctatctattcacatttctctttgttttgacctcctgaatgtgaaaatgtttaatagcatgtatatttacatatttaagtattcaagctctactgcttagttcttaatagtatcttacctgtgcattttcaccagccaaagattttgagaggacaaaagaggggacaagaacttgctatccgttttaaagaattttctatagagaccttttaaaagtaagatgattaggatttcattaaaaagaattttaaatatgttaaaagcatgagtttttgcagctgctaggcagaaagacttgcttgctaaccacactttgtttcttgggaatgaatgactgtacttaatgtacacacacacacacacacacacacacacacaggtgcacgcatgtgtgtatacatgcccggatatacaggaactaaagataggataaaaaactgacctctagaatattcagatacagacatcattctgtggctgcctcaccaaatcatatgtggttggatataagaaagtacagcctatttctgggatttacagagataagaaaagggaaaaataggaaattttaaaatgtcacaactcattttattaatgattattactcagctttattattttagatagtaatgcatttcatgtttgaatatcacaaagaaaacttttctgaagtgattttcttgagaatattgttatacatgttttctgcatcctcccataggtctatgaacataagagtttatcatattttacctatcctgttaccactacctgtggacagtgttaattgatttctaggaaatgccgacacttattttagcactaatttcacagagtcatttatttccaaggtttatataacagtaaataaactaataaaatatattgaattttaatttgcctttttacctcttaatttctctcttatgaatagactttagaatttgaccttattaatatactaggaaactcagaaattagtttcatgaaataatgtttgatttattttcattcatttgataggacaggagctttaacagatggactgtcagatccaaataaagttttattgctttattgttatgtgcaataattaagatattgttcagatagattgacacctagactctgggagacttatggtgtggtggtgtctagatagaggtatatggagaattcgtaatactgcatgtgtaccaaagaacacctgtattgttataatttgtatgtaaattgtatatgaacaattgtttataatctaaagtaatattatttagaagcattttattacatttatttttagatttgtaacctgattagaagactaactttttcaaatttttctttttaaatgtcttgatttttgagaaattttagttcactcttaagttcccttaagattatggagtagaaaccactgtaagcttaggaaaatattttgaaataatttgtgaaatacctttttgtatcccaataatttctattgtcatgagcttttgaatgttaacaaaatgattttcatctctatgttaggtttaggtgcagggtatacaaatgttatatttttattttcagtacagtacaggattctacaggggttttcattgttcatttggggggtaaactttttatttccttttctaatagctaagaggtataaattttgatggtattattatctcagtttacatatgtttcacttgtaaatattgcattcatgaagaagaaacaccacaacaatttaaacacataaaatacttcatgtgagttacttgaaaatgacaaatcgaaatctgtcacgtaataggaaaactatgctttgaagcataatctctagtgctgcctcttctctattacagcttaaactgtactctgcatgtcatacataaagaatgaactttgcagtcagttaaaaaagctgaaacaattggtatgagaaacataccaagaaaatattctaatcataattccaagttgaggtcaaaaaaataaataaaccagaatatgagccataatctttttattttttttaactttaatagtccttagcaataatcaacaatttactgattcaacaggagacatgttactctactgccatctggttattctaaatagaacctatccctctggacgagcaaaaggcgtaatgattggatagacgttttggcagaaaaaagacttttttaatgtcttgggatttgggaggtaaaaccaatggccataattttgaaacatctgctcttttcatgatctcgtctacatggaaagagatttggaaacagaacatcctcaagcattatttttttgcagtgataaaaaaatttcattttgtctaaatatgtaagtagagtcaaattcacttcttagtaaaacctattataccattatataaacatgtagcttgcttcttcttttgaattcaacattatcttaagttggtatatttattgtttatacatctacctacaaccaaaaaggtgaggagttttacacaaaaagagtatagatataatttttaaaaattgttaagtaacacttgacagcaaaaggatgattgcacccacaacacatttgtcagggatagcaactgtagttggcaacaaaaatgaggcctatatgctccaaccctgggtcatctttctactgtttgaaattggtatccaactatctattggatgaatgtccttcttatggaaataagaagtgagattttcagtcaatcaccctagaccctaaattggttaaatttaaaaatgaatgggcctgctctcctccttcttgctgggtctcttggcttcctgggttgtttccatcctttctcattctttctttcccctcagagtcagggactctagaggaaaacctttctctggatttgttgcctgtcgtgttcttgccagtcctcttctggggatatgctagattctggttttgtgctcttttgccttgcttagtatgaacttatggaaatttggtctggtctgagctttctgagccctgtgtctgccccattcctcctggatctgatttaccttctatctcagcattggcataaaatgagtcaggacctgcagtcacacctttacttgggctagattagactgtagaccttaccattgcaggagtagggtggaattgacctcaattctgccctcacattccagccctcctaattgattttccaccagcatcttccccaggttgttccctcctcctctgcctgtatgactgactggcagcatgaagctagggtacgttagtccctggtagggggcaaagttcttgcacaagtttccaggaagccaagtccaaaagaaaaaaagacacaagagtatggtaatatgcaggggagaaagaacgtctccaaaagggaatggaatttatttttagatctagaaaaatgtcttcattattttaataagtaaaatatttaaacgttagcagttataagcaccactacatatctattagagtggctaagattgaaatatgctgacagtaccaaagtctggtgagagtgcagagaaactggacatcaaggagtttggcagttactctttttaaaaagaaaaaaaattagttaaactttttattttgagataattgttggttcatatgcagttgtaaggaacaatgagatcccatttatgcttgactcagtttcccccaatggtaacattttctgaattacagttcaatatcaattctataatttctatttggttctttttttataagttctatttcttttcaaataaattctagtttttcatttgtaaagctatatagtgcagtatcactgccaggttattaacattgacagtcaagctatgcaatcctatcaaattaccaacatcgtttttcccagaattagaaaaaacaatcctaaaattcatgtggaatcaaaaaagaacctgaatagtgaaagcaatcgtaagcaaaaaggataaagctggtggtgttacattacttgacttctaactatactacaaggtatagtacccaaaacagcatggtactggtataaaactagacacagatcaatggaacagaaagagaacccaaaaataaggctacatacctacaagtacctgatatttgataaagtcaacacagatatacactggggaatgaacatcttattcaataaatggtgctgggagaattggagaaccgtatgcagaagaatgaaactggacccctatcttgtactgtatataaaaattaactaaatatggaccaaagacttaaatgtaagaccaaaaccaataaaagtcccagaagaaaacctaggaaaaactctattggatattgtcctaagcatagacaaagagtttatgactaagtcctcagaaaaacaacaaaaacgaaaatagaaaaattagacttaattaaatgcaaaagcttctgcacagctaaagaaataattaacagagtaaaaagacaacatatagaatgggagaaaatatttgcaaacaatgcatctggacaaaggtctaatatccagaatctacaaagaactcaaataactcaacaagaaaaaaacaaataactctgttaaaaagtgggcaaaggacatgaacagacatatttcaaaagaagacatacaagcacccaacaaacatgaaaaaatgctcaacatcactaatcatcagggaaatgcaaattaaagccacaataccatttcacaacagtcagaatagctattaaaaagtcaaaagcaatacatgttggcaaggatgtagagaaaagaaaattcttatacactgtcggtgggaaggtaaattgtgcaacctctttagaaaactgtggagatttctcaaagaactaaaaatagaactatcatactatccatgtatcctacttctgggtatgtatccaaaggaaaataaatcattatatcaaaaagacccctgtgttcatatgcttattgcagcaccattcacaaaagcagagtcatggaatcaacctaaatgttgatcgaggaatgactggataaaaatatggcatatatataccatggaatactactctgccataaaaaagaatgaaatcatgtcttttgcagcaacatggatagaacaggagaccattatcctaactgaaatgactcagaaacagaaagtcaaaaaccacatgttctcacttacaggtgagagctaaacaatggacatacatggacatgcagagtggaataatagacattgtggactccaaatggtgggaagatgggaaggtgagaaggggccaagggataaaatactacctattgggtacaatgtgcactatttgggtgataggtacaacaaaagcccaggctttaccactacaccctatatccatgtaacacaactgaacttatactcctgaatctataaaaatgtaaaaaaaaaaatttttttttaaaacgtaacactttcatcaccacaaggattcctcttgttttccttttgtagccacattcatttccctcccacccctccctctctttaaaccttttgtcatttcaagaatgttatataaatagaaggatataatgtaaacctttgggattggcttttttcccctcagcatgaatctcggaaaattcctctagattgttgcatgtttcaatagttggttcttacaagtcctaaactattctaaaatcaaaatttgtcaacaataatatttttaaacagtgctaacgtaacaatgttattaaagttcttaaaaaatgttgaaattttcttctacataaaaagttaaacattttatatggtgtgttgattattctccatttactctcctcctactctaagtccccctgcctttctctggcttgctgcatgacccaaggggcttacttttatgcagtgtatcatctgggcccctcctcttccacatatccggctcaacagagtttagttccttcctttctttttacccctaagacctagaggttgagacagcattttcttattgttggaagatttgttgatgcctttaatcttcctgcatctttggacatggctcctttatttaattcctttcactcaaagttaaaagcctttgagtgtactatctgtttcctgccaggaccctgatacatttaacaaaaaatagataaattggatgacaaatgatatactgggcaaatatttgtaactcgtgtgataaatataggtttattttccataatatacaaagagttcctacaaaaggaaaataaaaaaccaaatgaccaaaagaaaaatgggcaaagggcatgaacaagcatgttacagaagacaaattccaaatggtcaataaacgtgaaaatatgcttctgcattagtattcagagaaattcgtatttctgtagtcctagctactgggaaggctgagtcaggaggatcacttgagcccaggagttctaggcttctgtgtgttatgatcatgcttataaatagccaatgcactccagcttggcagcataacaggtccccacctcaaaaaaaaaattaggattgctgagtcaaaagttatgtgtttgtctttttaactgattatgtgagattgctttaaaaagacattgcaacaatttacactaaagcaacaagatacatttttcaaccgtaagatgggtcagattcccctttaggactgaagcactctcccttctgctgagagtttggtcaggcaataattttcagctgattccttctccaagaattttcctcagagacagctgccttgcctaagattatggcctctccctgaggatggcctgccagcaattactcatgatgtaacatacgaaagtccaactgccttgcctgtaggttggaaaactctaaagggctattttccagggaacccaaaccacagcacagcattaacacttaccatgtgtaatccttaggaacataggaattctaatagtataaattgttgcaatgtctttttaaagcaatctcacataatcagttaaaaagacaaacacataaattttgactcagcgattctaatttttttttttgaggtggggtcctgttattttgcccaagctggagtgcagtgactatttataagcatgatcattgcacacagaagcctggaactcctgggctccagtgatccttttgcctcagactccctagtagctaggactacaggtgtgtgccaccacacctggctttagcaatcctaattgtcagaatatttgagaattaaaaattagaaagcattagtacataaatatatatatgtataaatgatgtgcactgctattttatttgttggaataactgaaaaaggcttaaatatccatcaatagatgaatgatctaccaatagaggatattgtatgttgggatattttgatagtattaaaaagaatgagctagatccatatttaatgggatgtggaggatgtccaaatgtcaatgatacagtgttgtataaaaataaaagaagaaaaacaagttatagatttatgttggcttgtgtgcatgcgtgtgccctgctatagcttattaaaggtcaacagatctcagtgactgttagaatgacgtgttttattgggctcactcttcagccagaacatgctagcatggctatacttgttatttatggtgatgaccattttgattggctgggtattttttctaattaggcagtgcctgtgctgtccttgttgttaattattttgatggttggctcctcctttaaagtgtattgtcagctgactgacaatttttgaaagcctgtttatgtagttggcttcagaagcagcaaggattcaataaaccacttttatattcagattatgccagatatttggatggaaaagggagtattcattccagatattatatctgtataacaaatataaacaagttagaattataatcaaaacttctaattctatctgttaagctctttgtagacactccctcttcattatgaataacataggtaaggagagagaaattatgcattatatagttaaacactggcaaaacattatttctcattctcctactattggcttctgggttaccagagcacatacttaggactgccaaattctgaagtttagaaaacactgtcataaggcataatgtatccattagaaatgcattaggaaaagagagaagtaacattttattagggcttttagctagttggtggagtaataagcatacttttgtgttacctttatatgatttatattacttttcttctagagaaaacagtggaatcaaagagtattttgatcagttttataaagaaatagatgactacttaagaaataaatatattcaggttagagtttgctcatttgtatttgatatgatctgacactgcagaaggccaaaggatctcattattgcccgggtctttacaagaaaggttccccaatgcatgacatggcaatttgtcgcctttatttagagggatttagacaaagcttgcagcatttagcattccgttcctttgacagtaccttttaacatccttcttattgttctatttgtgggtcaatgcaaagcattcatgaagattttgtggtttagggagcaagtgaggctgttgtctaatttgttgtaattgctcaacttactcaaatagtttaatttacctctgaatatgttcagcagcttagaagaaaggtgtttgttcaaacatgaaatctttataattagaaaaaaattattatatgggtttgtgttatgtaaaccttagtgaactttctcccaatctaatttaattaatctttaaataacattggtttagttcttttggcataggggcaaggaaatattatgctttgaaaatgtaggcttttctgagaagtaacatacatttttctacgtgagcgactttttccttaaatctctttctaaacagtcatttcaacttctgcctgagggaatggattagctgtatcattcctcactctcagattaaccccctccctgcaaactgctacagccccagtcagcattaaggttaccaaaccatgagggaggacacaaaatgttctttctctttccaactcaatctatctttgaagtgccaaggagagatattctggcagtacgtaaatctgaaattctgttttgcttcaaaaaaacaaaaatgaaattctcactcagccatgattctcttacaaccggcaatctttttctgtcctttgtctacctcagtgtcttggaggtgtctcattagtgggctggtatttctgacagaatgctttttaagagttacatttctagctaaatctatgctgcatttttagagacaaaatagcatacagggaaaatgaaaaataacaccagagtcttgaataatatcgttagctcaccttccatcagttaattgtatttcttctcttaaaaaaaactattaaaacttcaatttcacattatattgctttcacaaatacattggctaatagtatagatattgagccattactgaaaatgaatttttgtgggtagaatttgcaaccaggaagaatattaaaaaactgaatactttgtattcctgtgtgcctattcagtatcctccacaacccagcatcattctttggtgaagaaattgtttactatacttgggttagcaacatttaggtccccccaccttttttttttctctttcaatttttagggatgctgaaattaggtgtgagtgttgataatgactgtttctgcctctgcttatataatcaaagtaaaatggagttaggttaagttattttagagggagcttactatcttctgtgtggccaaatttatccaggagcttaaactttagatactttgggtcccgggactagcatagactgtgaagcgtagagctgtgaaagaatttggatcctaagggaaaaaagtttggaaaccaaccatagaaaatgcaagtgcaaaccacaaagaatagttaaaatgaaaaaaaaggggcagtgtaaagcatgggaggaactgagattcttttcctctgctgttggaagttctaccacatcagaaacatatttggtaatagaactaaagctaaatatatagctatcctctaactagcaattccatttctaagtctataaccaacagaaatgaatctatatgttcatcaacatgtgcaagaatgtgcatagctgcacttagtaatagtcccaaagtggaaacaacagtacaatagatgcattaattgtggtacactattacaaaaaatacagaaaaaaggatgagacaactgtacgtatatacaacggcatggattaatttcacaagctcaatgttgagtgaaagaaaccactggataccagtaagaacattctattgttcaatttgtgtaaacttcaaaagcaggttaaactgatctgtggtgttgtaagttaggatggtggttagcattattgttggagggtgagtagtaatgacaagaagaggaccttcttgagtgctggtggtctgtttcttgatctaggtgttggttacctgagtatgttcactttatgatttgtacaatttgctgtgtgtgtgtttactccaataagaaagattaaaaagaaagaaggaagaaaaatcagctatagaaatgaagaggattggcagtgtaaaagtgtcatttttttttccccatggtaaaagattaagaaagagatacatgattaaagccaatgaaaatttgggagtcaaagttttaaactctcttagcagccaaactaattgtttgaataaaatgcatgctagttatcacagtgtttcaaactttcctgatccttagaacactaaggaagatagtctcaaaaatatttactccctggtccttctgtgggagatttcagtttagtctgtttaagatggggctaggaatctttattttaaaaacacaacttagacaagaattagaataatggtcagttcaaaagagggaaacagaattatgtgatttttttttacagcagccaagaatgatgtagcctggtttattcctacttctccttcatctaccccaatcctcccacgtatctccaattccaatttgagcagtgattctgaaactttactttaagcacttgttaagaatgcagatatcttggccttactccaaggattttgaattggtaagtctgaggagaggcccaaatagggctatgcatttttcataagtaccttcgaagatgctcagattcagaagcagttggtctcagatgtacaccttgagaaagtcaggcctggagaaaaagaatgtactagacaaacagatatatttggcttagtttttttcctttcatgactgggctggttatctagcactggttatatttaagtccctaataaattttaaggtcataggagatgaggagtgtatcttatatccttcttaggagcaatttcacagcacctgtaattgtactgcttagccagtaggtatttttgaaagtcatgaagtccagatgattaaagttatttttagttttattataatcatggttggaaattaacctggaaagcactgagtttccctgtgtgtatatatatcacttgtaattaaaaagtaatctatttccccagtcattaaatgtttattgagtatctattatgtactggttttctgaaatatcattttgtccctgtcatttcatggtctctagttggagcatgcgtagcaaagaaaattcatgttccaaaatggcacaaggagggtcttaagcatttttaatattccacttatcagaattggaatatagataagtatttgcctgctcccagttctttgataggcattctattaaaatcaaaggcaaatgaattgtcagaaatagatttagcttacaatatagatccactagtccttgcaagttggagtcacgggctagttctacaattaagaaagaccaattattcaatctcttagaaacttagcttacctaataccttgtctttatgtattatgtaattgtttttattctaggagaaggtactttattagttcaagactgcccagatatacagtaatgaaaaagaagaaaaaggctatcatcactctaataaaatgattagttatgttcggtttggaagtgtttgctcaatatattttgtcatagacagcataggatcccagacctcttgacatttctttgccacctagattttatagtcctgctggtacgtgcaagcaccttaaagaagaggctaatactggggaacactaaggtatatatatttattatatcatctctatttttaaagtataggccaatcatatatggatttctctgtaaaatgaaatagtatgagagtatcatagagatcagttggtgttcatttttgaagaatcttgacattgaatttaaatatttacagcctggagcaattaggattctcaaatattgctgatgagaaagtaaattagtgtaaccactttggaaaactgacattagctactaaagctgaacatatacctatacctaccctatgaacagcagtgttactcctaggtgtatactcaagaaaaatatgtgaaatattcagcagaagactgcataagaatctcgatggcagcaagtactctaatctcaaccaatagtagaaaagataaataaattgaatgaaaatgaatagtctctaactacacttaatatggatgaatctcacagacataatattgagaaaatgaagttagatgttaaaaagtatattctttgtgattctgttattcaaaaatagacaaaactaatctcaggatagtggttaccattgggggtttgtattgtgactggaagttggcatgaggaaggattttgggggaatagtgattttctgggttttgatgctggttagaatggtgtgttcagcacatgaaaattcactgggctgtgtacttatgatcagtgctaatatataatactccaataaaatatttaaagatattttaacatattaaatattaaatattaaagatattttaataatataaaatatataaagatatgaattggaatcagtttccagtgtttatcagttaggcttgtttacatgcacctacttgagaatttgccagcctcagagaaaagtagagaatagtctaagtataaacaatatcatttagatgtcatgaaatagccttttttttcccttttgcatagtgtttagtgtgtgatatgaaggtgttgtagccaggtggaataacatcaggatttggtatcattagatcatatttgagttctagctctctccttaaaacactgtgaggtcttgggcccagtcacttaattttctgatttgaaaactgagtatagtaatacctaagactttataggtctatggaattatgtattattttatataatgtttgtttactagaatgcaaatctcatgggggcagtgatttctgtctgtttcattgattgtggtatgccaagttcctggatctgtgtctggcaagtaatcagcacttactatatatttaagtgaataaattactaaaacaaaaatatagaaagaactaaaatagaaaataaagtatctacgtacattttagctgctgctcttttaaactttattaaaagtcactggaaacctgagacttgttgagtttaaaatattatggataaagggtaggattaggccttagagaaaagatattattttttttttcagatatacttgtcaaaatggatgtttctttattcaggtgttccttctaggatgatagaatcctgggtcctagagagaatacttagtgctatactgccatctttttgaaagtattccatacctcacaacagagtagactgttgaaaaagtcacaaaacaactgtacttactgaaaaattagatctttacaccatatatccaaaaaatgtatagctgctggttaaacccatccaaagtccagctttgccttagttcactggtaggagccaagctaggacgggttccagaagaagagttccaaagtccagaggaatggcttgttccagttatgggatcccttatatcgaggctcagctgtgacttatctccctgaaaaggtagcaccaccttcttcagggttgactttttgagcacatgaagtagtagccttaaccacgtggagctgatcttccaagagggcctgatgctttcaaggtcccataaggcatagagataatcaagaacgacactgctgcctgtgagacagtgccgtttctccatggtggtcaggtgccaggtctgtgagcaggagacattcctgaggctgttttccctgtaccagctcaggctctgtatcttctttctgctctcgttgctccttgggctcagacctctgctacttgcctggacttccacttgaatttttccatcgtcttgaattgactcattcagagtgttacccagtcttgttctattgaaccttactctctcagctgcatctcaaatcaaaccatagcatttaccctgccattcattcattcattcattcattcatctaatatatgctaaggtctgtagggataattggcaataaatataagcagttatctgaggctctttgtcctggctgcagtgcctcctgcttaagtcctgcagagcccataacagtctaggtttttctgatgctcttttcacttgccccctagtattctggctaaggcacattaatgatgtacacaaaactgttttctcagtctcttgcattttgggagtgattgaaaaattacatatataaattataaaatatattattatgaaatatattataaaacatatgcaaaaacatacaaaatataatatatcacattttataaatattcacggccgggcgcggtggctcacgcctgtaatcccagcactttgggaggccggggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactctgtctcaaaaaaaaaaaaaaaaaaaaaaaaatattcacaaagtttttggtctctgcacccctttccacttttaaaaatgatagaaaactgcaaagagttttgtttattgtattatatatagcaatatttaccaaattggaaattaaactgataaaatttaaaatatttatttactaattaccttaatataataaacccattatattagtataaataacttatttttaatgaaaaataactgtgttttcccaatgaaaaaatttagtacaaagggtggcatcattttacagttttgcaaaacactttaatgtctggcttaataaaagacagttggattcttatatctgtttccatatttaatttgttgtgctatcacacatcccgtaacctctggaaaacaccactgtacactcttgagatatgaggatgaaaaagttaaatgatgtcttagtatttatatgaaaatggctttgacttgtgggctccctgaaatagtgtcaggaatgcccaggggtccctggaccacatgttagaaatgatgccagaaactcacaattttatttattccttgttacactgcattcgatcaattgaattttagtgagtattcattcaaagaatcttagtagtcctccttctaataagaaaatagtttattaatgttggcatatgtacattttataaataaaattttaatattcattattaatgtaggaaaaaattatagtgccctgttacttagagctttatttggatgaaggatgtattaaatgtaattttaaaaagaaaatgttctacacaggtcaatgacctttataataaacacattttattgcttaaatttagtgcagtaagattaccaagacaaatatttatctttctgtcgaacaatactaataatgctgcaattaattatagaacttatttgaagagagttgcatttatattaaaatacctgcctatatcatgggcacctaaatatatagttgtcttcattatcacattggagagcctaggttcctcatgttttgtaaaataatgattttttcacaggcacacgatcttttagatagcatgcatcaggaagaggtaccagcatgctagtttcttatttaagattccccagccccacgactggtatttatgaaagagaagaaaggatgtcattacttgttcctcaagatgacacagagaggtttatgctgcttgagcagaggcttcagaatgtgaagactcaggcccaggttttgatgtgatttgatggccagtagcaacagagctgccactcttcatggatgattaaagacaaagagagtgagatggcatgaaccacaaagccctgctgccacctgacagatttttcctccgattcaaggaagcccttatgagagcccctttatgtgagcctggttcccttgccagtctatttcaaatttttttaatctctgctactggattgaaagtgtaactgccactttcaatatgcttcagaactgctaatggcaaagttgcttttgggaaccagttgattaatttagacaatgcaaaatatggaggtcccaagtcaagaataagctaaacgactttgccttatttggatataattaaaaggcatggatccaacgtaaatgtgtcacttcccagtgacatctgcactttctgtttgcaaacactgttatataagggctctcagaggtcaagagtgcagaggccacccccttttaaaacttctggtatattataaaaatggagaaatgaaaaagcagtgttaaaaaggaattttattttcagggcttatattggaagaaataatgctttaaacacaaattataatgcaatagaacttgggtattctcaaagtaattacaggatttatttgaacctatctttagtaaagtttgttactcaaactttataaatatacctaatagtagtcatgagtttgaattgtatggtaaataccatgttcttttgatctagtcagaatattccagttatttgagtgaatagcctcatttggagataaatcttaaacttgagtttctttctgggtgtaattctgaaatgatagggtcttctgcttcatcttaaaggagtgacatcacttcatccaaaagcagatactatttaaggtgatggttttaaatctaaggccactggatggccaaatcattgaggatataatattaaaacaaagagagattttaaaattctaaaatgctatatgtgagtatcttataaatgaaatccagaaatatgccaacagttttttcataatatgctcaaccttgagaaaaaccctgtttaatatctaaacatacgtatcaataaataattttacattaagaattactttcctcttgtaaagcgtatatttcaaaaccataattattttaagacctaaaagggattataataacttttcatctaagctttataattgtggttttggaacttaggtaactttttggaactatataagagggactggatgtggtggctcacgcctgtgatcccagcgctttgaggggctgaggtgggagcgattgtttgaggctaggagtttgagaccagcctgggccacagagtgagaccctatctcaaaaaaataaaataaaaaattagccaggcatggtggtgtgtgtctgtagtcccagctactcaggaggctgagggaggacgatcacttgagcccagaaattcaaggttacagtaagctatgatggcaccactacactccagcctgggcgacagagcaagatcatttcttaaaaagaaaaggaaagagaagagaagagaagagaagagaagagaagagaagagaaaacaactatgtaagaaatatctgcttcaagttagaattcagaaaaaattcatgaaactagaaagaaaagtagaagaaatggatatcaattccctcaatgtaagatgaagacacttaggctaaatgactgaattgattcctccatcaagcttcttatagagctagatccagaacccaggatttctgaagtacaacctgttgttctttctagtctatgacttgccaccttcttacaattttacatagtcaggaaatggtatggaactttaaaggctcttccaagaggaaagagaattgtttgtatttaaaaatatatataatatatattatattttatattacacatatatcaatggcaggttttcttttcacaaattgagaaaaaatttagttcatgttcaaatacaacataaaaataataaatataagctattttaaatgcctttatttttatctattttttgatattacagtagtcaggtacaaggaagtttattattacaggcgatatactttcagtgaagagaaaattgtgtgtatgctttattttgtatattgtaggcagggatttttagtgtttcatttaagggagggattgataatccaggtatttttgactgcctctcagatattctttgttaaatgtcatttatttctttaagaatcctgttcagtcaaatatttacttgctttttaacaaataataactcagggcccttcattcctccttttacattattatagagtagaatttcaacaacagtgaacctaattacataagtctttgtttttatcaaagtttttagtgttttgtcagccaaaactctaaaatattacaaccaaatatcagatggatttagttacaagcagttagatttattttttaagtgtgaatgtattacttctgaataaaggaaagagctgatatcggggaaggtaaattcaccgaaacctaaggcagataattcactgtagatggataataatttacttttctatagctttgctattttacagggaggagcgtgtgactctggtttatgtgacttttcagctgtttcttctaagaattccttttttcttctctaaatcttcttaagcttaaatgttcttcccatgtttcttggaagtacttgcaaattttatggaatgcacttctttaaagctgctgctagctaaaagtcctaacccctacattttaccatttcattctattttaattcaggtatttgcccatattaaaaaacataacacattcatttttttttctgggaagcaactgtatccaattctttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaactgtatccaattcttaatacacactctttgacaagtgcaaatgacattttataatcagattgaaaataaatgtttaatacttgctttgtgtgcttttgagggaaaaaccgtttcgatatttgagtaatacattttttgttgattatcacattttgttcttaatagaaagttggtttttcttataaagatgtaatttgattctattaactttgtctttttaaataagttatattttaaaaacttgaaggaaaagcccatttttatgtattgcaatcattttgtatttcaaaatctactttgcatatctttgtatacttgaattaatataaaagcttgataaagagatgagaattaatacactcaacctgtgaggaataaagtagttgtattgttgatttaagcttgttgaatgtgatatctcaggatgctaaagaggcagaccagcaggtttcaggtgattaaagaaagtccctcatcttggaggaacttgaaggaacatgttgctatttaagtggaatctaatcagtaagaagaaaagcttggatgtaaaaagacggaatgtttcatgtcattatttacaaagcaactgaacaaaagcttagcaagataattaagtgccttgatgctaagtagaatttttcaaagcaggttgattagaggtcttcttcaagaaaaaaaaattaaacatctaagtacaaatagtctagttgaaaaggctaactcagttacatagatggagaccagtttgaaagaaaaatcacagtattgtatatggtggctgatgttcacagtgatgcttttaattgctgagcaaaatcccgatcatccctgggtagttatagcactaagagtattttactgtgttttaagtttttgaaaactgaaaatccgtacagacttaatatgcagtggcactgaatgtattattccattatcttggttactccatttttcaattggtctgaataaatagaatttgattctttttcccgttgcctgaaaaaaaaaaaatcaaaagtaaatattatcattctcaatataaaatgttatttgcaactgtcaagcaaaaattggatgtcatgtcttgtatctgcattttgtatttcaagacactcctggtgataacataaggagactggcatgcccaggattgtgctgtgtaaacaaatgctggcaaagccctggcttctcttaagcaggtggtcaggtcaaaacactgatggcagcattatagctaaaaatgaaaactaggaagtcgtgaccttaggacctacttttctaccaaagaaaggaagcttgaagttaacaagtttgtgccaaacacttcagtagacatatgttcttttttcagtgttcttttactgtgttaacattttaatgacctcaagtttacttagtaatgaatactttgggggcaaacatccagtagcagattgcttcatttattaccaatgaatttatttattcagtcagtcattgcagagctttatctctgaagaacacatttgaaaagctaaactgatcctctgctcacctggcagtccactgtgagaatataaaacgagtaactataataccaatctacctgtgggcagtttgcaaaggctgatgtcgtgagtgccatatatgagactctttttgaaatctaaaacaataacccagcccagacattttcagctaaagcatatgatctaaatgcttgaattaaaggaaaaacactttggattatagtccccattagtacttaaaacactcttggttttttcacttgtgctttgcttaagccaatgtgtctcaaccttagctgcatattagaattacctggagaactctaaaaaattctcatgttctagccacactccagaccaatcaaatcagaatctctgattgtagaacttgagcatctatattttgtaaatctctttacctgattccagcgtggagcgaaggttgacaaccactgatttaaccacttgcaatttcttcattcattgtattatttatttttcttggccttttaaaaaacacactgtagcatgacttccttaatttagaatcctgggatagagtttctattttaaaatatcccttttattggaattggactaaggagcattataaaaggccatcatttaggatttatattacttttacattatttaaatatataaaacttagtcactgtggtttgatttctgtggacactttgatggacagagtgcattttaatatgagcattagacatcttttatgctttatttcacattctcccagccgactcttcccatcatccattgctgttgcatcagctgaacagagatataacctgataactcctcaccttagctgtacctgaaactgtttcttcctcggaggtgtgttggctactgctcttgggagtcaggtagtccagtgcatccttatacctgattcagttcttggccaatatgggatgggagcaggtaggagcatgctcttctttctatgtctcaggcagacagttctgaagttattctacacatttcctgatagcatccccagtaagattaaacgtcagttgctcacgttagtcaccagcccaactatacacccttggattggctttcccccttcctgttttacatttacacttcctatcccattcaactctcattctagttttttgggaaccacttctctgaataaactatctgtgcacaagtcctcatctcaagctctgcttttttatttcatacaagctaagacagtatgaaagagaaaaatcatcataggcatgttttagtgcatgctcccttctctattgtgtttttaaaatcacgttatttttctacttaatacattcagtttatcatattatgataagggacactttactcacaaatctcgaatgctggaaaagagccctatccccatgttatctgttaccatgttatccccatgctttcgtctgctgcccttattatcctctgtgagttggttgccttaagatcctcctcctgatgtctcccagcagcgtgacctagattcttgatcagtgtccacaccgaacattcactccaaactgtgcagcaaacattttatagactcaagccacataataggtccataacatcagcataatattaaatggaatgggagagatttttgcagagagaaaaatggtgctaatgcagtgtgatacacttggtgtagtggaaaggcaagcactttacagttagggtcccagtgtagggtaattgtgtcttctgttgcccagaaaataaatacagttaaacatattaataaggaccacccagatatttttttcctccagcattgaaaccaattgccatttctttgttgagcatcagatgtttgaaacatatatatgtgaccattataatgacattgtttgccatgagatactcatataataagaggcacacaggaggaggcacagctcccaaatcacacttactctggggcatacacatcaagtgaaattgtggcaaaaatcctctgcactcttgatcttttctctccgtctgtcactttgtggctgagtgcatgtggttgagtgtgcagaagtactcatggatgatgcaactctcttgtctgagcgtatttccaggctcaggaactaaggacgtgtgactgtagcagatgactctcatgtcttgtgttggatttccttggcctctctctaacttgagaaacagctgcagtggacagttctgtgcaagctcagattcatctcaagctaacagcatttcatctccagcatgagcatgtcttttagcttcctgcccatggccttcttttatgttgctggagttcctaacccacagaccgttaggggccagaataatgaggatgttaatgcctcaaagaccaccatcaatcatcagggtccagaaccttgaataaactccccagcctctcatcatttaggtgggcaaccctgggaggcatctgtacttttctcagcaggtcccaatggattcaagccctagtttcccaaagaagtagcctcagtaatagatctgtatattggcctaatcttcttccctgtgtcattctcctcacaacttcagtctgcttcctgagatcatctcccaaataaacaactgatgtccaggttcttgcctcaggctctgatttcagaggaacactaatgaagagcgatgttaggtcagtaatgtaatctctctgagtcaatacttactcatctatgaaacaggaatattaagatctaccttagaaggttgttgaaaggattagatataatttatataatgcatttatccctatccatggtacatgactcactttaaacactgacaggtgtcttaagagatagacaaatataaatagaaacctaattctaacatgatttctatagagaagacgagaaagagacagagtgaacagacctgaggtgctacatgcatgaatacttgctactggtttccttttatcttcctgaggcagttaccataggcatgatcaatcctcctcagaaccagcctttgcccttgtgttacccggcatgagggtgccctactgttctgctcctccttcccctctctagcaaatgcctccaggaattagggatgcaatttcattttcttagttcactcaccttttaactatgcccattactattccattttattctaaccaatgaattatattctactttcattaagggctttcctatccaggaaactcaagtgggtccaaatttcccacaagcacctcatttacccagcagcgttttgtttagaaattagctcttctatacatagggcatgccgagataactgaagcttatttatttaagttatgcttactttagaaatacaaatattaaaatacaccaattttgtattaagctaaaatatagtaaatgtgggctgtgttttagttagggttgctataataaataccatcgactgggtagcttaaacaacaaacattaatttgtcacgattctggaggctgggtaacccaagatcaaggtgtgggccaattcagtttctggtgagggccctccccctagtttgcagatggccatcttctttttgtattcttgcatggcagagagaaaaagggctattcttcttcttcttataaagacatttcatcatgggggctccaatattatgactaaattacctcccaaaggccccacttccaaataccatcacatatagggcttcaacatttgaaatttggtggggggacacattcagtccacagcattgagtgacaaatctttaaaaattggtgcatctttttagccttcttttatataattcattgagcctaattaaaagtttttaaatttataatttagagttattatacctagcaatccagtgatacctagttgatgagaagttaaactagaaattattgtcagttctgtactagttacttattaaaggcttgttgaataaatcattgaatgatcgaatgaatgatgcatgattcttccctggggtttcttctaactctagaattgtatgattctatgattagcaaatcctttgggaacaaatcttctttcaacaaagttggtctaaggtcctccaggaaggtggaggtgccagtatccttagttgtggactgatgtaattacagctaaggatcatagtttagtttcttttgttggccttgctagagcagcccagttgtggctggggtaagggaacaatagctgagtcccgaagttgacatgctttagccagaatttttacataggcggaacagcgtaattggaaggggatctagcaagtttgtcttggagctgggcatacataaaaacatattgttttttacttagcacatgtgcttcttactggaggtgttaggatttatgaaaattatggagtgctaacatcttcctgatcacactgtgctaccaacataaccccatttccgaagagttaaaattaagccttttagaatcatatgtaaactatgagagtaggttcttactaagggtttctgaggatagcataagaggaatattcaggtgctttagtgcaatgacttgttttagatatagataattatataggtaatctttacagatgtataactatataatatataatgggatatattatatgtattttggctttacttcttcatttataagatatttattgtatatatttgctcaggtaactactgccaataatcaataagtgggacagatatggttttgtgacctcatgaagtgtacagaaaagattaaatatgtaaggtgttcctataccaaagatggaatcattttaaacctaccattgcaaagaaaaatagtttttaaacaaagctgtttttcaaatacaggatcttggtagattaaaagatttatgttgatattacaatattgttaaagaaaatgctgagttttaggtgagatattcaaggtgtgtagctttctatgtaatttccttaacttgaaccaactgttattaagaccttttgaggccaaccatttaaacaccactaggtaacacaaaaaacaatgatatctgtgacattgtatgtatcaaaaattaaatgttataaggacaaccagtgcactaagtaggatacacttgtgatggccttgtttgtgcttattttcttgttttgttttaattctttacattttggagaaaataggagaagattcatgggttggttaccaaaagggaaatgtgaattagtgaagtgagaaacaatatgtatattttcatcttgctaaataaatgtggtctcaagtcttgtgatgaagggcgatgagatactactaagtggctgtgtgtatgtgtgtgtgtgtatgtgtgtgtgtacaatatatctgttagctctaatgatgtgtttgcatattctttgaataaatgactcttttatattcttagaatgttctagataggttgatttaatcagtaacatctttccttaagtttcctaattctagggtgccatgtgaaaagatgcagaagaaaagttatgcttacacagatgacattcaggaatgaatactttctgctataacaataaaaaagtccagtactagtttcaatatcaaaagacgaagagaaatggttatttagaactctgtgcatagaataccaatctggctttctctgtagttaactgattctgaataaagatggtgatttgatcaaatttcaaacattttgaattcctcagaatacccttaattggcacagttttgttctttacaccctttgcttcactcttgctttacaaaagttagtgaataaatgaatgatccatttagtctcccaaagttttgatatactacttttgtcatatctagaatctcacatatattgaggtttattttagaggcttttgttctgtgtcactgtcctgggtccatatatcaactctggattcaaattattttagttactatagcctcataatatttggagaggctgataataccacattactcttctctttcagaaatttccaggattttgacataatatattttttttcagataaacgtagaaattatttcaagtttcaaaatgtattattttcttgtttagtgtattttataatttaatttagagaaactagattttttataatatcaggttttattattcactaacaacacaggttttctcatttctttgtgtctttttaatagcttttatagaactttaaaaattggctgcacacctttatatttgtttctaggtgattactggtgtctattgatattgtgattaaaatgtttgattcattagattttttaccttgatatatagaaatatcattaaatattgcatattcatgttctcataccttagctactttgaattctttttggttatacaattttttcagttaatattttttagttttcttgtgaactattatattgtctgcacttaattagagcttcgtctcattttcacaatttttcaatgaattaattattattgttatattggttagaattgagttgttttatatagcagcatatcactaaataggcattcttagttaagttcagacataaataaaaatgctttgacatttcgtcattaaaaaggtttaatctttttaagttccagggagaaatctttttcagattaagtagatttatttttatttctaggttatgcagaggagaaatgattgttttattaaaatgtataaacagaattattaatacatttatataacacatattaatatacacacattccttcaaatgatttaatttaaagaatttcattagtaaattttataatgttggactatccctgcatttaaaaaaaataaaccctacttgatcatgatacattaatcttttgatgtgttgctatatttttgcatgctgtttttaaaattaattttaaattgagatatagtttacatacaataaaattcacccttttagtatataattccatgaatgttgacaaatgaatacagtggtgttatcaatacccctttaagtgtgttgctttgatttgctaagatttatgattgtagcttctaattctgtaagggaaaaggaccatacttttctattttccaatgttatctgtctttttctggatctggtatcaggcttattttaactttataaaaggaattaagaagatttttatctatgtatatgtttaggaacagtaaataacgggatgatcatctgtttcttaatgattttatagaacctgcttcttcctaggagtaaatctttgaccatcctttcattttctcctcatggtttttccctctggtttttaaatcttcttgagctacttttgattatctctattttcctagaaaatcgttcatttaatttaaattttcagaattactggcaaaaagtttaacaattgtgtaccaatgtatgtttttatttacatttatcttgttctaatgacatctggttaagtgtattttcttctttaccttaataggtcttaaaaattgttttacctatatttttaaaggacagctttacttttataattagctactctttgtcttgctatttagttcttttctggctttgtagtttttctttttttctctgtctggtaatgtcttccacttacactgtatttctgatgtggctggagtgcagtggcgtgcgatctcagctcactgcaacttccgcctcctgggttcaagcacttccctgcctcagcctcccgagtagctgggattacagatggggtttcaccatcttggccagtcttgtcttgaactcatgaccttgtgatacacctgcctcggcctcccaaagtgctgagattacaggtgtgagccaccactcctggccaaggctatatattatctacgttacatgataaacattgtacgacatgagcatgtagcattttataaaaatattcattgacatcatctcacagcttttgatatgtttcttgtcattaatttccaagtaacttataatgctatttttagttgctttacaaaccaataattattagacatttaaaaacatttttgaatgattaaattattttagagaggggatacattcttgtttttatattaattttagtttagtcacattatctcagaaaaaaagtgtcctgtatgactttctgtttctgtatttgaaatcccaatttgaagatctttgtattctaacacatgatgtttaaattgtattatttttgtttgaaaataatgcatttcaggattcatggatttttctcttgttttatgtatatctaatgattaaatcaactttgtattaagtaaatcttataatcactcaattttttatacacttgaatgactaatttctgaaagagttgtgctaaaatcgctattcttttaaaatggtgaatttctccttttttctatctgttattgctttatcagtttttgaagcagtgttagcataacatctcaataagtgagcaatttactatataattatttggttataagttttgtcaaaacatctttcttggtttcattttatgctttttacattgaattctattacatttggtagcaatgttgccatttatacttgctttttgttatccttgtctgttatactattatattttccagttttaacgtttctgtagcatttagttacatatgtagctctagccattctgagagttgctatgttttaataacataatttaaaccatttatatttattataatgactgaaatgtttatacttattcatgacattatattgttggttttctctatactgttttcctctctttggctgtattagacgtggctagccagatgcctgattaagctgaaaatccaggtaaaatctattttaaattcagagagaaaagttctaaccccaaccagctggaaaatggtacatctgtgtgcagttcactaaatgctacatactgctgtatggcatgaattctgcagcactttataaaaatatgccgttctcatatacaaaggtgaacttactgacccttccatctgtgagacatgtgctttgagctgcttttgatatgttggtgaagtgttatattgagccatggcatacatttgtattatagcttcttggggttagaatttaaaactgtggatattagacagttttttctctctctagctctaaaaagaattatatttttaatatttaataatctatatcttttggtaactcttgagctattttgactacattaaggtggtcatacatatgttacccaaactggaatgcttttgatcatgaaaagtgacactgttaataattcatgctggataaacacatatgaactgggaccatctagggcaaaatggaatatagagctgtcctaaccttactagttagaggaaagagatcataggtataacataaatgaaaatttgtactgtcactcatttacccataaaaatacttactaggtaaggtggtaggcagaacattcagcctgggtttagaggtttgtggggcagtaagatttgaattaaagaagagattatgatgctgtggcatggcttaggtaggacacattcaaactcctagcctaccccgtacacttgagtagctgtcagggtgaaactgcaaacagataccttcagaaaagaacatacaaatccagatttatccattttgcatactattttactcatttgtctgttatttacttattgtggtcatgttactatttttcccgtatctgtatattttaataattatcttatattgaatgaccctgcttgcccagtttttctcttttctctactgtaagcaacataaaagaaaatatttcattttatttgtattttctgctcttaactataatattttgcgtatttagatgtgagaaaatgtaatactgtcaggtcatttcttaaagtatggccttgtgtgatcctaaaacattactgagatagtttaagtttcaggtaaatggtggatgattgttacaatcagtattactcaatatattaagtccacattaggtctcaaaatcttaggtctgcatttgattttagagacatacattatggtgtgagtcatttttctataaatcaggtaaaaaatagatacattttgatgttatacgaaactgtatttttctaccatagcagttactaaatatacaaatgatatccttcaagaaagaaatgataaaactgttttaaattcttttatgagtgtattttaattataatctacatataatgttaatagttttcttatttgattagaggaaaattttttgggctaaactttattttattttgaatagtttagtgccattgagcttctttctgtatgtattacaaatttaatacatttaatccattttctccctcattgctttctttcccaaaaggacacaaggctgttaacataattatttggtctggagatgtcagaggcttcgctcaaattattatatatcaactttatttgctctctcttattctgtatagttttctttttgtaaattacgtagtatagctagattggctccctgtaaatatatctcatagcacaagaaatttaaaatatttccagcaatgcctgttttaaaagcgatttcagctgcacctgtgcttaaatctggccacctctagttcagagcaatattcaaacaccaaaagccaatgatgaactggacattactaccccatgtctacaaaggaagaacattaacttaacatagtgtggtgtctagaagaaaatgtacagcctcataaagtttgaggagacgtttttatgcactttaagcttcagtgtaatacctttataagacaggttctgcagagaggggcaatattatcttctcaggctagctagtattacaacacactttcgctgtaatagtcaaacaaacctttattgaaagccaaccatataccaagcagtgttctgggaattctggaaaaatataaaaatatgaaataatttgagatcatgtaattatgtaatgagtgagaatacatttaagtgctacagtacttccaagaagggagagtttagtacttgatcaagaaatttagactgaatgtgaaggtgacaggaaatcattgggcagagaggagaaaagaagatatgctggatagagaggactgcagtggaaggacatggcaaataggaatgcagagggcatgactagacatgcatttgtgttcactagaaattacagttaatggatttggataggaagggtttatttggagttcctcgagaacaaaactaaaaaaatatatacacgatatggttaatagaaggcagtcatgaaggatttttgaatgagaaggttacatgaaactatctgtattttagaaagttaaatatgactatgccatctgtaagctagattggaagaagcagctcaaggatagtagttaacaacatagttgttaagttttaggaacttttgggcatttgatttggtccgctagaagaaaggaacattattgcaaagaggaaatgcatattccttagtgtctctgggtttgtttgtttgtttttctgagacacaatcttgttctgtctcccaggctgaagtgcagtggcgtgattacagctcactgcagccttgacctcctgggctcaagtgatcctcctgcctcagcctcccaagtagctgggaccacaggcgcaggccaccatgactggctaactttttaaaaaagatttttgtagcgacagggccttgccatgtttcccaggctagtctgggtattgtaagttctcactttggagattgattggttttattggtctgcatagggatcatttattagcagtagctacaggaggtccatctcaatgttattaggttacattttctgtactgtaagcaatataaaagaaaatatttcattttatttgtattttctgctcttaactataatattttacatatttagatgtgagaaaatgtaatgctgtcaggtcatttcttaaagtatggccttgtgtgatcctaaaacattactgagatagtttaagtttcaggtaaatggtggatgattgttacaatcagtattactcaatatattaagtctacattaggcctcaaaatcttaggtctgcatttgattttagacacatatattatgctgtgagtcatttttctataaatcaggtaaaatgtaggtacatcttgatgttatacgaaactgtatttttctaccatagcagttactaaatatacaaatgatatccttcaagaaagaaatgataaaacttttaaattcttttatgagtgtgtttttatcttaatctacatatactgttaatagttttcttattcgattagaggaaatttttttgggctaagtttcctataaaaggcagatgtttttaagagtacagattgtgtataataatgaaatgtatctgtgcaagtaacattctgatttgtactttaattgctgtttatatacagtgtgaattaagaataaaacagtgaggtgagggagggaagaaggaatgaggaatataattagcatactcagtagtttggaaatgtaactgttttaattaacagctttgtggtggcaaaacaaacgtgctttgggaaagctaagaataactaggattgtggcatcctccttgggaaaaagttgtttataatcttaatgttttatttccttttggctgacagacaaaagaaaacaaagtatatgaaatatttgtgtcagaagatatttatatgttcagttttaccaattttatgcattattaaaaagatatttacttattaattcaactaaatgccaagcatactacttctactaatattaacctttgtctttgtatccttccagaattgcatttatatatttataagaatatgtatatagagtctatttattcatatttttaaaaaagtgatcacattgaaatcatgttgttttgaaaattgtcttttacttaactagacattaagaatttagaattgtttacttgcatgaatgggtctgattgtcaggtgatttttcagttcaatatttgtccttccctttgtctaaaatggtcttgatttacatttcttagctctaggcatgactagtagatagggctagaaaacaggctttcagagactaagactctcaaacagataaataaatatactaaatgagacatggtaagtgctgttaaagacatgccaatgaagatagtaggagtacaaaggaggagaaactaactttgcctcagggagttgtaaggaactgcaaggaccttctgctgacttttcctctaccctcttcaacctggttcttcacctctgcagtttgttttctctgttttctcctgcctaatactcactcatctgtgatcttttcccttatattttctctcacttaattggcattggtccacttcttttaaatgaaaaaagaagatatttagaaattacaaggcatttatggtttattaaaatatggaaaatgctttttttagaataaaaactaatataacacttcctactcctttgtcataatcaaatagatacgttaaaattgtattaattttttaaaattttccctatctgcaaatatgtggtgtccatcacaatctaagtaagaccatctaaaagtaaaccttaatataacatattttttcatctcttctttaaaataaatacatatgcaatatattatttgttgtggttaagttagaaaatacaaagaagactgggcgcggtggctcacgcctgtaatcccagcactctgggaggccaaggcaggcggatcatgaggtcaggagtttgagaccagcctggccaatatggtgaaaccctgtctctattaaaaatacaaaaattagccgggcatggtagggtgtacctatagacccagatactcgggatgctgaggcaggagaatcgcttgaacccgggaagcggaggttgcagtgagctgagattgcaccactgcactccagcctggatgaaagagcgagactccatctcaaaaaacaaacaaacaaaaactaaataaataagaaaagttatcaaccccaaatttcactgccattatttcaccatacacttttcctgtctttttttccccctctggtataaatatatacatagaaatactaacaacaaacacatttgcataaaaatgggtcaaaccatatgtactgttttatattcagctttgttcactcattcaacaatcaaataaacaactcacaatcaaataaacatctcattagtaattgcacagttgtcttcatttttaatgatagtgttgtaggactctctccttagttcagctaaaagcccgggggtccttgtcacagggccatgaaaaattaggcgtgcagacaatttgaagggtgagcacggtggggtttattggacgaaaaggaaaaaaatacacagtgactctccacaaagccagagttctgctagtgcacttcctgcctggcagactgaacccctgtaccacctaggaagaagaggggccagcctcgtccccgctgcaaacaacgcgaacttctgtggctccatcccagtgtgtactcctcccagtgtgtagcaggtcagttgcagtttttagtttttcccgggaacccccttacacttggctgtctcaataacatagctttctactctgtgactatataaaatttctttaacccctccatatttggttacgtttctaatcactgaccgaattagtaacatctttgtcaagacagctttgcatgtatgtcgagtcgaattttctcttcaggataaattactagacacagaagctctttgtcaaatgttacgcacttttgaaggttcttactacacattgtcgaattgcctcccatgttttgcctacgtatatgctgactagctgttaaaatactgttctgttgaaagacatttatgcatatatgtaatctttatattgtataccggaaccaaattaaataattgaattctatacaaaacatatatattattttgattctttttcacagttaaatggtcccaataacgaggaacattcctatactttacttcagagaggagtttctgtcttcttgtaaatttcccatcaaaatgcaaatacattgcttgaatgggtttaatattagtggatctttttggctttcctatttatgtgtttccacacatacacccacacacatttatatatatatatgtaatttttttattttttagacggagtcgccctctgtggcccaggctggagtgcagtggcacgatctcggctcactgcaagctccgcctcccgggttcacgccattctcctgcctcagcctcccgagtagctgggactacatacaggcgcccgccaccaagcccggctgattttttgtattttttagtagagacggggtttcaccgtgttagccaggatggcctcaatctcctgaccttgtgatcctcccgcctcggcctcccaaagtgctgggattacaggcgtgagccaccgtgcccagcccatatatatgtaattttttaaacatatatatatatatatatatatgctttttctgaaggaatgagcacttatgacttaactaaaatatttttgaggactaatttttttgaatgcatttttttctgtcaattactcataaaatttattattatggcctttttaaaatggagcttttgtctttcttcagtacttttatctacttattctatttaacaataacttaccaaaatattatgtttacttattcacttttattgctatacttacacttttagaagtagcagagtataaagaaatggaatctgaagagccagttttgattccttgatattacacctgctagcttgtgactttagacaagttgctcaacttctttgagattaagtttgcccatctgtaccatggagttaataacacctacctcattgttttgccttaagaatcaaatgaagtatgtttgtacatggggtttgtaatctgtaaaggccttcacaagatgcagcctgttatcatttgaacatttcatatccagaattacttctattgtgtaaattattatgattggaaatttgatgttaagtatcaaaattttaaacatcactacactgaaattttaaaatgaagtgtcatcttttcaaaatgaccgttttatcttacaaatatcatttgcaaataatttctcccttattaacttttattgtagataaaagatatattttattgatgaatattttaaaaagcataaagccattatatttgaggaacaatttttacattcttatttcctttctgaggatgtaagtgatgaattcttgatgaaatagtatcagtattgcttacatacagtggatatattttcattactgtataaataaattactacataaatatttgtttgaaaccaaatacatcttatgtgggaatgaaggcagtttgttgttcttggcttcccatctctgcccaaaaccatttcttaatctcttaatttctaaatacaatagtgtttttgaagaaatatacagggaagagtgctcaaagagtgagttgacttggaagtgtttatttagtcctcaaaaacatgtgcaaaatatcaagaaactttgtcatcttcaaatctggaatcattttagaagatctgctttgaaaattaagcttctaacattaagaaactggcttatccaactatcttgtttcaaggaaaatagaggaggctagttggctgaaatgaaatctggttcattattcactagccttagggataatcacatttaggggaaaggctataattagctcaacttgccttttacctcatgtgtggcaaaatctaattgtttcttctttccttttcctttttttggtaaagtctcctaatattgttctcaacttataaatttcagatttccaaaatattaataaaaaatagagttgtttgcaataattaaacaatatatattgacatgaacatagattcaaaaatttgtatctttaaaatttatactttggtgctgttgattgaacttctcattatactcagttatttattgtactatggctctttgttcaactgtgagtaattaaaaatataatcttacaaagatctccaacataaacaaatctgtgcttctctacctttgtttgccttcttacagcctccagaaaggactgggtttggaagtttattttaattagagtttaagagtaatgaacattaattacagtcaaacatatggacattcccagaagcatttctacaagcactatgttcattggcagactcacgcaaacttcatgatcatattaaaaattcttcctgcttaagaccattttgcttaggcatgtgcaagtttccctcgtattttttctgatatttgtggtttaaaatgtaaaacaaaagttttatcttctttccttttatatatttttatatttgcagtaaccatttttccagaagtatttatctatctttcaggttttttaattgaccttcattatgaacattctaatatttctgctattatttcaggagagttgaataactaggaattgtagttcctacagtctatgatttttaaaaatagagatggtaatatagaatataattttattctcgtaatatgattttttatgccccgtgcataagtatatcttgtttatattttgcattcctaatccttcatattgatttagccaacatttctcttaggaaactaagtatattaattgatttacatgttaattaagtaattttcactaggtgtacttactgtgaaaatgtaaaatttatttgctgtgaagctttcccaatagcctaagtgtatacaagaaatgtagtagggagcagtttgagaatttggaaagcctttaatggaggctgtcagacttccttttgccctgcaatttcacattatatgtgttctccatggtgctatgacatatgccacaaatcttgggctagattcgaagatgaagaattatatcatgtaaatcatcagtttgatagaagagttatactcgaagcacatcttaattatctttatattataattatatgaataagataagatttggatattggctatatttacatagatataaatggggatactatattgatttatacattttggtgagaagaatatgtatttctgttaaagttaccaaaaggtgtctgggtatgtcagggtgaggcattaaccatctagcagggatacaggtacacccaagtagttataaatgtatatattaagtatataagtatgtattaagtacagtaataaaaatatttttaaaaaactgtagaaggtggaggaaaggatgtagggggcaaagcctgggatgcaaaggcttccaggagagagggcacttctgttgtgccctattaaaatgcatggtaagtactgttaaagcgttgaggacaggagtgatgaggaagtggggagttagcttttggtgggagataggagaatgattatcagaagatggtgcatgattgggactttggaggatgggtagaattctgaaagacatcagtggagtaaaggatatccgggtagtcaagtagcaggagcaaagccaaaaatgtgagaacatgctgaacatttctgtaatactcctgtttggctgtgaagtatgtaagagggagataatgctggaaaaataggtagagactggattgaggggagcctaaaatgttaaactgagctgctggactcccatttgtaggaagtttttcagcagcagtgcgtaggatggcttagaaggtagagagattggaagcacagccatgtgctgtgtgtcaggaggcagtaattggattctaacagtgaggggcagatttaataaagccctgaatagggcagacagtgacagaagtaatgggaaggtgggaacagatgcaagaggcattgtggatgaggaattgacaagacttggcaatgcctcacatagggaggcggacaggggaggatttcaggatgagctgaggttttgagcccatgcgatgtggaggagggtggcactggcaactgagatagctatcactgagtaggaacaggactgtgaattgaattaaggtggtgaaaggacatagaggttgacattttcagcagtcactaggaattaagaggctagagtataggagaactcagctactgagtccaccacactgctggatagtgctgccatgataggaaattaatattttcaggaacaaatgattaaagttttgaaaatgtggcaaggccgtcatcatcaatgcaatgcacacaaaaaaactggatgtgactaatcggatgtcagtcaaatcacttaatctttcaacagcttaattttcttagctataaaataggaaaaacagaaccagttttgtatccatctcctaaattccaggattatattaaagctattgctttggtaaaaagtatgtaatatgcagctacatatatatatatatatacacacacacacacacacacacaaatatatatactatatatacacatatatattagtttattatattgagagaactccagaaagaaaaaaaatacagttaatgttttactttctttaattgtacattgtaagatattgcagatacaaaaatttttaaaaagaattaatttttattgggctcttactctgtgataggcacaattctatgtactgttcaaatgttaatttagtcttttaattaacaccaagacattgtattattttcattttacaggtgaggaaaccaaggctcagagaaattaaatgacatttataaagctaggatttgaacgcaggcacacagactccagagccaaggcacctaaacgttagttcatgttgcctcacactgagtaaacatctgctcctgagcaggctttattttgtcattgcatttgtattagtgtggccttccctggtactctcttatttctaaaactcttgcagcccaggtatactgtctttgctttaatgcacattgcatttctttgctctgaaggtaaattggttgagggcttgtctcatgtattatatagaaaattccatggcatagagagagagcacaggctttgcatttagtccaaatgcttgctttaaatggaagcctctgtcttgttgactatgagaccttggggaagtgtcttaccaccctgaatcccggttctcatctgtaaacactgagttatagagagttaaatcacataatatatatatataaagcctacagcatctggctcctaaaagtcaagcaccagggctgacttatcccttcagcacagtaggcacagtgttgagcagtggtccccaaccttctggcacccgggaccggttttgtggaagacaattttttccatggtgtttgggagtgggagatgttttctggatgatcatcaggcattagattctcataaggagcatgcaacctagatccctcacatgtgcagttcacaatagggttagtgctcctatgaaaatctaatgccaccggggatatgacaggaggcggtgctcaggtggtaaggcttactggccattcaccttctgctgtggggctgggttcctaaccagggtactggggttggggacccctggtatagataagccacaatacttttaggaacccaaaaaatgttttagtccaaaacagtattttttttttaatatcagaagggaaaaaacaaactttcaggttaaataaattgttgaatatatgatactattatattcatgttcatgccaatacaattgtaaaatataattttcttatttcttttttaatggaggaaggggcccacagtggcaaaaagtacctcagggccgtgaaagtcataacttagcactggaaatcactccttacttaggttctttaaacctcttctggtgtctaggtcataatgttttcttcatgcattttgttgattcattagccaactaatttctagcttatgtcaattaaaataaaactgacctttgttccctcatacaataagatttttctaacacccccttcctaaatagttaatttccttttctgggttacttctgtaccatatgattaagcatctcgcaccatatataaactatttatttgcacgtctatttctcctccttgacgctcaaagcttcttgagaacatggatcatgtcgtagtgatgcaggacttctgctccttacttcagctaaatctgatttcctgtctcacgaccaggaaaaattaggcatgtggacacattgaagggtgaggagggcagaatttattgagtgaaaggaaagctctcagcaaagagaggggttctgtaaagcaggtctgcccctcacaatgaagtaccagcacatgaaccgaagaggccaggctcctcccttgcatgaggcacaaattcctggtggctgcaccctatcctgaggtactgtttgcacatgcaggcccttagtctgagccacattgatttatttcccttactgcgcatgtgttaagggatggactttttcaccgtgggcatgtttagtcaaaccctctgtgcacaatgacccggtgggtcggaacctctggggactcttccctatctgcctaggtatttggccgtctccttgcctctatcagtagccactgctatgtcctcagtaactggcagaatacatgacatttagaaagtcagtcatgaaagttaggtgaattaaattgattctgtttggaacactgacattttattgccagccataggctaattcgtgtttgtaaatgtgctctgtaactaagatttcacctaaaactttatgtatctgaagtgaaaagttgtcatctatcctgcaatattatctcctctttataagttttctatactgttcagcattcttccctaccagcccaattatttcttaaaaattgaaaagttaaataaattagtttgtcaagacatcttccccttcttgctgaattaatttaattaacaaagggcctgtcaaaatagccaaggcctttgatgtctgcatgtatggattccagtattataaatgattctgtgtccctctgacctaatgggaatacagtgtaagggtaagaaatgagccttaattcctcagtaccaaagagagaccagcattacccaattacatctaggagacaacaaatatcaccactaggatttaagtatctagctttatggatggagcagaacacataataaattattaggaaattggttgctgattagtttgcaccatatagttggtttttttaagagactgtaaagtgttactttgtttttcatttatttttatctctcccattctctgatttataactttctcaggcttgaagagtttttacatcttaatagcttgttatatacagaaaagtgaagcactagagtggggaggaactgtgtgcagtttggacaattgtggatgatggtaccaattacatcacagaagttggaggaaagagtaatttttgttcttactcaagtctggtagtgcacaatagcctgtaacagggctggctactggtagagattatttttcattcttaatatctctgaaaaaaagaagtggctggatttagcagaggaaaatcagtgtatgctcatgtatagagattgaaagttcacaattttggcatggtctaatacttggaatttcatttttattaaataggttcttctaaagttgttcaaattcttaattataaaggaaggatggttggtaagaaaaatgggtaatgattaacttgatgtgaagttttaggggatgattttctcactttagtaataacaatgacagtacctattatagacatgacatttttcaatgttttcacaggcattatttcttttgatgctctaacaggagagttttattgtcatcaatatttcacagatgaggaaattgagctacatggactttaagtgatttagacaagatcttatacttagtctggcagtattaggaccaatctgggtattattcttatttaaaatctcatattattcatgccttccttgcttctaagctctttagttcagtaagatctaatcacaggccggcctcctgctacaattggaaggcaattcaaaacaagctttctctgaccctttccaatctcgcttccctcagattcctcattcaccttcattggccacttggaccttaatcgatgcttttgctccctctgacttgggtgttacatgtggtctgtcccttatttgggtttggtctgaaaacatatttgtcttattttgtcgaattaactactcaattatataccagaacagcaggaagtttagtttctctttcctaaggtttttcctcttctccttaattattcaagaatcctgaagtttgctaaatccaaaggaaccattctgccttctaactgccaagcagagagcaaatttcacttgagccattggctcctactattgcttccaactgtcacacagtgttgctatggtatatttatcttgcacactaccatagctaatatttattcactattgatttttttgctcttgtgggtataggtcccttattatcttacaggcatactccacattgagtgccatgattacaagtctttcaattcacatttccaggtccaatcattatttcccaaactaggatagcattgtggcaggtggctgcgtttagaagggctttctgcataagcctcaggctggaatcatctctcatcctcaaaaacatccgtgtgtctaaacccaagattccagttggtattctccctttccttaaggcattttatttcagtattttattgctctttcctccaacagggatttggaagaggtcatctttatccatcttgataggtctcccaaagtttaaattttagggagcaagaccagagtccttcttccaggaggatcagggaactcagcaaatggcatctttggttgtcttccaaattctttttctcgcttcttcaaggaagaagatcccctcatacttcatattcacatgactaagaagataccttcaaggggccaggaaaataaatgtctttatgtatggaaaggctggtacaattttaaaataaattcccattgggcattctacttaatctctttgaacatgcctacatcacacttatgtttgcataatgctctatacagtttgcacttgtatatttgactcttacaaaatgcagtgaagtagctataacactttaatctcttcaattctaggtagaaagattaaaacctatgaagttagacttgttccagatagctagtaaagggatatattagtttcctggtgctgttgtaacaaagtaccacaaactaggtggcatcaacgacagaaatgtattgtttcaccgctttggaggagtctgaaaccaaggtgttggcaggtttggttccttctgagaactgtgagggagaatctgttccatgctggtccccttgctcctggtagcctgaggagttcctttggctcgtagatggtgttctccctatactgtaacatagtcttccctctatacctgctcaggtgtccaaatgcccctttttataaggacatcagtcatattggattaggacccattctaatgacctcattttaacatgatcattggcaaagacattatttccgaataaggtcccactcgtaggtgctgatggttaggacttcagtgtcttttatgggcaacaaagttcaacccacactataagttaggttttctaaccctaactgtcacaagattttcactatatactggagtctcttgtaatctaaaattttttcaatcactgttaaagcatttgttaggaatacacttaattgttattgatttaatggctcctgattcttttacaggatttttttgttgtttttaaaatttctttttaaagaattctcaactgaatcttgacttattgttttatgataatcaattttctaagagttacttctcaaaatccttgagatacattaaaaaaaatggttaggcttttaaagaaaagccaatagagatgtaacacctgttaggaaatgcagattataattgtaatgtaaatgtaattatacgtgtaaaattttttgtgtctagtaatattacccagggataatagaatgaaaaatttattcactgttgcttggttgctcttgtgtatataaatcccctttcagctcacagggataccctatgtgtaaagaattttaaagttgtaaaatagaatgggcgcttgttactatttataagcatggcatggaataatactgagatgtttcctacatttgaaaaaaatgaatttaactgtcattatcttttctatatccatttaatattcattagtacagtagtttgaaaagtgggctttagagtaagaaaaacaaatgtggctgcatctcaactgtgctgttattgtatgagtgacctttagcaagtagtttaacttccaagttttagggttttttaatgtctaaaattgagataagaagaccattttcctcataggatttttgggaatattgtctaagaaatatatgcagcatgcctataacaattccaggtactttgtgagcagatgatatacatcaacaatattgtcaccaccagttaaattaattagttccattgaaattgtgattactattttaccctattaaattaaaaccctgagcctgaaaagcaggagttgctgggattctgtgcttacagcaatattagaaacatagttggcaataaattattattgttttatgtcagagattggaactatgagtcttatgggcctactgttttcaatacgtttttctgtaccaataataactttaattgttagaacctatccagaaactcctaagattaaaatttttttgtgtgtgtgatttggctattgatttttgcttttcttttttagcaccagatatcctttcttgtttgtcccaaggcttttcattatttgttagagtgacttcatttcatggtattatctacttttattttcaagtgccaatttattaacttaaaaatgcataaaaataaacttttgttgtgtaagtaacacatttgcatgtgggaagaaatggatgagtgcacacacacacaattcaaggcacccatagtcctacaatgcacacaaacacatgtgattcaaggcacagatagtcttacacctcacatagcatcagtgtttgcattttgagataccatatcttaatgtcatcttttgacttttacgccatgttttggtaaactgaatttcgtctggattgaaactctcttctgcatagctaacccctttggtttcaacaatgtgcagagaagagaactcagcagcaagcagagtcaataggggttctaacatctctcttccagccctgggttcctttcatgtaaaggtggcatccaataggactgctgaagtagcatgaattcacaaatggaaattgatttctatcaattctatatgagctagattatcttcataaaatccaaacagtctgattctaaaacacaattggccctaaagatgttgaatgagagttgggaacttgtattagcatagggaggtagccaaggaacagtgttataaggagaagagccccagaaaggcagttatgtctcaactgcactgtgattttatgaactctaattctgttctggactcacactgctcaataacgaggatgcaaagcacctgcagcctcctcctctttattctgtccatttctcaccatgtcttgcagaccaaggcatgtttcctgaattcctagacttaatgctttctgttccattaacgatacttaatacattgccttcttcaaataaaacagatttcctttgttataacgctacatgacggtcaggctagaatgatcctttgctggagccactttatgaatcatacctgtttgtgagattgtaacacaataaattccatgccatcgttttgtctctgaattgagaagaatcccaagaagggcaaatgtcacacttaaatgctatggaaagagaagaaaaggaaggactggagaagaaaacaaaataaaggaggagattcatttttccatagtggatagctacttgaattatttttaattattgtggttaaatctaccaggaaaaggccaggtgtggtggctcacacctgtaatcccagcactttgggaggccgaggtgggtggatcacctgaggtcaggagttcgacatcagcctggccaatatggtgaaacctcgtctctactaaaaatacaaaaaaaattagctgggtatagtggcaggcacctctaatcctagctacttgggaggctgaggcaggagaatcacttgaacctggagcacggaggttgtagtgagctgacattgcgccattgcactccaacctgggcaacaagaatggaactccgtctcaaaaaataaataaataaataaagttaacaggaaaacatttagtaattgtgtattctgtttccccctacaactactgtgagtaatctgcacttttatttctcttttggcccataagttttacattaatcctattttgctatttactgaataaagggaattgagaaaaaggcatttctcattccaagttagccctacaatgccaagtgtaaaaactcaggcctaagtgaagtttgaggtcaggataagccaggctaacagatctttctggattttactttgcatctcattcattcattcatttattcatttaactgatacttattgattactgaggatgtgccaggactgtactgggtgctgcaatagtagtggatgaaacagtaaggtccctattctcatggagtttgactagtgggaggatgaggggagagcgacaagtgtcagtatacagtaaatcagtgaacgagtatttggattatataactttaaacagtgaatggggctgtaggaaaaattgaatgggtaattgggtagagggactggaggataggtaggtaccgttttagatagaatgatcagggaaaatttctctaaggaggtaggattagagctgagaaagagacagatctaagggatgtattccaaaaacagggatagaaaatactactaccctcagataagaataagttaattctgtccaatggcagtgagggggccagtgtgtaaggtacagagaattgaaggacaggggaacttggtgaggtttgggggtttggtggggtctatgtgccacagaaagctgattttgtttttgtcacaatgggaagccattagaggctttgaagcacatgaatcaacatattcttatttataaaggccattctgggaaaaacagtgaaagaaggaaaataaattaagagactttccaagaagtgagagacattggtggtttgagttgtaacattagaaacagagagcgtcataacattagaaacagagagaagttagaggattcaaaatacaaaattgagctgctagtagttgctgttgtattgatgttgggatgaggaaagagatgaatccaggatagtttccggttttgggatctgaacaaatgggaaggttatgctgccacttactgaggaggggaagacttattagcagactagccagtttgatgtgtgtttgggggtactgtggggaagtacttaaaggtcacttctttccccttttgtgtccttagtgctttgtggtgactcaggaagttagagtgtgtacttttttcaggtgatctttcatgagctgcctactctgaacttcattggctttgatttccattgcaacctaatttttgaaataccaaataggagtatcattcttctccctgcaaaaatacttatgtgtatgaagattacacaaatggccagttctcagtaaatcatgtgttcaaagttgtggttccatatagtgatgggtttatgtggaaacagacatcctcatcttgcttcatctgctgtgtaatcattaactcatgaagataacaggactgtctggggtcatgggctgtgggacagaatgaagctccattttctacaatggagagaaaatcccaagaatcagtattttcatacacgaaattaaccagcaaaaatcttcaagaacttaatccctttccagtgaatgagtaataaattttttgttcttcttttttcgtattttgtagtcaaaagctcatgtataccgcagggttttacaacactttctgtctttaaatttaaagcagcaataagcagacatgttctgtaaccagatccaaatgttctggtccctgctttaagttgagaaaatctgatttggcaaacaaataaatgagcaacaagaacagcaaaactaacttgacaaaatgggtcatttagtttggaaaggggtttattgtagaatgcctttaaataataaacaacattaaaagacttaaactataatttcataaacaattttacagagacacatttatttcatctaacattgaccttctgtaatgtgttgaatctaaattcttaagttaaagcataaagtagcatggggatttttacttcattttcaaagaaaacacaatataatctttcatttcattttcctcaatgaataaaatatttgtcactctgtgttataatgtgagcgcttctagtaatttttcatttttacctgaggtttcttttttacccactgctaagttcatttctcaggtcagcaataatgttgggataaattcataaatagttattctttgaatggtgaaaataaaatgtgttttattcatgagtaagtatagtgtttgcttgttgctgatattgtatttgggttgaaatacatattttctttttactattatctattttaaataattctggaaatacagtatgacagattttaatcagtaaagcctagcattgtatgagggtttttttctcttttcaagatagtgtatgtgaaagcatacatcaataataataaaagttgaattcagatgaaaatgctttgaaaatggtcaacatatgcaaatgtaaggtatttttattattgttattgttattctttgtcattattaaggtatactcgataatgatgttagcttggtttataattcaagcattaggtaataaagacaaggtacagttaattctgcattggagactcatattaacaaacgtttttggtaagtctattttagtcatttcatagagggctttgctggaattgtattgcttcaaatacttgttttcagtacttttacattcttggaatacttgcatttagatttttgttaagaggcagtatatggtatggtggttaagaatgtggtctatacctatggtgtcaaactacctgcattcaaatatcacccaagccacttattatctgcaagagcttggacaagtcatatagccattttatacctgtgtttccttatctgtgaaatgacaataataatagcattcagttttgatgatcaaatgtgctagtttcccagatgtgaaacattagaagaatacctggtgtatagtaaaaaataaatgtcagcaatgattatttcttacacaagcctggtgaaaattcaagtttactggttattaaattgcattggttctgtttggggtcttcctcattatgttcagagatcagcaatgccctgaggttttttttttttttttttttggcggggggtcatatttgcctgattatatctcatcgtcaagtagaaacactaaaatacataattcaaaacaaagatttgatcttcaaaagggaaagacaaagcaccatctcaaatttgctgtaccgaagggcctggctcagtgcctgacacatggtaggtgctctgcagacctgggtccacccatggattatctctgcccaggattctgacccataaaaggaagggcattctttccacattcttggtaaatctgtgtaggattcttatcttaaatgtagtctttaaccttaggagactcagaaactttgaaactatagtattatgactgaaatattaagctttttaaaaacacatactttagttcatttagctgtctaatattttctctgttcttaaatttgcaaccttttaaaatgtatggttttaaattacatagtggattattcaggtactcatctaacatttaaaatgtaaacagtgcaaatttttcttaaaggcaagaagcaggggattatcatatgtgaaagggagtagaaatatgatctttttattcttgcttgcctagattttgcagttttaatcaaattggcatttaaaaatactgggctctatctgttaagaactgtctgttgtttatagagatttttaggtgtaaattatctagccagatgtttaagcaccaaagggaaacaagttaaatacaattaacccagtcttcatttatcaagtagttaattctcagcggtaggccacaaaatcagtcttttgatcccaataatatatataggtataactatttagataacataaaatgaaagttacaaagccttattttgaaactctttaagcttggccaaattagggaacattttattcaatataggtggcttcccaaattttggttactgattgcctttgtcattgcctttaggacaactgtagactttgtggatattggaacagatataataattgtactgtaatttcccaccaggtaaatcacataattattatgggagtatgaaaatatctgagaacagggacagggtgggggtgtgtgggatacatacacatatgcatgcagtataaaaataagattgcaaaatgttgcatcatttcagttgctcaactgcagctcaactcaactcttgcatagtcccctataacattgtgttagtgtggaatttaggtacattttaatatgtttcatatgctatgaggtcggacctccctaaaacaatagtcttaggatctataaagttcttaaaactcatctgattatggtgagtttttaaacattttgcataattttttaaattctaaaagtattatgaaatgacagaaggtttgggtttgggaaacaaagggaggaaaaaaatcagctactacttaacaaaaatcatttgtaccttgctctatatctaaatctatatctacatcccattgtactttcaggcttgtactttatttcttctatgcacctacagtgaagttttaaatattctgggctctgtgtataaaggttctgagttcttcagtattcctgagaaggagcttaaaaatactgtgatttttataagtcgcattagagacctaggaaatcattccaaaacattaattttgagccaaatttctaatagggtattaaaaacaggggtatagtggaaattgtattaaataagaatcaggagtttatgttcaagtcgcacttctgacaacatgagttctatcagttgaagtatgtttgcgatacatgaatgtatatgagaaatacacatatacagtcaagagaataagcaatgattcatacgcattccccagaaccatgctttatgcttaaacaagatttatggacttgttttcttgggcttgcatttccctgtgagagagtattttacggtgggctggaaggtgtttctgtttctcttggttaacatatatggggagcaacagaaggtaacaggaatgattgagagggagacaaagagaccttgggaagggtggatgagagcagtggggaggaagaaagaagggtaaggatccaattatttacttgacatctatttgcaactctattaagtatggagataaaaagagagatgggtattaaggggacaaaacacagtggagattttagctacccccagtgttttcctctggctcactgacttccagttatcctctttctttgcttattgttacatgtttttggatatcaaagagagtatcctaaaataactttgatacagttaatgatcttagtggaatgataggagttttaaaaaagaacaaagagcattccatttgtattatagaacaattaaataaaaatccacttacagccataagttgcaaatttttaaacatatatcatttacttatctagctcatttttacctcatctgcctatgtaaacccatcgttattctaagtctcccttaataaactaagatttccttcttactctaatatttgagatctaagtacaatccaaatgtcagaggttattgttgttgttattatttccaccatggagacctccgattttctaataaaatatttttataaattttactcaacacaaattagtttacttttcatgctgtctccaaaagtgaggaagtagagtagttaagagtcataaattcggagcctgagttttggggtttgatgtaactccacacctaactaactgtgtgaccttgagcaaattacttcaaccttctgccctttcatttcttggtctataaaatgatgacaattatagtaattttctcataatgctgttatgaggcttaaattagttaacttggggtaagtgcttaaaacagtacttagaacacatagctcttcatatttcagtggttctccacgttggtgacacattagaatcacctggggagttggtgctcacctcacccattaaatcagaatctttgggggtggggcccagtactgggagcaattgaaattgggagcaattattgaaattgctgaggtgattccagtgagcagccagcgttgggaacgatggccgtaaatggctgtaattatcctgctgactaaattataaacttcctgagggcagggagtccattacttctttttatacatccttcctagtgcagctagcacagtgccttacttgtaactaatgctcattaaatactatcaatgaaagaaaacatgttgatgatattttagatgtgtaaagaccttgcaggaccacagaggtgctaattttaagcattaattattcattccctcatttattcatttatatgtgctacacactttggagtcttgatgctaaacactgcaggcatatatgatttgaaaatgcaatccctgttccaaagagtttataatttagtatgaataaatgcatacatgactttaatagaagggaaactaaccatgtataagtgctgtgttacaatttaggttcccttggaggctgtctctaagatggagcatgcagagcgtttgtttggaagtgctcttgagaataacacctctgcgtgtgctggggaaagggaaagctatggaaccattgaaatatgaaataattggacagggaaagaagttaggttttgatgcattccaagtgaagttttcagctaaccccacaggagctctggggctggggtgactcttcagagtcttaagttgggctgcagggggccaggtttttattcctgcatattgatcagtgcttggatacagctgtcactggaagtagtgaccttggatgaggcatgtttctttagcagaagcaattcccagatacaagtgacagctcagggtgccctctggcagttcttccccggataggggaataagtccttcattcctaaaggaggattcgagtggagtgtcaccgcgtccatcacatgcaacaagagataaacgaacaaaaaaaattatcctggctaaaagaagagagatcacatttatttagatggggaggataagagttagggtgaattgggaattactttttcaaatggatgccattacaatttgatatttaaggatgggtgagatttcaagaggctgaaatgaggtgcaaggtgttcctggtataggaaacaatagaggtaatggtggggaggtatgaagtatagatttgtggagaagcccatgggtctagaagctcaggctaagcagcttaggcataatttggttgactttcaggagcagggaagaatatgtgccagtgtgtattagaaagattagcctggtagcaatatggagacataggtggggcagagcttgcaatcaggaagattaggtaacaagccaatgaaataaactacactaaggatcaatgcaagaagaaaatgcatgagaaaggcaggaaagcagagaactgcaaagagctgagtggatgcaggaggcagtgtagatgtacgtgggacaggtatgacagcagacaaaatgtttctatgtatgtaaggtggtgtgagtggtcagtcaccaggggatagcctagtgaagagaggcacagtgatagagaagagagccagaaagagcagtggctttgatccattatccgcaaaggaagagacaagtgtgaccaaggtttttatagagcattgagtgtgcatgaaggtagattactcatgttgatttgaatcctgttttcttgtattactatctgggactttcttggcaatgtcagaacattctgtcatggccatataaacagcacgtatgtggtctgagcccagtcatgttggagcactgtgctagatggtactaggcaaagctatgaaatgactaatatttgttctaaaaatgctagtcatcagtgttttcactttctagccatcccttccaggcctttagagtactcatccaccttctatcttccttcttccctgtcaaaaatggtcgcttataccacagtgatggtttctccaattatatgtcatctattcctgaagtatctgtagtcataggattcaattcaaattctctttaaatgaattttggtgaataatattattttgagcaagtgggcttctgagcccctggaaatgatgttaagtgtaaggccaccctcggtgatttaattttgagggccagtattttcaggatttgaacaaagtggaaaattaagtgatttttgcggcttcttaaccttggaaggaggtcctggaatgatataaatactgccttctaggggactcagctgtgggacattgtatgacttaatattgttttaatttcttttttctcctctctgtcacaaaaatgagatggatgaactgatcatcccataatttttcattatgaaagaacttttcctacttcatcttaatgtctagggtatttcatttaagaacagcttaaatgagccctctttcaaaataagctgtcctgtaataccattagttcccagctagtcactttgtgaagtcacagaactgtgtacaatctctcttttgattctaaaaccttgggagaaagtaattgaagtatagacacttgagagtctcaattttattgctttgcaaagaaatttcaatttagagtttatctaggttacagtccccaaatatttctcaaggaggataaatcaaatttgttggagagttcctagtcatgtatcattcagtcctattacctgaactgccttgtttgacattgtcagttggaacactctcttggctatgattagaactcaaccttggtttgggtgacaactcactcttcttgcttgtttctctctttctcgcttttaactccgagattcaacatagttctttgaaatgatttatgtttcatcctaagtcattagtgtgtgcttccaagtggccaatctttcctcctttgttggttaatgtttataggaaacctcttggagtaatgactcactgtgatacttcatcacttgcctgcctccttatatttgagactttacccttctttgcatctttaaaacatattctgctctctcagtggtgaatatgattctatgcctgctctatgggtaaacacaaaccattctctatgtattaggaaagataaatgtgtgccactctcctctgtttttctgcaagaaatgttcttttatctgcagactaagaaaccatatacaaaactcatctaggttgcttcacagatgattattcatcattagagtattagaaatcaaatgaaaggataatatgtaactacttttaagaagtagttctccttttaaaataactagctcactcaagtacttctattttttaatgctactttccttactcagtaagagtcaagacactatgagactctgcgaaatttgaattctgcttgttaccgaaaccctgagcccttatagatgatgttagagagcaccttttccaaattccttcaggcgaagcctcgcaatcatgaaagaggggagaggaatgctttggtggttatttgtgcaggtgataatttgtacagaactagacttcagagtcttggagctgaagggagtcacaaaggaaggtttcttcaatctctcttcttttgcggaaagaaggatgtcatcctgactaaagtcataaagcaactagcaacctgagtaattgaatgatttaaccaaagctcactttaatgggtctgcggtccacacctgccctccaatccctatgaatttttttttcatcaatgtatcccaagcagctaaaataatgcctggcacttagaaggccctatttgctcatttactgaatggatgaattgatgagctgagctaagggaaaaaggaattcaaaatagcagttgctttcctcttaggcagtgttttttccaccacctagctataccttatcttgtttgtgtgttttgagaggcagcatagtagaatgctcaaatacagatgttttggaaaagaactgcctatgttcaaatttctgcagtgtaatcttcaacaaattacttacctctcaattttcctgtgttagagataattatagaacaatgtctcttaggattgctgtgaggattacccgagttaacttgggaaaagtacttaaaatgatacctagtatattgttggcactcaatctgtgttagctgctatctcgggaatgggcagtcagtggcatgtggtgtaacgcacagggttcctccctggaggcaagtctggaacttgacaagctcctctgaaacaaggtggaatcatggggtttcagcgtggggtgctgaagacttgcactatgcagctctcctcacatgccacattgagtcccagatttctgcaaccacagaagtttaagagaagctttgctgaaagtttgaaaccagtgtgaatacattcatatggtaaataacagagcctctgaaaaggagacaatgagatgcccaagaaattctatgggctttagtgccacccaaatagaatgtctttattggctcagctgctcattagctgcctgtcctggcaaaactattcaaatccttagaaccttagttttcttacttgtaaatttaattaaaaaatacttcttgtataaaatatgaaataacaggtacatgtaaagtgctaagtgtatcatagagatgtaataaatgataagcccttaaaataacgatcatagccataaaaatccaagggattggaaaaagcaatgcacatactatgtaaagatatcattatttcatttgcttgcttcttcagaaagtaacaaggtggtttctaggcagtcagtgccatgcaagtattttgtctcaggagcctttgttcttgaaatttttatccatgaactctgttaaaattataccatgacttcaaagtcatctctgattccaaagcctccctctaactaggctgcttgcaggagactttggtgtctttcttcagtagaagaagaaagaaagagagaggaagaaaaggaaggaagggagggagtgagggagggaaggaaggaaggaggggggaggaaggaaggaggaaaggagggaaggaaggaagggagggagggaggaagggaagggaggggaggaaggaaggaggaaaggaaggaaggagggaggggaggaaggaaggaggaaaggagggaaggagggagggaaggaaggaaggaaagaagggagggagggaggggaagggagggaaaagaaaaaaaggagtatagagataactaggcataatggacatcaaggccaattttgtcacccatttgtattccctatttttccctttcttttggagcttattgataatgaggtgtttcatctgacttttgtgagtgaaatatggctgttatcaatccatactaccttgtaagatgactggccagcttagtctgcaataacaaacaactgcagaatctcagcgcttaaatcaacaacaaaaggttatttcttgttcgtgctatgattccactattgattagatgggagctctgtgctgcttcatgcttattcagccaatagagcctccactgtctgaaatgttgctagtggccatcatgggtgagggaagatagcaaattatgatctggcttttaacacatatctttgtctaaaagactatgtggccctgacatttgtcactttgagacaggaagtaggctggaagaggaatgtgtcaaatatttggtgaccagaaagttgagtagtcattatttgggattcccgtctattctggttctcttcttctgcatacatggtagggttgcactttgatgcccatttgaattagccattggccagtgaagtgtgcataaggatgatgtgccacttccatgttgaagcttcaaaatctagcgtgcagtttggaatattctttcctcctgtccaagtgacccatatgtttatggctctgtcagtctgggtttttgaatgaagacaaggtggagtagattgctcccaccaacctaagatggatgcgtactatgagcaagaaataatagatttgtgttctgtcattgagatttgaatgttgtttggtctggaacatatcctagcttattctaaccaattctgatagggaacatattaggataaatttccaaaagttaaaaaaaaagttttcttttgtttatctagatatatatctcctcaaatttaatgagcccagaggcaatttttcagtatcatagggagaaaaaaattacgtaggctcctttgattggttcacttgattagtggtaggggtgctggtgttagtaagaggtcatatttgggaacaaggagctgtctatattaattatagctgcaggatgtggttgggctgtcaacttcttttctgctagacagaaaacataatttagggatccatcacaaatacatttatcctaatgacaggatatcggagagcacatgattttcatacacactgtctttcctttctactttttctttaatttaaatgagtttattatatacttagatattttaaagggaagattcttaatttcttagctttgttttatagaaatcaatgaagaaaggagggtattattggcaagtgggaaaacaataggtttgtattccaagcagatggtttgtggacctcaaagatttcacattctctatcagtcctgaaaattagacagagttatgaaatcaagtacagagcgtactactgattcgctgtgtgaccttgggcaaggcacttaatcactttagatcttagtttcctcattttaaaaatgaggataataatactggcataagtcacagggatgttgtgtggataaactaattaatgattgtaaaatgctttgaaagtgcaaagcgttgtataattgttaggtgctattattaagaagtattattactgtgttgtgtgtaattcttattagggcttctctttgctttgaagtcagcctccacgtggactatggggttgggataagtttacagatgtgctgctcaagtgccttttttgcctggagaaaatactcagtagctagggtaatcatcattatgaagaggatctcttcaagataaaaaagataggaaatgatctcctttttaaaaaatggaaattgctctaactttaaaagtatcaatcaattctttaaaacctcatacagccctatgtttcaggaaagtctaacatcatgcaaaatttgaaacttcaggaattttctgctcagcataacatgggaaatgttgttgctaagataactttaaatcagctgaaccagctctttctaattttcccacagtgtttgcttcaaggatgaaaacaagtgaggtatcctctagaggagagaaattctgagctgtggctgtgttttgcatgtacaaaaagttaaaaccccaatccaaattaatttttatttgttttgtagattctccgttgggaagtgtgtttctaggtacataaaaacgagctatttttctgaaggtcaagtatacaccatgtttatacgtgactacctggtgcagctgagcaatattgactttgatgcaaaaagaccacagtcaggccttgggaggatttctcattagctgtgtgagttttaacaaaataatttaacatttgcctcagtttccatatataggaatgtgtgtaaaataattcctgcttacctaataggctctggaagagctcaaagaaggtaaaatctttggaaaatattttacaaatacaatgaaataattaaattgtattacattattttatttaacattttaatcatttttaatgtattcctgagttaacaagcctctacatatatttccattggataataaagatattagaaactcaaataattttcttgcaatgatctacatacatgcctttagttttatatcccatgacatgaagagaaagaagtccatatgcactttctgagaagttgtccgttaagtaggtcaaggggtatctgagatgtgagcgggtagctttggtcatttgcttttctatgattgcacacctttttaaaaaaaaatgctgtgtgcagtcatatatgtgtacagcattaccttttaaaatcaccaggaactaggaacataggatagatttgtttgctatgcaaatgaataaaacttgtaccaaagaaatctaatgtttaactccaagacacaaaagagttgttagagtttgagcttattgtactatcataggggataaaaacttccagaaacttctgagaggccagaagttttcagagtctagctttctaggatctgaggacgaaagtacttaggtctacccttgaggcaccattattttctaccaaacatttcacttcttgtgatcgcctaagtctttgcaagaagaacaaatctcacaatccatttatttactctcctaaaaatgttgaccacgtgaaatgacaatcagtataccacagttgtttatcccctcagtggtgccagagaagaggtaatggcagagtttgtaaggtttgctttctaatttttgtcttactggcatattttctatggtagatgctctggtgggtacccagatccccctttcagaaccgaggcactatttccccacctactggaagtgttgtctgctgatgactcacggctaagtccctctactggacttgactgctggtgcaggaagctgccctctccaaggtaatgcctgcctcccaggggctagctcacatccagtgactcaacaacatagatagtacaaagccacagccccttgttttgatgaggaaactcccaaagactatcttaatgccaaagttctctgtaagtttggctgagacctgtgttacaactgaattacagttttttttgttttttttttctcaaccaaccttgaagccatcaggctgatatctagggtcaattcccaacataacatggacaagaatatactgggtctgctatggaaggaagctcaaagagccatgtgttctccaggaattgggagcatatatgttggactggatccagagggtgctggttcaaagtggttggaacagaaagttgaataagggagagtttatgaacgtgggatcacttgctaatgatagagaatttaacaccctggcaagggctttgggagatggtgttaacatattgctaaaatgattcttgaaagcttggtaaaaatgatgaccaatactataataaatagaaatgccagaattttgctgtagcagacagtggatgaactaatcaaaaggctcagagaagttgtgttggtacacagagggctgaaaaactaacagatggtcgtgttctggaggacctggagccaaacagataataaaaatattagtgagaggagcatcatcatccctgaaaagccagtggtagccatcctctgttgtccaaggttcactgaaaagatgctgttacagaattggactctctgatagcaaagaaaatggtgatgagcataagtctggcccctacaaaaaacatataaattctagtgaatgacagagggctatcacaaactcaaccaggcttcaagtacatggttggcagccattgatctggcaaatccatttcttctcatcttatcagggaggaggaacagaagcacttcacattcacttgaattagataacagtaaaaacttacagtcttgccccagggctatgttgtctgtcttggactcttaaggaacctggactgtctggacatctgctgaatctcacatggatctgttatttgatggcataatgtttatcagacttatctgcagtaagtggcaagtcttggtaaggcatgtgtgatctagaaggcaggaggtagaccttatggggatacaggggtcttctccatcagctttaggtgtctgaggcatgccgggacagcctctccaaagtaaaggagaaactattgcaattaagcagtgagacacgttaagaaggaaacacaacatctgacaagcctctttgggttctggaggtagcatacatatttcacacttagtaatactgttccagtcttttactaagggacattttaatgctgtcaactttgattgggttttagaatagaaaagagctggatagcaagttcatgccacagtgaaatcagccctgccactagagtcatataatctggcatctcttgtgcaaaccccagtaggaaaatgacaaaacagaaccatagggttaggagcaaagacatgccctctgcagctaataattatgcacctttggaaaaataactttagtgtgtgctactgggtgttggtagtatgaagcactgaaatgaaactactacatctgggattgaacacagcaaaggccagaaggcagaagaaaactgcatgagcaggtggcccctttccacatgtgagggaccacagtggaaactgcacttcttcctctgctcacaccaatagctgcatccaaggtgggggatgttatcctagttgataaagaaggaaaaagtatgagcttggttcatgaatttatcagcttattagatgaatgccagccagaaatgtactgctgcagcactactacctcattcaaaggtgcctctgaattatagcaatgagaggaaatcctcccaaaggtcagaggtttgcacattgcaccttttgtatggtccaagttaagaatatacacaaattcatggttaatggtgaatggcttggccggctggtgagggacctaggagagattgaaagattaggctgggtgtggtggctcatgtctgtaatcccagcactttgggaggctgaggtgggtggatcccctgaggtcaggagtttgagaccagcctgaccaacatgaaaccccgtctctactaaaaagacaataattagctaggcatggtggcaggcgcctgtaatcccagctactcgagaggctcaggcaggagaatcacttgaacccaggaggtagaggttgcagtgagtcgagatcgtgccatttaactctagcctgggtgacaagagcgaaactcagtctcaaaaaaaagaagaaaaaaaagaaagattaggaatgagggggtataggaagtggtatatagatggacctattgaatggtcatgaagtgtgaagatctttgtagtatgtatctgttaatgcctgtcagagggcaatcaccaccgaaaaagctctaaaaataaaatagagaaaatgaccgtagtcattggccactccaatgctgacacaatgattgcatgaatggagtagacatggtgaaaaagacagagtccatgaatgggccatatggcatgtattcccactcaacaatattgacctggccactgctgttgccaaatgcctaatctgacagcagcagagaccaacactgagcctccaatatggcaccatctctttgtgagaggagccagctagttgtcaatgaatatcatcagcccccaggtatgactttgcctttcctaacttctgaagctcagctggcatcactgtttgagggctttagagtttctgggttttttttgttgttgttgtttttcagatggagtctcactctatcgcccaggctggagtgcaatggtgcaatctcagctcattgcaacctccaactcttgggttcaagcggttctcctgcctcaacctgctgagtagctgggattacaggcatgcaccatgatgcccggctaatttttttggtatttttagtagacacagggtttcaccttgttgattaggctggtctcaaacttgtgacctcgtgatctgcccgcctcagcctcccaaagtgctgggattacaggcgtgagccactgtacctgaccaagtttctgttctatcaacattgtgtatatattacattgctttagatcaaggggcacactttacagcaagggtagttgtgggggtgggcacattacattggatgctatcacatatcatacttcctagaagctgtcagcctgagaaacccatggcacggccttttgaaggtgaggtagtagtttggcatggcatctgcaaggaaccagcttggagatgatacctgtggggttggggtgccatctttcagatatagtatatagcctaaaataatgactattttacagtgctgtattcccagtactacaatcaataggtccaggaaccaacagaaaaggaacaggagtgtccctgcttaccacctctcctagtcaccctttagggacattttttgctttccacttttagatatttgggctatgtttacctagaattcctggttctaacacagggaatgctgccacaagaaggcgtggtaagatttccatcaaacttgaagttgcagctgctccctgcttacttcaggttcctcatacccagagaccagcaggcaaggaaaacaataatccatactggcaagggtaacgtatcctcaggaggaagtatggccattgtcgcacaatgggagaaaggaaaaaaatatttttggcacccagctgatccacttaggtctcacttagtaccccctattcaaacggacaagtgtgggcagctgtgacctaagacaggtgtggtgattagggactcagtccccttctagacgagggtctgtgttatataccagcaaacaacctggactggaagagatgctagccaaagataagaagaattggcaagggatagtagaggatggagacaatgaatatcagctgtgaccttgagaccacctgtgttgggagctatagtttgtcccactaactttcctcttgtaaatttctacaggagaagagatagactagaatcctcgaggacctgctcccagagagtgagaatttactaacttactatatgaactaggtggatctgagtggcctgaggagtgaactaaaatgcgtgctgtatgtaccacctcgatatcccctacagaaatgagacatccaatccttcagttgctagtagtgttgcctgatgatgattcaaaactaattctctcaatgggaattggcctcttctcaaagtagctgtctcaccaaggccatggttcctccctggcagtaacctgcatctaatgactgggcgatgtaggagcacagaagcccagccctactgccttgatgagcccattgtgaagggtcatctcaggttcagaggtcccattaggatcaactgaggtctctgttgtaagtgccttgtagttcaccttctccttcagttcaatcccgtttctctcactactttacaggcattgttcctgggaatactcctcaataaacttcctgcataacaaatctctgcctcagagcctgtttggaggggaggaaaacttagaactttgtccccaacatcaaaatacaatttaatttaaaaacatttcagtgaagttaatatgttttctgaattagtgcacccaaaaacatttccaagcaccccctttgtgtgttttgattcttacaatctatgtcctttattcattctatttattgaacaattaaagagtgcttctcatatatgaggcagtgtgccaggcattctggattcaatgacaaaaaatgcactcagaaaattcattctggattcaatgacaaaaaatcctgaccttaaggacctgatggacaaaagggaaaagcagataaattaatagacagttaaaatacactataattaatagaacataatgtgggaatgcagacatgggataactaatttagcttgttgagcagagcaacacagagaaaaatttgtaaggtttcccaaaagcactatctgatctgaacctttaagataagtaggaaataggtaggtaaggaatggaatatgttcagagtgggaagcagtgtgaggtaaaaagagaacaggtttggagaaaagaaaacacttctttaggatcagaccaaggagtgtggcagatattagtgtgaggtgcagagagctgttggcatctgtggagtaacttcaggcaggggagtgatatagtcagcttttcattttggatttattactgtagtctagtggatgtagagagaatggattagagaggagaccagttaggagttccttgcatcaatctagctgagaaacgatggctggaaatcatgtagtagcagaggacatgaaaaaaataaaataatggaatcctgagatttgaaggaatttgaactaataaatgtgggtgatggactggatgtggaaatgtagagtggttgaagataccctgtttggattaggaggtagaaatgctattctctgaaatatgtggtgagggtgaaggtaatggtggtaagtgtgtttgtatgtagggagagtattgcaggaaggctgagatatgatgacttttaattttctatttctatttcagacatttggagatgtcctaagacaattggctatgtggatagggagatctggtttagggaccatatcatacagacagtagaagccatggatgatctcattccaggagcacatatacagtgggaagagaatgaagctgaagacaattccagctccaaagatagtgacaagagctgttcatcttcatcatcctctctgtaggcatcttgaattagaagatactatttagtgtggtctcttacccaagataaataatctaagtttccgtaatctttcctcattgttctaattgtgaatttctttggaactttggtgatgttttctatgttcccatttagttctgagtaccagaattagacacattatatttattattatctttgacaaaaatagtgctaaaaaagccttcctaatatgccatatgcatcacggccgtaggaaaataggcgtaccacttgtcacttccctaaaacaggtgctcccaaaggcaattcctgcatgtcctagaggacttttgtgtgtgtgtgtgtgtggtctgtgtgtgtgtatttttaactgccgtttttgaaccaatgtaacatgatagaacatgtattaggatgtaattggttccaggttagttaagtaagaaatgcatttaattctttctcaccccttgaagaatatttctacttctccattaaataaatcagattttaaacaaaaatggaataatccctcaaatgtaattcaaaatacaacacacagtctcttgatttgtgagaattagctattgtacttcttcttttgaaaataaccctttaaacattaaaatcaacagatgacagctttagtaatctgagacaatttcatgaattgcaatatttacttatttgggaggatgttaaatgcttttaaaaattctttgtacctgatgtgaatatataataaatgtgtagagtatttcagttgcatgtaatgattgtgaagctgtaggaaaggtggctttcccaagtcttgagtgactgattccatcttttcttccctgactccttctctccaagtcttctaaaggtataacatctgcacagatgcagggaaggactgcactacaaagatgtgctgtcaatgagctttgcagactggttcttttccctctagccaagccttttttctttttatcctaaagaaccctggtctctttttatttcctggtcaatcttaatttttctaattttcaactcaaaaacactgagatttatctccatttctctgtcttaaagagaaatatacacaaagcagtcagagcattagctaactcagatcctattatgtgctaaggtctatctatctatctatctatctatctatctatctatctatctatccatccccttttaagattcacgacaaccccatgaattggtactattattatcttctcttaaacagaggcaaaggaaagctaagtaacttgtctgagatttcctggctgtaaagtggcaggaccaggcttacagtctccacagtttggcttttgagccaaccctcttaaccatcctgttaccctgcctttcaacagtgtaaaacaacaggagcaattttggtgtgctgcggaatgtaattgggggatctgggtcagaatggagaaaaagcaagagaaatttttcataggcagccaagaataaaagagcctaagagcatctacaccgatttctataacttaggctgtaagagaagtaggaaaagcattttgtttttctgcttaaacttgttgcacagtagaggaagataattttaactaaacttgtttgaggctttaagaagtaggcctcagagactcaaaaatcaaagtgaagtgaagtaaaattagcaattgttttctaaaaattcatgtaactcttagcaatgatttaggctttccaaacaacgtaaattatatatgcagattacttctaattataatgcctttccttctagattattgaacacttacacaataggattttaattgattctcaccagcctgcatctctagtgtttgattaaaaatatgcccattgtcaagaaaataaattcatttaggcatttataagcatttgtagaagataggtgaacaaaatttaaattaaaaaaatatagttatctacatttgaaagagttccttattatttaatcccttttgaaatatgcttagaatatcctttcaaggagatgatctacagatctttatttgaatctaacacttttaaacattttccctgatgtacagattcttgagttttgtttttgtttttgttttacattttgccactcaacaagaacataattcacttacagaattatttttgtgtgtctgtaacagctgtgattttccaccttactaagcagtttggaatttatcagtacatttctatttgtcttattttttaaatttttaatattttttaaaagaatatatggaatcgttaaatgaaatttacaagagttcattgctttggactgagttccagcactaggcccaacagaccagacaaaaccagaatggaatcgctgtgccacataatcaaactgaactttgaaacaagccagtttttcaaaagaggagatttacagcaaccaatcagaaggggcccagtttacctgagctggcatgataaggaagtcgtctctgttttaattccataaggaaagtaactttgaaacaaccacttctcttttgttcacggtttctgctttttcttagcccttttctgcctataaagccatactcctgatcagttcattagaacactcattctgttttctggaatgagatgttgcccgactttagaattcaataaaagcctattggatctttaaatttaagaaaaaccgggccgggcacggtggcttacgcctgtaatcccagcactttgggaggccgaggtgggcagatcacaaggtcaggagattgagaccatcctggctaacaccgtgaaaccccgtctctactaaaaatgaaaataaaaaaattagccaggcatggtggcgggcgcctgtagtcccagctactcaggaggctgaggcaggagaatggcgtgaacccaggagcggaggttgcagtgagccgagattgcgccactacactccagcctgggcgacagagcgagactccatctcaaaaaagaaaaagaaaaagaaaaaccaattatatctttaaatttgttgtaattttgtcttttgacaggatctttatgaagttacatgccattgacaatctttgctgtgttgttgtaacttcaggtatgctactgcaatgagcatgccagttggactcttagacaatggccatctgagtaagaaaaaatttcagttgttttaaaaaataagtgtggtattcattttgtaatttattaaaataacatttgaattttcaaactagctattccctgagattcagaagtctttttgcctgctttttttttttaagatgaagtaatctggctataaggaatattgattatattagtctaaggacacttacagagaaagtaagcttactgtagtgtgaatgatgcttctctttctattaagggtggtcattctaaatatgactgcataaggaataattctggcaaaaatcagtccttcattttctcttaagatatttagaatttaatttaaatattatatgtcaaggttaaaagttagaaacatgtaaggaaatatttaagaacttacaatatgaaaacctgttttctttatggaactctttggttatatgattggataggtaaaaacaaatttgtaaaatatggtagatatgggaaattgtcaatatatttgtaattcatgcagcaaacataatatttaggaagtatgttattctgttttcttaagtacataatgataagggttcttttctccaccaagccccttttctacatttgtggttttcatttttgctgtttttatgttattattgatagtatctcaataccaacctgctattgttaatttgtgacattccttatttagtctggaaagtggaaggtagtagatagttaaaagtttttggtgtctgatacagagatgtttatttaaaagtatagtaaacaaaattaaataaattgagatgtttttgaaacatggcttctctaactccgaagaactttgtgacaaaaaatgatctcttatgataatattttaatgtaaaatacaagaaattctttgaattaaaaaacattgtcttgattatcaccatttaggcatatattgaaagttctcatttaagtggtagaaattatttgaaatagtgttagtttcctgtggctgctgtaacaaaccaccacaaacctggtgatgtgaaacaactgaaattttttctctcactgttctggaggtcagaagtctgaaatcagtgtcgcggtgtggaagtccagatgtgggggagctctgctgcgttcccgcagaggccctggagaggaacctttctctttcctcttcctgccagtagtggccactcgccttctttggcctgtggttgcatcactccagtctctgcctctgtggtcacgttgccttccccttatttgtctgggttgaatttccccatgtgtcttttttataaagacatttgtgattcattttaagcccatctggataatctagaataatttccccatctcagaattcttaatctcatttgctaagaccctttttccacagacggtaacatttacaggttgcaggggtatctttgggggccatcattcagcctactctggtaatctttattcatatttaatcttcttcaaaggaaattgaagccaatgagaaaagcagtttcactcaactactctgagttggtgataaataaaaaatccctatttctccaactggtgttgcatgtaaagttacctgctatatattgccacctggatgggctgccttcgcatgaactaaattcaaataaacttaaaaaaaccaaattcatcatcttttttcctgaggtagcaactcctcttggctccgaattctccttttagagtcaccatcatcccagttatcgaggcttcccttggcagtcatctctgactctcgcttccttctctcccacatcctgtccttaaacgacctccctcttgagttttcacatacttaaaacatcaccagacacataagtccattgaaaccacctcaggcctttttaatttaaagactggggtatcatcatagcctcctaactggccacctcatgttagtattcccctatggcattctctcttatagccactgggttaatattcctgaaacactaccatggccatctaattttcctgcatagacatattgtttggctccttatttcatctgaagttaaatataaactcagcctggccttgatttattttgtagcgttatttctgatgctctcctcacctgacactttgggtccaggagcattgctctcttcacagccccctgggcgtgccatttcccacaacccgccacacccccacttctgacatgccttttcccaccttgcctttcaaaagtctactcacctttcaagatccatctgagatgtggcctgaagtaggacatttccctctctcatttctaagtaatgtctgccacattaccagcttgagttacacttttccataagcttgtcatccctttggaggatggacactgaatgagcaaagatgatgccttgtccattgttaaatttcttcagtgttttgcacagagtaagcatttaataagcatttctcaaatgaattttgtaaaggccaccactggaagtaatttgctgttttcacatcgatttgtatattcctcctttccatgtgcttctttgatcacatattattcataaaccttgtgactgtttttcatgcctaacatttggtcacaattttggctttttccttcttatccctccccccgcccaactggagtttaatttattttcctatatggtcctgtcagcagaactgttcagagaatttgggcaaatcaggacttcctgagagagttttacttgaattgcctgtaagtctgtaaatgttgtggggcatagaatgataggaaagacctctggttttcaatgctgaaggctttttattgttaagatatccaaaataggcatagcatgtttaaaagtaaaaaccctggacctgctctctctctttcatctgaaattatgtgtttgccagagtataatagctctagacaggaagttatgccctcagggcataattcttgcaagggagagaataaaaagtttagactcatgtcacatcctgaatctcaatcccttcatgtctgggcaatctgcagggagaacttttgttctagtcttctttgccagagagaactctggggttagcattttagtccacagtcccctgatgaatatttattgagtgcagagtgcaatgaggatatggaggtgaaggtggtgtggcctgtgtcttcaaggagcggtgtccctatagttgtcagaaagaaactccaggaaaatcctaaagagggagtttaaaattgcagatatcacagttatacaatcagtgttgaattatttccgttttcctcatgatcagaggcccctggagaggcactctggcattgtcctagtattactatcctgtggctatttcaattattgcttgacttcttcccaatgctttcactcatcttgtcatggtttgggctagaggttccttcactacacccactagcaaaggtgacaaagccagatttgtacctagaaaagtcactaaaatgctccattttccaactttccaaaaagcagcaatactgatcatactcataagtaaataaagctcattgatattgaattatctctacccaaaaagaatgtccatcacaatagtgttcataaatgagaggcccttctttgcaatacaaaggtaaaaaatgcaacataaaattgtatattgtgctggcaattaatttttacttattaatacattataacagttactttctgcctgatgtatttgtcatttacaaagacacaagaccttatttccatatttcagtcagtgctttattttgatcaatactgtattcatgtatgtaactctcatatcatactcttgagttatgttgaagttttaaacaactattagacaaataatgaatgttacatgttgggtacaagcatcctttgaaaaatcaagaagataaaagcaaagccaagagtatatgattcattttaatgtaatactgggataaaaatgtgaggatgtgatgtcaaatggtaataaatgctgagttttcccaatgatatgagacaaatttgacagaatacaaaattttaggaacatgtttataaactaaattagtctaatgttcaatgggaaaagtggaatttgatttatttatgttttgctttactgcatttattaatttttaaataccacacaatttattttcaaggtttatttatcttcatgtttacttgatgtaattctattgctcattatattgcacagagcttgtcacctataagaataagagttctatgaaaatggatcattttaatgtgataatgaatggaataggagtttagcttcatttcatttttcatgatagaatttgtttcggaagttcctatcctccatatcaatgtcacgcccaaatatttctggcttaataggaacttctgaaacaaattctatcgagaaaaatgaaatgaagttaaattcctattccactctctgacccccgtctctcctctgtcttcctcctggcctcttgcctccccgcccttctccctccttccctctcttctttctttcaccggagggcactacagcatttaagcttacacccctgattgaggaccgtccctttcttagggactccagaagaaacacctgcaatgttgagacacgaaaggcaagagtgatcctggaaagccaaatgggtgcctgtagaagaggaaatgatgcacagggattttgctttgattcatcaccaggttgactaggtgaccaggcttcttaccattcatgtgatctgcacctgtgatcaaaagccttctttatattctgtgagaataaaagaggatggccacaaaatattctataatcttctcagtgtattgtacttcatatctacaacaatattttgagcacctactaatataagggactgtgccttgtatccaagatagaaaaaataaaatagctcctgctctatttggggaagaaggtcaaaatcagggtaagggaatccagaggaagcaaaaactgatactgacggagtctgtttaagtaaaggcactgaattgtggaaaggtaaaacacatatgaagactggaattcaaataagaaggtctcccaaaagctgaaatgcagaataatgatggtagataaaaataatctctgacctgagatggtttttcatactctacaaacaagatgggatttgttaatagaatacacctactgaaaaatgagactggagggagctggtgggaggaaggaatggcctgagagaacaggtgggggaagaatagagattcagaaagattccatcaaacacttttgcagctgccgttctatactggtttgaagtcctagtttgccttgatttacatgtgtctaacagttgactctactggtatatgtgtctccagctttaagaagaagaaaaaatccactctaatgacggatattagttgccacttaaagatgctcttcagatactagtgttccagttaaccattaaagatatataacccctgtacaagttggcaaccataccaggtcattgatttattatcattaaactgcctaactagtagttatgttgagatgaatgctgggtaaaatattacaatgaatgctaaatgaaaaatacatctcaggcttgtaagctcccaccttgtgtagtatttctgtgttccctgacaccctgaagcctaatcgtgccttctgtatagttttacatgtgtagactctcttcttcgttacgatttgccaatcccctgttgctcacattgtactacagcaataatctttgtcatttttgaattggtgtccaggtggttgctgtcacattacatccatttttaaatgttgctcaaacccactgaggtgacatgcagttttccaacagtgtgaattttttttttccaaattttttctcttcgatggaagaaaaatttgctgtcttctttgacagctggacaagtagagattgcaatctcctttccctctcagtattctctggcaacatcatgaataagcaacattttagatggttgacttccaaaaaatgtttcttgtcaagctcctgtcaggattttggaagtcagggaacaacttttttccagttgtgattttctataatttcatttctgaagtctgaattatgatttttttttctttctgggtttttttttctgtagtaaaaggcaggatgggaagaaaaagtagctcagttcctttttgtgttgatgtagagggtggtacatcattggaaatctataatgggattttctaaactggtagtttaattattgttatattttaagttgaattatctctatcatgagccaatgtctaaataaccttacagtaatcatttttatggtatcagatgattttttaaaatattattacatttcatacttacaaaagatactgggaaatacattagacatttcagaatttctctcagttatgactatgagaatgaaaagaaagtcttttaaacagtcctgggattttttttttctgctgctatctagtctacttcaagttgtaattttcagtggttcttgttggtaaccccaatttaggccactctagagataggcctcgacaggattatatatagagagagagctcagcttagtcgttgagagcatggactcagaagatgggccagccctaaacctgattctgccaggattcatgtgaccttgaataaatttcttaccctctcatttgctcagtttcctcatctgtataatgaggataataaaaatcatatttactccatgaggttgttgtaagaattaactgagtgaggctgggtgtggtggctcacacctgtaatcccaacactttgtgaggccatggcgggaggatcacgagatcaggagatcgagaccatcctggctaacatggtgaaatcccatctttactaaaaatacaaaaagttagccaggggtggtggcatgtgcctgtagtcctagctactcgggaggctgaggcaggagaatcacttgaacccaagaggtggaggttgcagtgagccaagatcgtgccacagcaccccagcctgggcgacagagcaagactatgtctcaaaaaaaaaaaaaaaagaaagaattaaatgagtgaatatgtgttaatctcttaggttagtagcacatagtaggcattgtgatggtaaaataatacatacatacctaatttatatccagcctcacattttggtactgggaaactggatatcttgttcaacagtggtattcatagtttaatctcggcagcaacaaagtgccctggggttcctgactgaggtagaagaatttataagtgtaagctgtttccattttagtgtagtctaaggtaaccctctcctttctttttttcctgttatgagtaagcttaattttttttaatatatagagtttacctttaaagaagttaacacatcattaagatctaggtaccttcttcaactctccccattcactcattccatttcaatttcatgtactccaatcaactttggtatgttttgaaatgttattattatttatccaactttagaaggttctggtagagttagttcctgaggctagggaaattcttttaattaataatctttctgttaatcaccccataatctccatcagctctccaatccaccctgtctgtggccagacaggactgtggtttagttcaattgccgtcaggatacacatacgcaattcagtgagaattttgccaccatttttcctctttcagaagttgattacagaatagccatcattcaatgaaagtctacaggcttctctaattctcttgcagttcacagtcctttagccaacagcaactctacaccatcaaaagtaggatttactgaggtatcacttaaattcccccttgatttaagttcttaagtttcaggaccacttaagtattatgaatgacaaatcaacactcacatagtattgcagaagtatagcttgagtaagtctaatggggaacactttttttacaagctcagggtaggggatattttttgtcactccctcaagcaagcgaactacaccagtagaattataaatcgttctcaactctccctccctttctttttgttccacctccagaccatagtaggggtttaaaatttttggtgttgttgtttacttttttggtacttcggggttacctgtggacccctttccagaatattttacaggcatacgataaagtgcaaaaacttacttaggaaatcagttttatggaaatatactgatcacgattttgaaaaatgtgaagactaatttatgtgcttttattttaacacattaaataacaacagctaacaacaggtcaaaaaatcactgcaattcccaagtactgatgggtataagtgaaatattgagatttctatagcaactggaatctaataggaaaataactgtgatttctgctgttgacatagtcacaagttttcctgaaactactttgcttttttccctcattcacaagtgaaggaaatgggaagattcactcagagattagtgaaaaggatatttttttttctaagttcatgaaccctaagtccctgaggatgcagacatatatacatctagttttctatccctgaggagctttatagtctactgggagagacaggtggcaaggtcaaagagtgctgagaagtggggccactatcaccccataatcttcatcagcccttcaatctaccccaaattatctaatacaggcacacttcagagatagtgtgggtttggttccagaccactgaaataaagtaaacagcaataaagtaagttatgcaatttttttggtttcccagcgcatatggaatttatgtttatattctactatagtctattaggtgtataatagcattatgtctagaaatacaatgtaaataccttaatttaaaaatattacttaaaaaatgctagcaatcatctgagccttcaacaagttgtaatctttgcaggtggaggctcttgcctcagtgttgatggctgctgaatgatcagggtggtggttgctgaatgctgggatggatgtggcaatttcttaaaataagaaaacaagtttgacacatggattgactcttccttttatgaaagatttatctgtagcatgcaatgttgtttcatagcattttactcacagtagaacttctttcaaaatttgtatcagtcctctcaaaccctgccactgctttgtcaactaagtttatgtaatattctaaatccttttttgtcatttcaacattgttcatagcatcttcaccaggtatagtttccatctcaagaaactattttctttactcatccataagaagcaactcttcattggctcaagttttatcacaagattgcagtgattcagtcacgtatttaggctccacatcttcaggctccagttatcttgctgtttccaccacatctgcagacttcctccactgaagtgtttgaagctgtcaaagtcatctgtaagggctgaaatcaacttattccaaacttatgttcctgttgatgtttgaattttcttccatgaatcacaaatgttcctaatgatatttagaatggtaaatcctttccagaaggttttcagtgtcctttgcccagatccattggagtaatcactatctatgtcagctatgggcttacaaaatgtattttttaaataataagacttgaaagtcaaaattgctccttgattgatgggctacagaatggatgttatgttagcatgcaagaaaacaacattaacgtctttgtacatcttcatcagagctcttgggtgactgaatgcattgtaaatgagcagtaatgttttgaaaaaaatctttttttctgagcagtaggtctcaacaatgggcttaaaatattcattaaaccatgctgtaagcagatatgctgtcatccagactttgttgctccatttataaagcacagttagagtagatttaacatagttcttaaggaaccaaggatttttggaatgctcagtgggcactggcttcaatttaaaatcatcagctgcattagcccataacaagagagtcagcctgttctctgaagccttgaagccaggcattgacttcttccctctacctatgaaagtcctagatggtatcttcttccaatagaaggctgttttgtctagattgaaaatctgttagttagcgtagacacttttattaattgttttagctagatcttctggataacttgctgcatcagcactcgctgcttcactttttacttttgtgttatggagacagcttctttccttaatcctcatgaaccaacctctgctagcttccaacttttctcttccagcttcctcaccattctcagacttcatagaatagaagagagttagggtcttgctctggattaggctttggcttaaatgaatgttgtggcaggtttgatcttctatccagaccactcacactttctccgtatcagcagtaaagggctgtttcagtttcttatcattcgtgtgttcactggagtagcacttataatttccttcaggaacttttccttcgcattcacatcatgggtaactatttggtgcaagaggcctagcttttggcctctctcagcttttgatgtgcctttctcactaggcttaattatttctaacttttcatgtaaagtgagagatatgcaactcctcctttcacttgaacaactagaggccattatatagttattaagtggcctaatttcaatattgttgtgtctcagccaatcgaaaagcccaaggagaggaagagagatgggcaattgctggttggtggagcagtgagaacacacaatatttatcaattatgttctcctttttttatgggctttattggtggtgcccaaaacaattgcaatagtaacatcaaagatcactgatcagagatcactataacagatacaataataatgataaagttagaaatattgcaaaaattaccaaaattgtgacacagagacacaaagtaagcatatactgttggaaaaagtggtgctgatagtcttgctcaacacatggttgccacaaaccttcagtttgtaaaaaaaatgcagtatccgtggagcacagtaaagtaagctatgcctgtatttaaaaaaataaaataaaaaatagaataaaatcttaggttgaatattaataaaataatgtttagaaaacattagtatttttactgttgcataacaaaatatccaaataaaacttacatgttttatatgtgaatgccactttacataattcccttagctctgctttcaaagtactgttgctgcccaatgtcatatccccctccatccatttttctatatggaaattctggagcccccactgggttttaaaacaaaaaataggttaaaagttaattgcagtctcttaacattattattatgtcagtgcaatgctgagaacttgttggttgagtgatggtggcagctgttacacagtggtcatatggcagattgtaaccctgaggcctatccacaattcaaagctcatgtcattgccagctagtgtgataactcatacctggcatttttgtttactagtgcaaatggcactgacattttgtgaaaacattgtaaaaagtttgattcatttggtctatttgaaattaagacaggcttgatgagctctaggagcattcacaaatttaaatttataaatagagatgttaaagtattttatattactttgtgtcataccattcataatgtactcttccttaaaagaaagaggaaaagaaaggagatattaagttaagtgtgttaataggttataccagtgtttgcatgttagatagtcatgtggtttagcttgttacttggcatatgtggccccgattgtcacatgacaaggcacctgtggtgactgtcctttgttcacagctgcagcctcagctcatgccacagtacctgaaacctggtattttataaagatttgttgaatgaatgtatgggtaggtaaatgaatggatagttggatgcctgggtgtgtggatggatagaattttttttaaaaaacccaaaacttccttaagctgtagttagtcatctataacatggaaataataatacgtaactgataagattattatgtgaattaaaaacaataatgtatataaagtacttagcttgcatataagtgggaaataaattgtagcattaataaaaatatataattctggttctattaaataactaaatattttttgccaataattaaaactgactgcttttgtgagtctaagaaacagcagtgaacttggattacagttttatattctttgcgtctagaaagtgatgtttcatcacaaggcaagggctttcttctcatgacaaagagcctgatgtagctgcttaataactgttagtaacactgaaaggatctacagtaaatctgttagaaagctgtgatcaaaaatgtgagtgccaatcttcaaaagcccatttcaaagcttgtttgctataatactatgtagtggtttatttgcctttctttgtaactcattaaattaaaaatttggatccatcctcatggggttttcagaaatggttttataatttagcattccaatgacacttcttatttgcagattattatatactagtttttttgtcccactgtctcaccccagtgtagattattaagtccatatcattgcaatttgccaaaactctctggataaatgtctatgagagccaaggctccattttacttgtttatcgaatatggaattaatgaactatcttgaaacaatgtttataactaatgtttatatgacagaaaattggtgctgatcgtagtgtacatatgcaaactaatgctattttgttccccttgcctgaactctggctacacaggcagaattatattgctgttgtgttcaaacttcaaatacaatagtaactccagatgccatttttgtgttcttgtgaacttggagtgggtaaccaaaagcaaacaacaaaaacaaacaaaattgggacaggtgagaggcagtggcatggaagggagtgtaggcaggaaacaaataatatgatgactacaggatactacattctgatgaagactttacacttatggattgaacaactgttagaaaaagatcaaacatattatttgcacaggggtaatgattattttagaattacttcctgtcagtgataaatagctttatttaagcaaaatccaacctcttgaaattgttctccccttcagtgttatttttgtcattattttttcttcacttaaattacatataactgtaaagctctttgaaaaagtatattatctaaatgcatctatttaaattgaatgggtattaaatttattaaacatatttacaaaatataagtaagacatgaatttaatatgagtctgttgaatttttcattgtagttgaatgaatgaataatatattctagtcagccttttcattttctggtgcttctttttagcacccatagactttcatatattgtaaacattttcttctctatatctagttttagaaaataaaatgttgggaacacagaattgacttctggagactgggaagtatataactaaagtaatatgtgtttgctttttctaatttaattttgattgtggtgtgcttaatttataatcttttaaaatgttttaattttactcaaatagatctgtacatactttttatactcaattaacataattatttagctatcatacttccgtgtgtaagatttctagagcatcgccataatgtagcactttggtttgcaggagagaaattttcatggtacattatttacttgcattcaagtgaaaatattgttaatattggttgcatttgaaggattctttcaaaagtacgtggtgctcaagatggatttaaatggaacatgcaagagacagtaataacagagagatcacattctctctgtaatttattttaatgccattacacagggaattcaaggcagataaaaaactccatttacagaaaccaaatgtgcagaaatggattgtcataattccagatgaaatcaataatacatactccctggcatattttttattagaaataacttggaaaaatttatattttctactaagtaaatatataagttataagaaataacttatatattaaataaataagttataagaaataccatatattaaataaataagttataagaaataacttggaaaaatttatattttatactaagtaaatatacaatcatagccttaagatcttttgcagcattactttccccttgatgaattacaatgcaattttctagcctactcattttattaaggaagctaatgactggagcaaaagtctaatcagctgccaatcaggattccttgaagtgcagagtgtcaaatattgaagcaatttttacaactcataaaagcacttatgttccatggtatgtcataaaacttgtgatgaaaatctagcattgatgaagctaccttatttctcaagtgtttttccccaaacaaacagctttcaaatttcaccaaatctttcattaatattcaagtctattaatatagcactattatgttatctgttatagtattatattatccaactatagcaagataattagttatatataaacgtcagtcagagaacttagtggattcatcataaaagctgtaatggtggaatttttttttccatagtaaaaaaattggtctttcttctgataatgttagagtgggtttttgtttttatgttacagaaacaatgaggctgcacactttgctttcaccctttgcatcattatgtttgcattgtttatttttaacataatggtacattgtttcatgaaaagtaaccatatttcaaatcattaattcacttgtcatttatcattttaataccagaaagtagttaccttcctgtgtttgaaggtactgtataattgtatttctttaccatgtcgacttcctgtctcttaaaacgcagcaattacgtgtgtgtttgtgtgtttcttcatctgcttcatgcatataaatatgtgcgggtgtctggggttttgttgttagctgagaggtgggaagtgtttccacacatctgaatatttgctgccgaccttcttgatgatccgtctgttaatgtttttatcaagctggcacacctcatgtgggatcttaataaagtaatcagcattttccctctaaaacaagtttgagaaaatcctagttaaactattctcttcaacacttgaaggccttggttgtacagcaagcagctactaattcaggaggatttatttggcttttcctgagttctctgaaaaatctatttgtgtaaaaagaacatactgcatgatccccagggctcctggaactgaaaactcaaggatttagacgaagctacccagtttgtttaatcatttgaagttttgtttcagcagctcatgctttcctcttacattttggcagaggcagaaatctcagatgattgtttttgggtacacatgtaaaaattttctcattaaccttgggggtggtgtaatgataaaagagataacattttgtttcaaaaaaataatactaactgagcacatatttcaatgcattgcaaatctgaaggaattgtcatggctaacaccatctcagtctcagtatttgtgccccagttttttttcaggtcaagaatgtagggaaacactgtactaagttctcattggatcccttgatgcctcataagacacccagacccctagctctcaatttcatttctaaatgtaccccagctactagaatctctctcacaatgatgacaaacatcctctttaataggacagataaatattcctgtcactcttgactgagagacaatactccaggtctaggggacatgatctgcaaggaacttcccatgattcaggcaccactattcctgttcattttttttccattgtcccgggatttacagctttcaggagtaccttcatgttactcttctcataagagggcaacaccatatttttctcactgaatcagaagacccaacaccacctctttccccagagcactgccatttgcatcctatccagctaggtagggcaaaagtgtctttcattagactaaggacctccacaggcagtgcttaattttcatttacctttgcctccatagtgccttatatgtagtgcctaaatacggatggtgggtgactgcttagagtaataatagctaatatttttgtgacattagaaatggacacagtggtaatacaggtcaggattataactcaaaatcttggcaatgtgatgtttattggaacaaaggaacctaaagatcagaatgctttctctatgtaagatgactaggcctgtaaagtagagtgggtcactattctacagaaacacagatatcaatatttacattacaaataagatatattaggccattcatacaatttacaaaatggttcattataggactcactaactgaaagtacccaggtgacattgaacgtccagtttattttcaatataatcttcctgaaatctctgtattaatttggaaaaagtcaacaaagtaaaccattcttaatgtaacaactggatttaaactagggaggatcaaaatgtttaggtaacagaaactagcagtccaatgtggatctttctactttctctctttttgcctttgcctttgtctacgtctactttctctcctttgcctcttctttgtttatttaaacatatatatatatatatctatctatctcacatactcagaggtttattgcttagttttgttttttataaaaatggagtcatactatacacactactctgcaacttatttaagagtatactatgaatattcagttgggtcttattaaagatctaacatcctttttaattgctgcttaatattttgtactttataccattatgtatttaaccaagaatgtctttattaaataatataatcttcacctatgccagttaatctgttattcttagtgatttaagctcctttctctcatctggaaaatacagcaataaataggtaaaatccacagtttctccttcaagtgctacgtgcaataggcccatgaggtaacccctgaaattcatgttttcttggaagtaatcagcagacctggagtcctgtgtatgtttgtgaactccagaggtccacactccttcacttcacactcagtgtcctccatacttagggcttctacccccctgcccagttttgttaaagaaattactccttgggacatggacaaaataaaagaaatagccatttgtgtttctgtatccaacacttctttgtcctgtcatgggttcagttagttctaccatgaagtatggactgtctggtaagaggaaagagttttagagattaatgagggtagcactagtgaaactagtctcaaagatggcatagtcaatttcctcagatatagaccaatactgatatctaaaaagtttattcttatgggtagggatgtctggatgatagcaatttaagtcttcaagggagagcatctccgttgcttataggaacaatcatctggactaagtcatgaccacagttctaacagggaaagtaagcaagatccagctcccgaagaggagtttgcattggctgcaaaggggatccaagaccttagctcagtgagccaagcttcagggaaggactgcagttcccttagggacatagaatgctaacaaagaactggttttggagcttggtcatggggctggccatacatgttgggggctggcatgtttatatgacaaggtatttaggctttccacacctaaatattcagctatatctctgtaagtgcatagatccctaaagagtttgccctgggtacattgtgctggttgtcagataagaataccgaggctaataccagggccctccctttgttagaactctacatctaataaacacccaggcttggttctcattgagtcacaggctgggtggggctgagcctacaggttgaatattctcagttcttgactctggatccaggtggagtatgcatagactgataacaacttgtttttgcagtaagtctgaagattaaagcccttagttgagccaataccttccttctcagataagtcaaatccacatattcagaatgggagcaggaggcagaagggaaaattttgtaacctcttaacagttctagacttaacacatcctactatcaatctgagtggatttgttccagatgcttgcatggctgagatatgcaaaaaactgtctccccatgctgattggtagcatctttacatgggcaagtcttcctacttgtaaagaatgagttaggtgtgtctgggacttactaaggagtctcaggtgttgacagcttaaacaccttgccatgtaaatatgtctgatctctcttccagttcttacacagttggctgtggttactgacttcttattttgttcaggtctaaatgaaattgatcttgatctattactttaccctaggctggagaaacaactttagtaattatctcctcacccctacttcccttttgagctttgtaaaaatgattaaggagatcagaatatatggcataaattatcaatggttcttctccattggaggttagagttccactgtcaaaaattagtaattatcattcttcttacaagtttaagactcaaatggaactgactttttcagcctatttgttgtctatggtaaactaacagcaaacagctggatgttcttctgtggttacataaccttaatggagattagttccttttatccttctatactgcttccctaccaaatgattagattttttgaggggcagatataaaccccttccattgtttaaaaaacattgttaataacccttcgcactacacaccaaagtgcagcctttaatatagttgccagaagcagttctgagtgaaacactgaaatgaaaagtaaactcatgtcatttggtctatgataagcattcacagtttgaaaaaccccaaacagggatagttaagttgcaagcactatttccagaatgagagttgaaaattatatacataatgtggaaacaatagatcaatgaaagggagtatagaacaaaagagagaagaatttccatagccactccatagaatattaggtctatagaatgtcaagaggggttatgtccaaaacagggttctaggatcagataagtttggaaggtacagaattaaatgtcattaaatagatttacttcttgcagtattactcattatgcactgtgaatttccaagacagggacagcgtatgctgcatttcccaaacttgtatggtctgatgaatccaccgaagacagtgcttttatagggggacgtcatgatgccaaagagaaaagagcttaagaaaggagttcaacaggtcaagaagattagtgcataggaacttacagaggggaaattggtgcctccacagcattagttagaactagaccctgatataataggggaccagaagaaaggagggcatgaggaagagaggactgggctgcacatcctggctttgactggaacatatttcccaaatccttggtgatcaaagccaaagtaaatacaaccaaggttatataggagtaataagtgatggaggtagggagtcagctggatgaggcagagactggaaatccttgttttgacctcaagcctcaatcctgaaccatattgctatattgaaatatagtcaagaaatgaatgtatcatgcatagtggcatgtcaggaagttcaagtgtgagaaagccactttgttataggcccaattcctggaggaggatatatgcctctccagatccatttggcttcacttgtctccacagctgtggcaatcagttctgcatggactccaactatcttcctgtggggactgccgaccagtgtctcatcaaatcccattcccactgcggatttctgtgttggtgctacctggggaactcaggctgaggcagtgtctcacctaggtagcagcctctgtttcttgtttatttagagagtaattatgaattcataaactttcatattattacaaatcttactggagtatctagtaggggcttagttatatgctaaacagttgtagtttgaaaagccataataactctggttatttgacagatatcaaggcagggcaaagagatacccaactagggtaggtcatcccatcaatattttggaaacatatgattgcctcacattgtatatccttatcattgttttcttttaattattttacatataagtttagacagttgactgttgggaattcctattcagagatttatcttttaaccccaaatgattaacctgtaagctgtgactttcagtgttctggtattaacaataattttacacatttcaaaattatagtggaaagtaattttaccataatattttatctcatataacaagagcatggtatttcttttgtcgaactgcagcttttgtagataccatacacattattaatttcaaacatatcatttattccactagaattccattttttcttacctaatttatttccctttttaatactgagaaaaacagtatgagattgactattgaatttaataagatagtaacttaacacaataactaaaaacattggaagtttaaaaacaacagttttttcctaaacctgactcgaaaaccattgacattttagcaaacagatgggttttatgtaccacataatgaggtcctgggctcactcaagaccaccaggttgaaggaattctaaagctggagatcttttaaagatggcaaaatgactatgagattatctaaatatataattaaggaaaatagatcttttctgtttgtccttggtaaagtcctcaaggttgcatatgaccttccattaattttcttcagtcccaataggtgtttattttgccactgggaaagaattaggatttaggtaatgtctttgcctcacacttaggcttcctaacatgttataatgcactctatgttcatttcttgcctgtgttgcagtatagcaatatggtgaggactaaggtttagagtcaagcaattcaggatttccagtctctgccccatcatttattagccgtgtatacccttggttaagctgattaccctctctgagccttagctcatgaaatgagggccatataactcatatcactctgttgcccaggctggagtgcaatggcgtgatcatggctcactgcagcctcgacctcctggactcaagccatcctcccacctcagcctcccaagtagctgggactataggcattcaccaacatgtacagcaattttttttttttttttttttgagacggagtttcgctctgttgcccaggctggagtgcagtggcacaatcttggctcactgcaagctccgcctcccgggttcacgccattctcctgcgtcagcgtcctgagtagctgggactacaggcgcccgccaccaagcccggctaattttttgtatttttagtagagacggagtttcaccatgttagccaggatggtctcgatttcctgacctcgtgatcttcccgcctcggcctcccaaagtgctgggactgcaggcgtgagccaccaagcccggctgcaattttttttttttttttaagagatgagttctccttatgttgcccaggctggtttcacactccttgcctcaagtgattctcctgccttggcctcccaaagtgctgggattacaggcatgagccactgcaccttgcctactataaaccttaaatgatataacgtgttacagcagactgtgttaagagacctcatttgtacacctcaggtgttctttactgagaacacttcctattccttgcctttattctggctgcaggagcatggttggctcattccaaggcaaactggaagtctacaaaagtaatgcctcaaaaagcagtcccctatttagaatacctctgaggcatgttttacacgttttccagagttccccagcagaactgatgtccagtcgcccatagaagttgcttgcttgacagtacctctttccctttctttcctgaccgcatttctttgtccccttctagtaggtttcctgggatctcttttcaaataaattacttgtaccccaatttttgtctcacagtctacttctaagggaaaaataaggtgtgaaaagcacttagtattgtgtctggcacataatatattataataattattaatttcagaaacatatttaattcgttcttttttagaaaaagaaaccaaaagtgctatatttttgtaaaccactctcatggtagccacatcagttacagttatttttcattttctcttattgtttttaagaaatcattctttggctagtctcggtggctcacacctgtaatcccagcactttgggaggctgaggcggatggatcacctgaggtcaggagttcaagagcagcctggccaacatggtgaaacccagtctctgctaaagtacaaaaattagccgggtatggtggtgggtgcctgtaatcccagctacttgggaggctgaggcaggagaatctcttgaacctgggaggtggaggttgcagtgagccaaaatcgtgcctttgcactccaccctgggagatggagtgagactccatctcaaaaaaaaaaaaaaaatcattctttgaaaacttgttttctatttgaacagcaaaaccaggttcaacaagtgaatttgggcaatgactttacatgcactaatttttctgccttttaaaatacaattttctgacacctattttggtctggcagttcatctgaaaaataaaagcagaattttaaatgtgtaggtaagaaagattctattagtttccgacagcactgtagaaaaacaagagctctctatttcactaaaagcgctcagttccccctttttagcaaacactgaacattgatagtgtgttatgataaattaactacaatacctttggaggtcaagtgtctcagaaaaaagcaacagtaacatcttaggcaaaatggaaagcattagattcacacctgtaactcattaattttaaccaagagttagatttcacagaaagcaattactaggatggattgagttctttcatacacagggttgttttttttttaattgtaagactgttaaatattttctctgactatagttgccctcagcaatatccagaactagtggctatggattacttcattgtttctttctttggtaactgagaaaggtttaactatttattacaacgtttaaaaagttagattagaagaaaggatgcttccatctatttcatctttgtattctaaaagagtgtagctctactgtcagtggaataacagtgtgataaatgcactaattacatctgccatacaaagcttatatataaatccaaagtggacactgtgtgtgtgtgtgtgtgtgtgtgtgtgtgtgtgtgtgttttgagggtgtgcttgtgtgtgttcctgtctgagttttgcttctgtggttgttcatttgttaacagttatctgtttacaagctctttaaagatgaataacttagttattcaaacatgataaaatcgtgtttggtcgggtcttggtgttaaaatttacctgacctgactcttctcaaatgtctctctttacaaattccagtaactttattgctaagctataagaggaattttttagcttatttttgctttgagtctgtttttaactttctacaaataatttaatatcccttctctttgccttttcttaatgaagcagcatttctatgtgtctcctttcagggatgtatgtaaatgtagctatattgttgatagattaacataataatcaaatagaaattaacttcctgtgattcatcagtaaaactctatggacctacttttactcaaaattgttgctgtcaagcatttcaggtatgagttaattggctttctagaaaatgatagaggctatcctaaatctcaaagctcaatgatatctttttattttctgagatgccatttgtcaccatagcttattatacatgggctgattctcactccctggaaatagaaatgaagaaaggagctgtagggtcccctgccgccttctataaatgagcaaatcaaggaccagaatatctgtgggactcctccagaagctcttacagttacttacatagctaagtaagagcaaaggctggaagtagaacccacttttcccatagccaatccatttctcttttctaccaggtgtcttgtggcatttccccaggggactacatcttatctgctgtagtagaatcatgaaggtcatgaaatactggagctacaagagatttcggaggtctgctcccccccacccattttatacttcagaggaagaaactgagtacagagagttgggttgactaagaaattcatatagccaattggcgatctccttatagccattctaactttaaaaaggtggggattaaacctgctttcaaagcacaacctgaactgttccctcatccaagcttaagagagaatccatgacaccatataaaacagctctttatttccactggcaacaatggatgtatcctagttcatttgaacattttcctctctctatgatataggttagctggtttatttctatatccttgccaaaactggcagtgcatataggctgaaccatgcttgtggagaaaacactattcatatttcattatattaccttcagcagccctttactggcattatgactaaaacgcgtgtctccgagttgttgctggagaaatggccggccagtgaatttcgcgtcagaccagtgactattccagttgatatgaaagatgtcattactctgggggttatattgtggtcatcaggatattttctagtactcctggttcagaattttggagtattcatcttgaaaattgatgtctgtcctctattttggggggagattttctgtgtgctgtcttggctttctttgtttcctaggctataggtaagagttaagacgtacatgagtgtcttctagttaataaacctcactgccttctcacatggctgctgtacatacctgtcataacatgtatgtgatatactctctcccacacatacctatgcacacacagactcacacactctcacaagaagggaaatacataccattcttgccataatgttatttcatacatttgtgctttatttaacatttttcaatgcattagtattatgaactcttaaattaatgtaccaaagggcatttacataactttgaatatgttgattcaaaatcattacaaaatataatctaataagttacagagcctcattcaatgattccagttagcatccgcttctaagcgtgctattacttattcattagtagaagccctttaattttatattctgctcctggcagttgtggcttatttggtacttgttacagccactttagacaagtaaataaaaatcagatgaaaaatcctcagcaacagctggaaataaaccagtagtttctgtttgggtttggcagagtgaagcactgcagggctatgcatggaaaaataccagccagaactgttacacactgtgagaaaagattacatatctctagggttttggccttctaattactagggggtttctttgtccatgaagagtgccacctgcgtggttgggcaacaatataaaataattaaatcattatcacaagggtaatagtatacgtctttctggtttagctgtgataagaaaaccttaaacctgaaatacattaaacagtgtagaacatatgaaaagcctctttgagaggcttattcttgttgttatttaaaattttccttcactaatgtttagttcaaatacatgataattctagggaattacccgtctttatcagaccacccaaggaaggaagatgctctgccaataagtaaagccattggcctgtaagaacttgcttctgacttctaagtcacactcattttgataagcagatgtcttctaaaatgactgtgtggcttagcatactgagctgtttttctttccttttccaagacagtatggacatagttaaaaaaaaaaaaaaaagacgaaagattgttaagtacctgataatttcaataacatatttgtagtaactgcattgcagttaagccttatttaaagtaaattatctattttgcatccttttttttcaataaacagtttcacttctaagatgatgagggaaaaaagatgattaaggtttagcaatcttgttgcaagcttatttaaaattagttgtttaattatctacttcagatattattttgccaactggttatgttcatgccctgattaattattcttttcttccaagttatactcattttggaaaaatcaggtttagccatagcatgtgaagcccttaaaattgtctggagacagatatcttgatctcagaaacttaaattatcttaatactttctggagtaagaccaggaatggaagaagaagagagaaatatttctttatttttcctaattttatttcttctttcagcagaggaactgtactcttaaaattagagggtcagagcccttgctctgctgctgaatttatctcttacttgaggaattaggcacaatctaaacccagtactatttatttctccctttagaaattgaggaagttacctatggctaatatttttcaaatttatgtattttgtttgtttgtttgtttttttgggagatggagtctcactctgtcacccaggctggagtgcagtggcacaatctcggcccactgcaacctccgcctaccaggttcaagcaattctcctggctcagcctcctcagtagctgggaatacaggcacatgctgccatgcccggcaagttttttgtattttagtagagatggtctttcaccgtgttgccccggctggtctcaaactcctgagctcaggcaaaccacatgcctcggcctcccagagtgtgggattacaggcatgagccacattgcctggcctcaaatctacattttaaaaatattttaaaatagcgattttcaaacattaatatgatcagaatcacctgcagggcttgccaaactctagactgttggattccacctctagagtttctgattcggtaggtctgggatggatctcccaaatttgctttctaaaaagttcccaagagatgcggttgttgctagttcctgagatcacactgtgggaaccaaagccttacaataactagcctttttcatgagagaatggtaaggaaatataccacatatcaagagaagttatctcttgggttatcggaatgttagtaattttgtacttacccttttttcctctattctccatatgtcctacaagttatgtataatacatatatgattagaaaaaataatgaatgtttttggaagaacacttgttgaactagaaattcattaatctctattcattcttcccttctgatgtcttgtagcaatataataatgtcagttctcctcacctgctggggacagacactcctttcgatgtcttttgagggagctttcactcagcaaccaccagacagttgcttggttccttttagagtgctgtctttattgtgccagaatttagtacaagaggtgctggctctccaagatgagcaaatcccttaattgtatttcaaaaattctccccagttttttttctctctaccctcctcaggttacaatgctaaaagttctgtgtgggcctaaacactagtgggaaaaagcgcctggtgaacaaatgctgggtggcatgcccactcagacataaagaagttctgctcacccttttgggagtgtactcatttttgagaaatttgcctcacttagagctccttaaaataaatcaaacaaaattatatataaaatatatgctttcacaatttcagccatttcttttggtgtttctcttctaataaccttctaaacgttgttgctttatgtttttatctcagatttttgaaaacaaactaaatatagcaccctaaaaaacctttcaaatattttggattcttttatttatgactcttacaagcatgtgagggggcttgtttagagagaataaaggttataacctggtctgtctgttgagacagtgattttaatcacatttaattcccattcactctgtatgttacttgatccactcattggtttaaaagcatattgataaatacagccatggcttagcctcttgcccttcatcccgtctagagttgcatccaggcttaagtgagtttgccacatttagatgtcatactttgttactgatgagatccttgctagatagtggagcctatgtttttctagagaaaagtccatattccattataaagataaataaataatttgtttcagaaggctttcaagatgttggcttatagtcaaactataagtaacagcttgaaaaacctcagtgcttctcacatacatgttaatggctgttctccttcataaatactttgaagtgtttcagtaaatattttcctaaagaactttaacttatttgctaacttattgagtatcaaaatgtatgttgtatatgacactatgctaggcatatatatacaatattatccataatttttctaaatttttttgcaaatcagataaatttttattttaagattcagggggtacataagtaattgttacatgagtgtattgtgtgatgctgaggtttgggcttctaatgatcccatcacccaagtagcgaacatagaacctgataggtaatttttcaacccttgtcaccagccctcgatttctccctcctctttttggaatccccagtgtttattgtccccatctttctgtctatgcatacccagtgtttagctcccacttataagtgagaacgtgcgatttttggttttctcttcctgcattaattgacgtagtgtaatggcctccagttgcatccatgttgctgcaaaggacatgattttgttcttttttttaatggctgtgtagtattccatggtacatatgtaccacatttcctttatctaatctaccattgatgggcactgggttgattctgtctttgctattgtgaatagtgctggggtaaaaatacaagtgcaggtatgcttttgggagaacaattcattttcctgtgggtatatactcagtaatgggattgctgagtcaactggtaattctgtttctagttctttgagagatctccaaatggctttctacaggggctgaactaatttgcactccagccaccagtgtgtaagtgttctgttttctctgcaatcttgtcaacatccatgattttctgactttttattactagccattctgactggtgtgagatcctatctcgttgtggttttgatttgcatctctcgacatttagtgattttgagcgttttttcatatgtttgtttgccacttatatgtctccttttcagaactgtctgttcatgtccttggcccactttgtaatggggttatttgtttttttcttattgagttgtttaagttccttatggattctggatattagacctttatcacatgcatactttgcaaatattttctcccattctataggttgtctgtttactgtgttgatagtttcttttgctctgcagaagctctgtagtttaattaggtctcaattgtcaattttcggttttgttgcatttgcttttgaagatttatcataaatcccttgctgaggccaaggtctagaagggtttttcctaggttttcttctaggtagagcaaaactttaaatacacatttaaaaaatatattttcttcagaaaccaggatgcaaaagaaatttccaatattcctatattttattaataaatgtatgaatttgagcaatgaaagaaaacatctcaattcttttcaaaaaacacattttccttctttttggtgttgtaataatatgctcccaagtgacatggaagtgactacttctactggtcatcagtggtaggatgggagggtaccaaatctggcagcaaagaagtttacaaatcatattgtaaaaaataagcaattgtgagaaacggttattgcaataagttccagaaatcattatggacttccataaatcattaaactccatagcaaacttaagtacattttagttggattggattctggttcagaaagctaaaaaggacattgctgggacaattggcaaagttctaaaaagaactaaaaaaagatgatagaactgtaccaacatccgtggaacagaatagagaacccagtaataaggccacacacctacaacaatctgatcttcaacaaacctgacaataacacacagtagggaaagaatttatttaataaatggtgctgcgataactggctagccatatgcagaagattgaaattggaccccttcctttcaccatatacaaaaattaactcaaaatggattagagacttcaatgtaaaacccaaaactgtaaaaaccctggaggaaaacctaggcaataccattttggacatagaaacaggaaaatattttatgacgaagacatcaaaagcaattgcaacaaaagcaacacttgacaaatgtgagctaattaaactaaaggccttctgtacagcaaaggaaactgtcaacagaatgaacagacaacctacagaatgggagaaaatgtttgcaaactatgcatctgacaaaggtctaataatcagcatctataaggaacttaaacaaatttacaagggaaaaacaaccccattacaaattaggcaaaggacatgaacagacacttttcagaagaagacatacatctgaacaacaatcatatgaataaaagctcaacaatactgatcattagagacatacaaatgaaaaccacaatgagataccatctcacaccagtcagaatggatattattaaaaagtcaaaatacaacagatgctggcaagattgtggagaaatacactgttgatgagagtgtagatagtgtagattattttaaccattgtggaagatggtgtggtgattcctcaaagacctaaaaacagaaataccatttgacccagcaatcccattactgggcatatactcaaaggaatataaatcattcttttatgaagacacatgcacacatatgttcattacactactattcataatagcaaacacatggaatcaacctaaatgcccatcagtggtagactcgataaagaaaatgtggtatatatataccatggaatactatgcagccataaaaagaatgggaccatgttctttgtaggacagggatggaggtggaagccattatccttagcaaactaacacaggaacagaaaaccaaatgccacaggttctgacttctaagtgggagctaaatgataagaacacatggatacatgggggaacaacacacacaggggcttattggagggtggagggtgggaggagggaaaggatcaggaaaaataatgaatggatactaggcttaatatctggatgatgaaataatctgtacaacaaacccctctgacataggtttacctatataacaaacctgcacatgtacccctgaacttaaatgttaaatgaaaacataataaaaataaaacagggatgtatacacacacacacacacacacacacacacacacacacatgcacacatatatatatataaaatgatgtgcatatataatggtcatatatatatgaggtaaaatattaacaattgagaaatctggatgaaggagatatggagatataggagttctttatactggctttgcaaattttttaaaagtttgaaagtattttaaaaataaattatgtaaagggatcataccatatgtagttacgcattaattgtcacaatgtttctctgattatttacatcatggcatttagctttacagttaaactatttgtacaaactcttggtcatataacattctgagaagacaattaattttggctttgaataaataaaacactagaagaattgttttctccttaccactttgtgtcttatggccattaacaaaaaatactgatagattgactttactttttatgactcttttagttttctagttctagaacgtatattacaattttaagatctaattaaagcactttatcgcatacagtattgtctctttttttcactgttgaacaacatatttttaattttgaaattcttcttttccattactaatggtaagaattagatgattgttggttttacaaaaatcacaatagatggaaaagaaaacactgtattttctcacatgtgcatcaaataccagggttttggctcataaatcagaagagcacaaaaagatacaactggagtccttcctagttccactgttacagccaaaatgctgacattcaggcatatttccaagacccacgtttcggtaagcccttatgtgcttcgagtgggctgaaaagaatgtgaaataatttcacatggcaccttttacagaaggctgtgtgaggaacacaacattctctttgaaagagaaagtcatctttgtaataataaccattggttgctttcttttttttaggcatgtaataacattagaagatttactttggaacttgtttggaccattatcaacacgttagttttggtgacaaaatttgcatttactactgtagagctgtaatacctgaaagatgcaccatcctgacttgggactaagagcagctctcaacctcttttattcccctcaaaaccaacaccagtgcacaagtacctctgatattagataaaataatgaagctcacagtaattataatgcctattattttatcagcatctaccacgttctaagtgccttacattcttgatccaaactaatcttcaaaaccatccttaaagaaaaaaacttttcatgttacaaataaggaaactgaggcccaaaagagctaagcagcttgcctagcatcaaaatagtattgatggacaagaaattcacctgttctatgtcactctggaacctgtgcttttttcacaaaacctgtctgaagttagaggggtaacaaatggttactagcatggctaagagaagttacatgtggacagcactcggatttcaactagttggcagattatgcttgcttcagtggggtgggaaaactgacaaatcctctgacattagggcaaagaactttgttagatgtcatcattattacaggtgactctgatgccattttattaaaggctgtatcttctttctgtttctatctacaatgcttagtggtacacaacgcatgacaggtgcctaggaagtctttgttaaataaaagagtgaatgaaatatgtaatagagtaacttattgaatggcagcttaatggccttagtgaccagaattaactggtcaagagttaggggggtattgccagttaagatttcaagaacagttttttttttttaactgcagtatgggtgaagaagggtgaagtagaaaagtttacaaagaattaagaactgattttgaaaaatgataagccctgacctaatgaattacattttaaagcattctttagttatggaataggaatatataaaagcagtgattatcttcttttttcttcactgtttccaattggttgtattttttttttctctcctcagctggaaatgcctaggttccacagttacaatgtctgctgattttatattacttaagtcttgtagttttttcctttaattgtgaagccattcttacctaagttcaatcatattggaataattttcatactcctaaattagtatattagaattttttttcctcaacctatctttactagcataattaacttacatatatccatcctttagatttcgttttcttccacagtcactggaaggtggttcaaattctccagggcacttttatcttcccattcaaaacatgtccatttacattctccctggattgtgaagcattatgcactccatatgaatgtggaggcaccattttcttctgcctcctagtaataaactgctgtttttcatcagttttaatatttactttcaacagaaactgtcaagattgccattatactatttgctaataggaggcctgccctttttaaatatgctttttaaaaaaacccagattccttttctacagggccgaaattaaagcaggttatgaccatggcccgtgaggcatggttttatgactctgctgaaatctcagcctcctgctcctccccttgagggataagaagcaaatatgctttggtaagattgatgaagcaatgatatccccaagtatattcctattaagttccggtttcacagaacttacaacagggtaaaacccccaaataataactttctccagatatttatgatacatagtttataaattattacctagcaaaaatactcttgtatacaaataatcagtattttcttcaaagagagcatatttctggattaatttctgaaaacattcttagcagggaagtttccagaaagttggggactttctgtatcccttgacttttgatttctgtgcgacagagctcagtagtaaattgtccttaccatccctcatttaccttctaaggtactgagtcattgtagaatatttttaacatcttgtgtttccagacattgcttcatttgcaaacttaagaacatttaaatatttaagagtatttattttttaaaacagagatttcatacaagtgacacagctaagtccaaacactgtattatttatgtccccagcgcttgactttttgagtttcttttcttaatatttcagttctagagatttcatgtgatatactagataccaattactaaagtgttgttcagagagcagagggttaaaatgttttcttagtgaattctttaaaaactgtagctgtggaagcaggattgctcttgtttcatcctgacaggaatggtagatttaataggttccccagagctttttatcgcattataactctttctgtgatggtcagttttgggtccacattatgtgacctgactttcaacttgtttgaactgctgtcaggctgcagaggaactgaaggctactagatagtcctgtagttttccagttgggaaaacaacaatcctgcctgaaaacttctgacaagatccaatactgttcttcttatagcaaaactgagtcagcctgatacctggaaaaatctttacctgctcaaagtaaagcagtgtggccagaatgccttatcgtaatgtaaatctgtgttgctttgctctataataacagcttgtctatctcttgtgatcattcattccctgaggttgaaactattatcatgtcagcagagctcccttctcagttagcttgcattgctagccagcactcctgtataaatcttgatgtctcctaaatgttctccctagatccagtgtgtggtatttaaattaaggaagctcagacatgtcttgaaaggaactgaagtattgcatttagtcttgccaatccactgattaaaattcttgccaagtgttacattatgcacagcttccttattttggctgtaaatttcattgcatatttttctaggatgagaaagtttgtactttttatttcataagcccacataataaacacagctttcttcaaaaccgtttgaggtgttggatgcgtgtgctgtgttaaatatagggctcctttgtggaggaaagcacatgtggctcattttaacttcacacacaagcattttagacggggcaaaatggttctgctgggtaaaaagaaaatagacatttcgatgagctgcaggattatccaagccatagctttatcctctctgaaatctcttctatgcacttgaagaatgaacaaaactttctttatggacacagaagaacccactctcttctctcctatagccactgccactcattctgcccctgtattttaaatttttagtgggtgagtatgtgaatcgaaagctctcagagctggggggtggtggctcacacctatgatcctagcactttggaaggccaaggcaggcagatctcttgagttcaagaccagcctgggcaacatggcaagaccctgtatctacaaaaaatacaaatatttgctgggcatcatggtgccctcctatagtcctagctacttgctactcggggactgaggcaggaggatgacttgacctcaggagtttgaggctgcagtgagctatgattgcaccactacactttagcctgggcaacagagtgagaccctgtctcttaaaaaaaaaaaaggctctcacttttcactaaataaatgcttctctagcataaaactttgtgtagcgtcctttcagctaccattctgaagagaaaaccccaatgtcttagagagggaacaaatagatttagagggagattagcagaagccataaaatgcatactttggacccaatgactgggcctgcatttggaataaggggtagaaaactggataattcgctccatttacttctgtaaatgtatttttctttggtagcagccttgcaggagaagggcatctttgaaggtctggaggtggggctccactgacattcaaataacgcaggcctagggtacagggactgaaagctcactgcacttttgattcggattgggatcctcccataggttccattggcaaatgactactttcttaacaaaaagaaatagttctataattaatttttcttaaggaaaatcatatctcaacctattaatttagaaatattttaaatgagtacatggggatacaaatttagttatacaaatcacatgtgacactgttcatgctgttcgtatttcagtatagattaaaattttttaatgctaaaaagagcttttcttgctcttagagttttttttcatgcacatttccatgaaaatttagaagttatgagggcaaaatcttcatctatacacaaacacttttttttaaacaaaaaggagtaaaatttcatcaacattatgaactatgagccctattgaataattttttcctgtaaaaaacagaatcaagttatgaaatgaagaaaataattaggtctttgctaaaacttagtctttattaagcccaactttttcttaatcagaaaaagatgtcaaaaggaataattgtattgcttgacaaagtgatcaagatgttttctgctcctaagttatttcttcatgtgacaatcattccttaaagctcctcttaataaataatggaaagaaagaaagttgatgtttggattggggcaataaatgtcatctttatgtgtgtagtttggagaaacgggcttcttgtttgccatctcctctccagagttacagatacagtgtcattggtccttttaaaagtatggaaagcagagtgaatggcaaaaggtttgccaaaacagattatcttttgtatgcgtcaagattttatatttttgcaaatatacatacacagacaggcttttcaaaaccattttccttcagacatccaagtaaaagttcagagtgatttcttttttgctccttaatatttttaatcctttatcatcttacctaaagccatttagtatttcctggagcagatggggtataagccataaaatgacatatttacttctttgtaggaagaaaattaggagaagagattctataacacgattgaagtttaaaagctaaattccttgaggaaagattatctttctccatagatctcattctctgataaaacaaatgaggttgtctcagaggcacctgttaatattgacctacatcatccctagttctgaccttgtgtccccagccactgggaagtttttggtagaaaaggaactattaagttggttcgtttcttatttcttggaaagagaaaggtctccctccccttgcacttctgcttgatctggtctctgaaggagacttccacagaaacaagggcacaatctgtgccttgcaactacgcctatcatttcctctttacttaaggtcaaaatttccattactgcttagactctattaataatgggtttgaagattattttggggaattattccttcaaggaatatagtgttaggacctgcgccttgagaagggtctctgcctggatggaggaacgaggatgctcttgagaaagaactgaattgtgaattttttcttttcaagtaaatttcccagttgttttaaaaaaaggtatgttgccgagcttttgaggaactcttcagaataccagagatgtcttcaatttaataacatcttacagcaccgttttcaccagctagtatatcctttgcctgaaaatccctgtcatctacgatgatgaatttactcctcattcagactgtctctctgaaataccagaaaaatatgatcttcattctcctctctggaccctttagtagtacctaacatgagtaaattcagcctcattgttgatggaaatatcccttcctggtgaaaactgacagaatctaagcaatcttaaggtcccatggctaccagtctggcacattctaggtttttccagctgccatttcttctttagtggtgtggtcagttctcctctggccccttcagtgaactgtttggggttttacccactctggcattgtctttacaatgtttcgtcagatcagaatttcccagtaatttaacacttctgtaatgaccaaagagaaatttcttatccagaatgtcaaggaatatgtctcagataaatgagatgtatgcctacaacatttcaaaatggcatcaggcttcaagttacagaaacaccatccacatcctaggtagtgacttacacaaaacacaaagtcattttttaaagaaaacaactgttttctctcattgaatgagaagtagttcagggctaatgtgactccttcacagatgatgtcagagattgagacacctcccaactgttctttctaccacaccatagtgtagtcagcacgcccatgttgactagatggctgctgaagtcttacccccatgtggttagtcttaggcaggaaggtggatgagtaggaaatcaataataataaataataaataaataacaaagatctgctatggaagtaagccctctgtaataagcttgcctggaagccccacctaatggcatccacctccatctaaattggtcactcatctctttttcatctttgaaagagatgctgataaatgtacattctaaattgggcatatagcctgcccactaatatagggattctgttaccagggaaaatgagaattgatagtgggtaggcaaccaccaatctatgtcataatgacattttctttgatttagaatttctttttaaattgggatcatgcgtatgtggaagaaaatgcatgaactaggtcttaaaatattttgtttactatgaatttagcatctgaaaaatacatctttaacatactctgggcaggattttaatgagcttgacttttttgctctcagacctaatgatgagatataggtcattgtttcatatttttccaagagattttaagggtctactgtaaacatttatgagaaacattttttttctcatttgctatttcaagttcagaaagaggaatgaaagtcactgtttcttgggtatctgcatattatttagatcttagagtctaggagagagaagcatctcttggtttttaaagatcagtccctacgtttttggatttgagatgaagaatgctagtgtgtgatctgtaactaaaaactgctccagtttcctgatgtgtaaatatttattctattatacttatcatcttctcctaggatcacggcccaaatctcatcttcaaattgaccaacaagatgaggaggttcataacaagttattttttaagtcagcccaaggcaggctcaaataaattaaccaaattcctcacatctgtgaagcttcaagatgtggatctccttgtcattgcattgtattttcttagagatgtttcttctgctccctaaaggaaacactgatgctattcagtacctgacacatgaatctttcatgcaggctataggtgacctctaatggaatccactttttacctgattacttcagctatattgtttttcctccccaaggggttaggacagctatttaaccttattgttttgtgtcttcctttgagagtggcttcttgctttgtatcccttctgatgaggatgatgatgatgatgaatatctgtgtaacaaaccacttccaaagtttagtgacttaaaacaacagctatttaattattgattctatgggttcactgtaaagctggacagttctttttctgttatctggcctcactcatatgtctggtcagttgccaggaaagctgaatgctggctagtctaagttggcctccgctgagatggcttaatcctgttccatataatctctcatccttcagctagctgatctggactagttcacatgggagctaagcagagttctaagagagtgagcagaaatgtgaaaggcctcttgagacttaggacgagtactggcacagagtcacttttgcctcattctattgaccaaagcaagtcatgagattagcctagattcaagtggtagggaaacagattgtatctcttgatggcaggagctgcagagtcatatggccaagggcatggatacaaagaaagaagtaattgctgcaacctttatgaaaggtctaccacattaagattcttcgagcacttattcaggcactgtatgagctaagcactgtacatgttatctcattcaattctcataagaactctacaaggttgatactaatattatacccattacatagatgcaaaaattctaagcgacagagactggcattttgattttaaagcccttttaattaccagatctgtggactccaaatgttcttgattgtatagttctctcagtacaaatattttgaacatgtacttatatgtatgtgtatgtttgcttataaattacatacaagtactactgtcatctatatattaaatattaataaacttgaacttcattcttatctttttagataaaaattataaatatcaactaaagtttcagtgcattttttcatcctttatatgaatgtcttgtagcctcactttggagaccatgcatcaagcggctccttatgcccaagatatttcatgattcccatgtatagcgttaagtgaaacactgtttaattgaaatcctacttgtcattgagttcagttccagttccagttaatattgcttgctttcaatgcagacttttaagggtggggactcttcctttttggatatttgattaggacttgcggaggagcgtgagagcaaggctttaattaaatttagagaggctcttttgatttatgagagtcaggactcatggtttcatgtgtccagtgaatactcagatcacttaacacagggcccaattgctcatcactttctggagctgtgtcaataaaacaagataacgtggaggaatgcttctcaaagttctcagttggcagtgtgtgtctctgttatctgcagagattacgaaatgcagactctgggtttccatggctggagagactgattttacagatttgaggctgggtatgggaatctgcatttttactaggctcgcttggtgacattgaccacaattatagggccataaaatctgaattcatatctgccacttaggtggatgaccttagataagtaatctattcttgaacttgttgaatttcttcaactataaaatggaaaaggtggctgggcacagtggctcacacctgtaatcccagcactttgggaggctgaagcaggtggatcacttgaggtgaggagttcgacactagcctgaccaacatggtaaaaccccatctttactaaaaaaacaaaaaattagctgggtgtggtggtgggcgcctgtaatctcagctactcgggaggctgaggcaggagaattgcttgaacctgggaggtggaggttgcagtgagccaagatcgtgccactgcactccagcctgggcaacaagagtgaaactccatctcaaaaaaaaaaaaaaaaaaaggaaaaggtaataaagctcaagaccaccttgcaaaatattttgcaaattaaatttgtgataattttgtcaaagtgctttataaaatgtaatacattaatatgtgacccattccctaaaatgttgtcaatctattaaaagatgtattctccatactaaggtattcggtatattgtaaattacttttaatttcaatgaaaacgtgattctgagcttctctgccctattcatttgggtcccaaggaaagagactatggtttatatttcctttcttctctgcatgaatggaggtagaagacagtagggatttataacagactttaagttcaggcaaacatgggctctgaccccagcttctacattatcttgcagtgattacttaacttccacctgtttatttattaagtagtgatcctaatgaattcttcctttcaaaatttttatcatgattttatcatgattaaatgagatatagccaaaatttattgcatacttgctgcgtgccagacattattcaaagtgcttgtcagtttactcacgaaaatcctataattttgagtggaggtcctatgagggatcccattttaaagatgagaaaatcaagaaaaagagatttaaatggtggcactaggattcaaatctctgctgtctgacaccttaaccatcctctttctacttcgtaacactacctctaaaaagtgaaagctttcaagtcacttagcacaccagtgggcacacagcacatcttcaaaatatgtgacattattattgttgttgttaatattattatttgatttccccacagcttcatgcagaatgctttgtgcaaggtagttgtttaacaaatttatggtaattcgatttttaaagaaccctgttgtatcctcttgggcttctgagagatacatattcaatgagcgaagcctcttactttttaggctaatatgatttatgcagctgcttttagattaagttaccatcttttatttacaaaaaaagattaaataaatatgtgaaaatccaagaactccaaaatctccctgtgaaaatccaagaattccaaaatttcccttgctaaaaactgtttagaaaatcatctttgtaagacaagaaggagacaaagaccaaacctacttttgattggtgtacctgaaagtgatggggagaatagaaccaagttggaaagcactcttcaggatattatccaggagaacttccccaaactagaaagacaggccaacattcaaattcaggaaatacagggaacaccacaaagatactccttgagaagagcaaccacaagacacataatcgtcagattcgccaaggttgaaatgaaggaaaaaatattaaatgcagccagagagaaaggtcaggttacccacaaagggaagcccatcagactaacagcagatctctctgaagaaaccctacaagccagaagagagtgggggccgatattcaacattcttatagaaaagaattttcaacccagagtttcatatccagccaaactaagcttcataagtgaaggagaaataaaatcctttacagacaagcggaggctgagagattttgtcaccaccaggcctgcgttacaagagctcctgaaggaagcactaaatatggaaaggaaaaatcggtaccagccactgcaaaaacataccaaattgtaaagaccatcaacactatgaagaaactgcatcaacaaatgggcaaaataaccagctagcatcataatgacaggatcaaattcacacataacaatattaaccttaaatataaacaggctaaatgccccaattaaaagacacaggcaaattggatagagtcaagaccctttggtgtgctgtgttcaggagacccatctcatgtgcaaagacacacataggctcaaaataaagggatggaggaagatttaccaaacaaatggaaagccaaaaaaaagcaagggttgcaatcctagtctctgataaagcagactttaaaccaacaaagattaaaaaaaagacaaaggcattacataatggtaaagggatcaatgcaacaagaagagctaactatcctaaatatatatgcacccaatacaggtgtgccaaggttcataaagcaagttcttagagacctacaaagagacttagactcccacacaacaatagtgggagactttaacaccccactgtcaatattagacagatcaatgagacagaaaattaacaaggatattcaggacttgaactcagctgtggaccaaacggacctaatagacatctacagaactctccactccaaatcaacagaatatacattcttttcagcaccacatcatgcttattctaacatacatccacaacacacttattccacataatttagaagtaaaatactcctcagcaaatgcaaaagaacggaaatcataacaaactgtctctcagaccacagtgcaatcaaattagaactcaggattaagaaactcactcaaaaccgcacaactacatggaaactgaacaagctgttcctgaatgactactgggtaaataacgaaattaaggcagaaataaataaattctttgaaaccaatgagaacaaagacacaacataccagaatctctgagacacagctaaagcagtgtttagagggaaatttatagcactaaatgcccacaggagaaagtgtgaaagatctaaaatcgacaccctaacatcacaaataaaagtactagagaagtaagagcaaacaaattcaaaagctagcagaagacaagaattaactaacatcagagcagaactgaaggagatagagtcatgaaaaactcttcaaaaaatcaatgaattcaggagctggatttttgaagagattaacaaaatagatagaccactagccagactaataaagaagaaaagagagaagaatcaaatagatacaataaaaaacgataaaggggatatcaccactgatcccatagaaataaaaactaccacagggccaatttctaaaataactggatttcactaaatggtgcatttagtgtttttcaaaatctgtatttagaactttgtcttggttctcttttatttttattttctgatagctctacattcattactgtacagtacctgatacgtttctgctcaatgctttgcagcttgttttttctcttttcaggatcaacttgttcatttgcttataaaatgatgagctttacctgaggaatgccagagaggcagattggactctctggggcaaaataatcttaagttaaaaaaaaattgaggtgttttcatgtcctatttcttttgcctttatttaagctatctaaacagtggaataagactattctataataacatcttcaaactctaagctccaaggtaatatgaacaaaagtgacaacaattcccctcaagcataactgaaacttatctttctatcccgctctcagacagtggaattctttaggctatagtctaaggaaagctaaccaagatagcctaattaataggctgaagtcctctgaatttagcctttgctagataattggagaaaatatgtcagggagtcaaaatccttgccttagttaaccatctgcctgcaagcattttggccttcttatcagggtggtaaatgacaggtatgtcagtacagcagaaagcctagcctttagaaggagctgcagctagactcccctcagtcctgacgaagagcagccctgtgagtgacctcagtgttcaccccaatactagctgaccttaccacaggcagtctttaataagtctctgttttaatcttctgttagtctggtttcagtcactaagtaggaggaacagctatttcaatgagtaggagagcttggctttgggtactcaccgagtcttcagactccagcatgattaaggactctgagacatacctagggcaatgagcttggccaatacattcattctagtaataaaagctgatttttttgcacaagtttaaaaaaaacagtgatccagtggaacaaaaattgccatcatgatatttacaacagaaatgaatgtatttgttaaggcaaactggtgttgcaaacatccccaaattgtagtggttctacataataaaggtttatcacctgattcacagtctagtatgggaagtgggagtggagctgtgttccacacagtcatttagggactcagacactttttgtctggttgctgcaccatctcctgggtcattggtgtcctgcctgagcccctgcattcagcctgcagacaatggaaggtcatatggaggaccttgtgcaggatttttatggactggatgtagaaatagttatatcacttttactcatactctttaaacaggactcagtctcacaaccccctaaaattacaagagtgtttgggaagtactgtcttgctcatgtagcccaggaataaaaccaaatgggctttggtgaacaaacagcagactagccacagtggtcttgaaaaattctatatattgtggttctatttactgatggagcttagttgtcttttttcctataatatatatatttttggtatgataagaagcatagacagtcctattgctctctagaagattgtattccacttttttccctcttttagatttctgatcttgggttctattcttttcttctttagtggtgattaggtttagatgatctctgtcagcccgagtacaaactatgggtctcctccccatctgcctccccagggtagatgtgagaagtgctactgtgttgtattccacatcttgccactattcagcctgctgtctttttattctgaccctttgtgaagtcaaaaggcaaggttttctgcagattgaactagacctgagtggagaagggggtgaactttcagattcaatgaattataacacttctaatatagaacctcatcaccagatttgtgatgacaacactagctgtgtatttgactttactttttactttctaattccttggatttgagtaacctaaccatttcctcagtattatcagaaaaaaaaaaacaacacattacttttcctcccacatttaattgaatcaaaatcaactgtattaagcagttacagagtcatttattaagataggtggggatatacaaaagaataagccacctcctgcttcttcaagaaactgagagtaaggtgggaaacagacttttagcatataagcattctgctgtgtttatgtaatagctataaaacagtttataaatatgacaataagggtgcaaaccagaatatgatgggaacataaagagacatttattttgtccagttgtaaatggtttcttaaaagagaaaacatttgaaatagaaattgaaaaatgggaaagacctcgctaggcagaaaaggagagggaatagaaagcctgggtagagggtaccgtgcaaaggacgtcatggtgcctttagagaacagcaaggtcatgggtgtggccaaatcagaggatgtgaagggagaaagtgtaggaggatatgagagttgggaggataagttggaacaacatttatgaagggtctaaacaccttaatttggaattagtgttttacaatgtaagatatgaagaacaacaaacatgactttaatagagaagcagtaagatcagactcacattttataaaaataagtctagcaacagaattgacaatagattagagaattttaaactcttatattgagtttgtacatataggggtattacctttttgtctttcaaagacttgcttttgagcatagaattgatacaattgatattaccattgcccttttctcccacacgctttttttcaagtgccacaaatatagctctgaaataataggagatcatattttaattgaaagtgtggtatgtagttccattgttctataatgaaagactaacatgtatcagatgaccttcataccaatagtaactaggaattcttgacaaaatataagcaacaacagaaattgtttattggcactagcaagtaacttaaaataggctgaaataagagagattctatttgtgacataaggaaccacactgagtgagagccacatttaagagatcatgtgacttggaccctgagggtcctacttaactcatatggtaagtggctgagagggctgaaatagaaagcaatagttattcacatgggaaaccacaggactgaattcaggattgtcagaataggaattaaggaggagatgccagaaaggagagagtcacagatgaaggagcccaaaatctacaaataaatccctcttgaatccttggttgagtctatgcatatgcagagaaagactctaagaagcctaggaagaaaatgaaagctagaaggtgtaaataactgagaaaataattcagcagcttcttaactgtatgtctatagaatttggaattttagttctccccaagttagagggggcttggctaacatcttgggttttccgctgaaactccagaagggctatgcggtaggagtaaagactacatcctggcattaagggatttatcatagaacttaagaaaaaattgaaatagacccaccttaacgaaacgtccatattacttggcagtattttacctgcctgctagaacaaacttctaagataatagaatcttctaagataatagaagataatagaatctaaagcctctaccatatattatacacaagtttcaatatgccatcagtaatttactagacatgcaaagaaataagaaaatgtattccagagtcaaatgaaaaatgagtcaatacagacagacccatagctgacctagataatggaattggcacatagggacattaaaataactatgtcacatctgttaaggaatttacatgactagataaaatagaatggatgaggagatgggaaatttcaggagtcataggaaaacagtaagaagaagaaccaaatggaaatttcaagaatgaaaaaaatgaaatatttgaaactttaaaaagtgaaatggaattaataacagatttatcacaactcagtaataaaaagacaacaaaaattagcaaaagacatgagcagatacttccaaaaataagatatatgaatggccagtatacatttggcaagacatctagcattattaattatcagggaaatgtgcattgaatactcctttatagtcattagaattaccaacattaaaaaggctgacgacaacaagggactgccaaaatttgaactctcttacattgctggggttatgtgtaacatggtaatcactggggaaaactgttatgttagttctttataaaataaatatgtacttacctagtaatttcactcaatgatatttgtccaatggaaatgaaaacgtatagctacaagatggtttatacaagtatgcagattgattcataatagctaaaaactagaaacagtctaatgtctattcacagatgaatggataaagaaattacagcatattcaacaatggagtattacaaataaaaaggaagaagtctaaatatatacaacacaggtgaatctcagaaatatttaatatgtggagtaaaagaaggcagtctctctatctttatataaagtttgaagttatatagcaggtaaaacagttctggtgatcaaagtcagaacaggaactccctctgggtgaggggaggggaaattgaatggaaagggcacaaggtagctttttgggttcagggaaaggttttgtatctttattagcatcatggttacataaatgcacacagttgttaaaagttgtcaaaactgcacacttaaaatctgtacatttgattgtgtgtacattataagtcataaatagaatggatgggaatttaaaagtaatgtaatagagtgcttcgatatgccacatgcaggaattgagaagacagtgattaataatggttaagagcatggttgcaatatcagataaatctggggttttgaatcacgtcgtgagtactttgtgaatgtaagcaagttactaacctaagatcctaggaaatggagatgataaaattaatatttaccttataaggttgtccttagtgcagtgcccagcacattgatgcatttggtacatttaagctgtagttattattattaaatagctcttcagctagactttcactgcccgagtgcagtcaggaatactgggataaccatgaaaattttgagaattagatatctgcaaactgcattaaggagcaatctaaataatgcaggtaatatttgacagcatatgattaagtatactaggaaatcctattttcattatctatttgaaagcaactaattacctctttgccaagaaaacgtttactttaaaatacttttcttaaagctcttgtaaaaaattttcatatatagagaaattaggacttaatttttcccttatacagtaatctcaccctctgtttcccatctcataataatatcaccaactgctgcatatattttcagtacatatatatatgtgtgtgtgctgaatatatatatacacattacatatatatattacattacatatatatatccatatatatgtatattcagtacatatatatatgtacgtgtgtgtatataatgttgtaaacaaaatggtaaccatactatatgtacttttctaaacctggcattttcactgagaaatcttttcatttgaaggactctgtttacctatagctggtctattcattttaagtggtgtattacagtctatggcattgatgggcttttatttatttaaccagctcctgttgatggacatctgagtagatccaagttttcactattgtaaacaactgtgacatccttgtatacgtattttttgcacttgtgttaataatttcatgtaataaatttaaaaagtaaaaatgctaattgaaagaattttaacaaaatatattaatgtttctttgtaagagaaaaaactttatttttatttatttattttttttgagacggagtttcactcttgttgcccaggctggagtgcaatggcacgatcttggctcactgcaacctccgcctcctaggttcaagcaattctcctgcctcagcctcctgagtagccaggattacaggcatgcaccaccacacccggctaattttgtatttttagtagagacggggtttctccatgttggtcaggctggtctcgaacatctgacctcaggtgatccgcccgcctcagcctcctaaagtgctgggattacaggcatgagccactgtgcccggcctttatttcttctttttaaataaagaagaattatttcaaaatttacacaaaatttgatttagagtacttaagataactaccaccaaagggacacataacactgtactagacactatgctgaatgccttccatgcacaaaattattcaaattttatgcacaactttgtaactgtgtgagatactaccattattgacaaggacttgtaagaaaaccagtgcttggagcatgccatatctggtaaatgtttaagtctggatttcaacctagattttgcaaaacatgcagtgtagcgtagtctggagtgaatttatttttttgtgagtgtctttgaggttgaggatcattgtcaaactttggtgatatgcaagtggtgaagtaataaagcccagataatgttgtttccctggaacacttgtgaggccaaaagtgatgcctccctgccatgcagtggcagcagaagtcaacctggacattagacaagttatacttcccttagtgccaatagcctgtcccatatccagcttcgtcttaaataataataatgataatgataataaagatcaaggatcaattacatggtgttatggactgtggagaggagaagtcttcagacctctaatattctatctattttcacattccagttactactactctctcttttcctttattttataatcttgctttttttttctatccaaggggcccattcaataataactaaagccccaaatcctcaatttcctaatttatgtgtctgtgatcttttagtcttctacccttctacctgtgcactcacacacagagaactttaatttccagcgacatcaaatttgtgctctcaaaaggtaatttgtgatgcctggatgtcaaaggcgcccagatgtaaagctagagagctgatgagacctgaggctggtcacgggcacaaagcctgcccttctggcagagtcggagcagcactgaagttctgcttcaggccgtgccaagtgagagtaaggggtggtcttatgggtgttaagcaagacctaatctacccttgcgcagcacccagtcagacaccctgcagaaacacaatcatgtgtgtgtcattctgttgtggggagaagttgctcaaaggtttggttttgattttggtagctttaattctactccttcagttttgaggtgagcacaaatgtttcagagtacctttctaggtttcttactgacttttttcttctctaacctgtggtgtgttagaggcaacatgtaccagctcgggaaagagagacaattgtgagcatttcttctcaaccctgtgttcagtgacatcaagttaatagcttaaaattggatatggggaaaggaattataccactgaaatggaaaaatgctacatatcaaggattctcccaccccagagaacctgttgtttaactagcacacaacttctataacccttctacttctgttcaccacataacctcaccccccccccccggcccccgccaacacacacacaaacaagctagtgtttgaaacattggacaccctgggttttcttccacgggctatggttatttacaggaagaacaaattgagttctcttcctcttcccatcttgagctttatatttatttccaaatgccaaatataagctaactttcttctttctcccttagtggatggctgtattcatagagcagccggcccctgtttgctagctgaatgtcgtaacctgaatggctgtgatactggacatgcaaaaatcacatgtggctatgaccttcctgcaaaatgtgagtacaactgaatactgtttcaaaaccagatgagacatcttaacttgttttactccagtgtataactggaaaaggaaatggcagtggtggtatttaattaaatgtgcttgagttcagattttgtacatggtaataaaaacgtgctttccaagtatgtctccaaatatatacatatatataaaatatacatatactgtgtatattatatatatatatgtatatacacacatatgatgtttaactattcaggtctttgacagagtgtctctgaaagggaaataaaaacatgagcaaaatatacattatagcatttaagtgccacagagtgacagctcctggaaatgatgccaatttcttattccttgttcaggtttcttgattgtggatgtgtttagagcaaaggagatcaaagtgatgtattgtttttccagctgccatgtaaaggctgattggcaattacagccaaggcatctgtcacactttgctttcaggaaaagccaacgaaatctggttgtcagtgtgagaatgtgtttgctctttgaatgcggaatggtcaaaatttccgttatattttaatagagagaagtattgcatttgattgaccttattgcttagtgattcaaccaactgggtggcatggtatgggataaaatacttagagagaagctggtcagtgtcatagcttttttatcctgtaatcttcagggcctgaggttggaggtagagggtttcattgcatcattaaggtgtgtattgacctggaaattgagacaccaatttgttgattatcacattcgtccacttcttatgatactgctgagatctgtggaatacattttatgtaaaagtgaagctggttttgatttttgttttagcagtggagaaaatatgaatgaaaatttataatacaacctataggatactatgggttatatatagacaggttgtcataacagtgaatttcttgtggatgtgtgtgaatggagaatagcgtgttatattttaaagattactgtaaaggtatgtttaaatttgaggacttgtagcaaatagtaatatattaaaacagtatttttctttatcaatataatattgcatcctatattgttcataatggtttcagtgaaagtactttcatgtactgcatagcgatgctttggtcaatgatggaacacatatatggcggtggtcctataagattataatacagattgagtattccttacccaaaatgcttgagaccagacatgatttggatttcagatctttttttcagattttgaaatatttgcatatacaaaatgaagtaatttggagatggggcccaagtctaagcacaaaattcatttatgttttatatgcaccttatacacataacatgagtgtgatattatacaatattttaaataattttgtgcatgaaacaaagttttgattgtgttttgactggcctgtcacatgagataaagtgtggaattttccacttgtggcatcatgttggcacacaaagttttagattttggagcattttgaatttcaaaacttggattagggattcaacctgtactatatttttactgtacgttttctatgtttagctatgtttacatacttaccattgtgttacaattatttgcagtattcagtacagtaacatgctgtacaggtttgtagcctgggagcaataggctatagcctatagtctaggtgtgtagtaggctataccatctcggtttgtgtaagtataccctatgattacataacgatgaaatcacctaaggagtcacttctcagaccatattcctgatggtaagtgaagcatgattgtatatcaactatatatgctgtttaatttttcctttaatgatttttcatttatttttctttgttagtatctttacctagtgtgaaatagtcaaatcatgtgccaaatggctcttcactactacttggaatatgtacttgtgtcaaacaaaccctttgtgtagaatggtgtttagagcagttctctttgtaactcagaggtcatgatctgggtattaacggtgatttctctctccagaatcatatagtgctatttttacaaatattggttcttttgctttctaataccattctaccttcataatttacctaacttacactgccctgagaacaagcaaggttgttgactgctacaataatagcaagattattgactgttttcagacttgtatctgtccttaaaccaagtaatattcccagtcccctattgattcactgttttcttttttatgtattaaaatacaaatcaaatttctccaaatctgaactttctaaagaacagtatactcagaatcattaaatacgcccaaataaaatggtggctgtagtgtatgggttcacactgtgataattttttaaatgtgcttgtatctgtttgacatccctttgaataagttattcagtttcctttgaatacaattcatcttattttagggttattgaagacttgcacaataccaggcactgaggaacaaagatcagtgagtcaataccagtgcttgaagaattccaatgcttgagtcataacttcgaactgaagtgtggctttcatgggcatcctggggcaaatggatcttttgggacaatgaagctagaaatgaccagtcaatcaatgggactagctacagaatccatgagagctgagatcctgagagccgacagatactcaagtcactgcatgcagcccacagggcatgtttagtaaaaactcatccaatagaatagaaattaccagacaggcattgcagtgccacctcataaaagtcataaacatggaatatttgtgactaggtcttgcttcttcctatatatttaaaaggttaatgatttatattaaaagcataaaggaaagcaaggaaagcaatatgaaaatggtaataatagcttacatttttatgccactttataatatttcacagtactttcacaagcccttatatttaaaattatgtttgataaacattgtgtgtgttcattttccctttccctatccctgagagatgtttttctttctcatcaatttggttcatccatttcagagtcattaacaatccacagatgtgcttttgtagtgagaatgaaaagggagctcgttacatactgtttgggtcatttttcctctccatatttaataattccatgacagtttgacagcagagactagttgctatctgtcctctgagacagcgggtttatcattataggggtactaaagccagtcatccagccacaagtgataatatcttcatgcatcagcaatttgtttggaaaatgctattgtctgggttacagacaaacttcatagttttgaactggtttttgcctcttttatgcttgctaaattaatctattcataaatggttgtatttgaattaattatacttgtattctgtgttctgtgactcatcataattagtagaatgataagccccagatatttagtttacttttcactgcttggatgttttgaatgatttctttttgacattaagaatatccaatcattcttttcaaaagaaatcttaagggtagaaagaatattggtcaatatttcattgaaggctattgctaaggaaatgacttagaaagtagatggaggattgtttatgtaattggatcttttgggaatcttctctacaatattagatatttttgaattcataatgcaatttaaatttttatagatttttagaagcttgttgacatatgggacatttctattcatgctatcatcattccgccaagtagtcagcttcacataggcaagatttgtctatctcagtcagttccaatgtcagtatcaatcatagtgtctcctaaatatgtgctgaattaatgtgaataaatgaaggatcagacgagtgaattatttcaagacttcttcacctgaaaaatagtttttaaaaacacttttgcctctacttctaatacttttccttccgcaattattctgcacatttctagtaaattaacattcttaaatccagagtccttaaaattgtctacaatgctctacatgatgtgacctttacttctctacatcatctccttctgtgcttcccccactcacacaggctgctttgtgtgaacctggtcctcaaagcctttgcactggcattccttctgctggatttctattcttctagatacctacatggcttgttccttacctacctcaaactcttgttcaaatgtaacatcaggtgtcaccctaaccaacctatttataattgcttcagtttttaaatttgtaattgcttacttgtaaagttaatcttcaaatagcattatatcatttacttatttcttttgtttcttatctgtttctatctaccagaatatgggcacagattcttctttcttcatttttctaatgtattgctatattcatatagcttaaaaaatgtgtgatatataataggggttcaaaagatatttgatgaatgaatgaataaaacgtaactctaatcctctcaaaatccgatagtggatttttccttaaacacagactcattagcctgattacctttggccttccactgaactacttacaaccttttgtatgatatgaattgctcacaatggtgtgtctatgcatggggtctgtatctgagctatctagaaagctctttctttgctcctttcacttgtcttccagactcagttcaaatatcacttctgccatgaaacaagtcttctcgcctcacctcagctaaaaatgccttcttttttcttcacactccagaatacttcatgttaacatactgagggcacttgtcacgtgctaccttttattgttggatatgcaaacttcccacttttataacagagtaccttgtatatcacaggtactagagaaatatctaacaaatgaattagttattgaaagtgtcaaacctggttgataattggtagtaggtggaatataaaggaaaaattatgctaatattcataagaaattatgaaatcagtgtcaattatccattgtgtttttaaaaaacatattttaacatatatatactacaaagtctcctgtctccaaaatttactcttaatggagtttctcctaaggagaaaaaaaaataaaaataaagaaaccatatcacccttatttgatggttttcagcatagctcacatgtctattttatttctttagaatgcttctctcttaggcttcagggctgaatagtcatcaaggataaatggaaaaatattaaacttgtgtaaatgaaatggtggaatctgtttcttttatttcttctatttaatctttggaaggcatcaaggggtaatattgactaactcaaggttttcattaatcatttgaagggaaactctaaggtgagagaccatagcataatatgtttgaatgagtggtatgaatcagaatacacattctattcccaggtgcaataataatcagatgatagtagcttaaaatgtactgttgataataattagtacttcttttctgccctttatcaagaaatcatagtactttgaaacagtagctcatcagtccttttgaaattcctatgaggaggtgacgtgacaagtaaagttttcttacaacacaaagagaaatacaggtacagggaaaataaatctgttgctcccattaacaaactaaatccatattagaggcatcgtggtggccaaggatccctgagctgggaaaggagtctctgttaggtgttagccaggcctgctgcctgtttttatagataaagctttattagaacacagttgtggccatttgtttacatattgtctatggctgctttcatgtggcagagttgagttgtagctacagggattttacggccacagaacctgaagtgttcactatccagcctctgtggaaaaagtttgccagcccctggtctgtggcaatctgcacttttatttttatttttttctccctgagtcagacggattccagctctgtcgcccaggctggagtgcaatggcgcgatcttggctcactgcaacctccgcctcctgggctcaagcgattctcctgcctcatcctcccgagtagctgggattacaggcatgcgccacaacacccagctaatttttgtatgtttactagagctggggtttcgccatgttggccaggctggtctcaaactcctgacctcaggtgatccactggcctcagcctcccaaagtgtgggattacaggtgtgaaccacagcacctggccaatcttccctttttataaagtaagaaaggtgagattcagagagactaaatattgaattttattaaatgaattactacttattcagatcaaagttgataaagttgagactaaaatacctaccctctattccttgggacatccttgcttctgttgcctcaagagaacattaccttgggaagatgatctgaaacctttcaaatctttcaaataataaggccaccttgaaaagaatgcctagaaaaatatggtgatttttcccaatagggccagatctgggaagtgagtaagtcgagtctctcaagggagagtcagtttaaaccaccagagtattaggaagcaaatctttgttccttgtttcctccagtggtgttagctgcaaaggagcctgcagtccacaggaaatgcagtttctagagcaggtaattcataagatggttctgagttagtcctttgcaaagggtgacctgatttcagccatcgtggactctcccagcaggtgtctgattgtgaaagcagtggagtggacatgctgctaggagtatgactctgccagcctttgatgaagacctgagggccctcatgagccccttccataatcaaatgacttatattacacaaagagaaaagccgcttttgaagatcataaaatcatcttcctttctgaagaggaagatgggattgttcctcctaaaatcaactcggattggctcattttctttaagtgcttaaggaattcaggttttatttgaatctatttctccataattgtcacccttttcatttacattaagcagtttcatacatttaatctccttagtgatcctcatgatgaatgtggaaataagaagggcagaaatattctaaaaaccagagcagtggttctcaaaacgtggttcctggagcagcagcatcacctgggaatttgtttgatacaaattctcaggccccaccccacacctactgattcagaaaccctgtggtttaacaagttctccaagtaactctattgcgtgctcaagtgtgagggccattgccctagagagtggtggaatccagtagcacccttgccttgagatttcttttggctttacaacacaggtatccatttgggtcacagattagggctttttttgaagagaactctgacacgttcttcttttcctttatagcattttccactagtgatgacatctgtgtttgtttatttgtttattacctgtctttttagacaaaataacattttaagaagggaaggtgtcctatgggtctcatttacccctgatatccttagcatctgacatagtacccagaacagagttggctcttgatacatatttactggaggacttaatgaaagcattgtttttatctcctcttgtctttgtcataatcatagctgccctgcaggaaaccgagcaagaagacactcaagagagaacaacatgattccaggaatctgcagagctagtactcctgctgcttttagcatctctgttatcccatcaccaaacatactgcctgctcaaaggctagcagtataagaaagcacaggggccaaactttgcttaatgtatccacatgccacatgtctgttctatgcttagcttctttcattttctcttattttgacccattgtgataacatagagtccacccccaaatggctttgtgatgaaataacttaatgattctaatactaaatgttgtcttttaaaaaatatctaccttttggaagcaactggtgtttacactgttgtattactggctgagtgtagaattaaacagctgtgttttgcattatttgccatcatagcaagcctttagaggacgctgtctatacctcctatttcctatgtgatcaataggaaataacagtgtaaatcaattctaggtaataatgtaaatgggctcttgaaggcaattcctgctgtgaaataagtagttagcagtgacactggcattaaccacagtgggggtaatcagcctttggatgtgtttaatcagagttatcagctaagattaaaaagagagccactgttgtacagggataatcattttcaggatttaaaagatgaatatttggaggtgttctcataaattaaagccatcagaatggctttgagtaatttaggatgccctgaggtcaggcacaagcaaacaggaaaggttaatctcagagctacggtagctgatgtgcagagatggcagaatacatttattgaaataagtagcaaatgctgagtaaaagtgtagattttttttctccctgtgttaagatgttccttgagctattacttacatatatgatttgattaaaaagtagtccacagtgaacacttcgtgaatgtattaactctccctgtaattaatcactaatcccaaagattaaatattaggccatgttatgacttgattagaggtgtttctacttgaaaatattgatgtaaccaagctctgtattatagaatgtaagattgattctgtgtcaagaacactaaatgtcatggtagaagatctgagatgcataaatgcagagtgttgtaattggtaaagtccttaacttctgagcctgaggttccttatacgtgattgtctaggagtgtgaagatctcactctggagagtctgttaagccatatacgcagaaccgcttcttaatactgtcagataagagagataaatggctctattattatttgtaaaatacatggcacacttgatttgcttgttcagcccatgttttattgagtacttactcacagctagagtgctcttctagagtgtagacgactatagtgaggaagacagcaggccccttgtcctctaagagcttaggtcctagcagagagaggatgctaatgaacaagtcacataaaagcaaagaacctcagataatggtaagggctatgagagaaaaaagatccccttaccagatgtatacagtaaggatagttcatacatttttgaaatgttctcccttgctacaaatattctatttcagttcttacatatttgtaactttagtctaatttttggagataacaaagggaatgctgcttctgatagagctgacaggaattttaattattacctatttgatctcagaattttacagataaagtaaccgaggcctaggaaaattacttaatttttcccaggtcatgtggtaagagacagtgctaagactatagcctgacttttagtatagtgatctttctgctgaaggtactgcctctcttagtctctttgatcataccaaccctcttatagaagtatggtgagaatttaataactgttaagtgagatgatgaacatgaatgtatttttaaaataaaagtttcttatctcatatggtaccttattatttagtagtaatttgtagtaatattgcaagtaattttagatgagttacatataaattaattatggtcccatgagctttgccaataaactttatgacaataatccatcagtatatgtgcaacagtgactggtgtttgagaaaatatggaagtcccagatagggattaataaatattcaatactagcctcaagactcagacatttgctcatgtctctttccagtatcttgacctcagagaaaaggggtactttaaaagttattttgagaaacttcagatgacagctttattggttttaaagatatgtccacagattctttgatatttctcttctggagagctagagcttaattcccctctacttaaacatggcctggacctaatgactcccttctagcaaacggagtatgtcagaataatgggaacatctgaaactagtttaaagaaaagactgtggtttccctctctctctctctctctttcaattcactctgtattagcttcctagggctgctgtaacaaattaccacaacttgatggccaaaaaaagcagaaatttattctctctcagttctggaggccagagagccaaaatcaaggtgtcagcaggaccatgccccattctgaaggttccaggagcagatccatccttgcctcttccagcttccattggcctcaggtgtttcttggcttgtggcaacataactgcaatctctgcttctgtttatacctgacatcctccctgtttctctctgtctttaccccttctcttctcttataaggacacttgtcactggatttagcactcactcgaatccgggatcatctcaaggtctcaagatccttaacttaattgcatttacgtagatccttttccaaacaagttcacattcataagttccaggtatcaggacacaggcataactatctggagtcaccatttaattcactacatactctctctgagcatggccagtttctatgtcatgaggcagtctagaggaggggaaaaccagctaccatgttgtgagggaactcagacaccttctggagaggcttgtatgctgaagaactaaggcctgcctgcagcaatgtgagtgcgcttgcaagcagatcttctgaagccagcccacagccacatcagtgagcttgggagcacattctcctgcccaatcaagctttccgatgtctgcagccctggctgacagcttgactccaacatcatgaaagaccctgagccagaggcatccagccaagccactccaaaattcctggcctgcagaaactgtgagataatacatatatgtttttttaagtgcagggtaatttgttacgtagcaataggtagctaatgcagcaactatgatcctgaagtttataaagcaggggaaagggctcactatcagagtgggggatatcaatcacattttctcagtgcagaacctgcctgtgtcagagacaggcctaaattggaaaatgaaagccaaatcacatggtgggtaatgttacattatacaaccaaagccctttgccataccattatcataggcagcatattacattggaaaaactattatgaacgaaaacttcttagatagatagatagatcgatagatagatagatagtcaaagagaacccaaagtccagcttagtaaagaagcattgagagaaaaacaacacaaaccaaaacacacaactggatattaatatctacctactcctgttactccttgaccatgctctagtctttacctttgccactcacatgcttttttttactgataagaattactgtttctattttggggggaaaattaattcagtttctgtcctctgttaatgctgtgagctaagtgaagcagaggtaacttctcatccgcatatgttgtgatgcccttctaaatgtgtttgctgtataagctggtgtgtttcccattagctgttttatttttcagaactaccgagagtttgcttcatttttaatcacgtgctatttgtgaaatccctgtaatttcctaaggccttctggagcttgcctcttcctacctgtgacattttcaggaaagatttattctctctgtgtgtttattctgcttagtgaagatcatgagacacagccttaactggagttttgcaagttctttttaaaattgtgtctgtattgtgtttggagtctagttacccatttggaggtctgtggagggcaaagggctctcttgggaatccctttcttttactgatgctcagtgtctgctttctgatattatggcatgtgatgacaaactattgtccttccgtactgggctggttgagtttgttcttgcttttatgttactcctatacttagtacagtatattaaatacatatacatgtcatctctcatgaccttcattctcatgtagaacatatatttccttctgagttataatatgttttgtgaatatggaattcagggattgtgttcagtttgtggagctgtttgggaaagcagtctgagagagtgggtttgggagtggcttgacggaactgggatgaagggcactggggattccccaggaaatccgttggctggcagagaagagctaactgctgtgctggctaagctcatggaactgggctttcctccatatgtccgggatatgtcctacctattgttttaaaattaacaaaagttattttgattttcttcctcctaataatacctattgcctgagaagaacgatgccagattgagaaaccccacatcaaaatatatccaacaaaatggtcagagctttgtacatagaatattccatagttagaatgatccatacagctatgcacaaagagggagccgaaacagggaactgcacatcaagagttaatacagtacttttagcctttccttaaattctctgtgttgtgcaatggcaggatttctccatataccaaattaactgattgccgtgggcactaaacctgttaccttaaacacattcatatcacactacaagtaatatcttatcctttatacttattttgagattaactgtctatcacacagccctctttcctcccatattctcattttttttcttatcactccattcagaaataagggatcgatattttaaaggctgaatgtgagatgtttctatttattgttcatcatggtaattagcaactttttaattatcactgttcttgaggatgtatgtttgggaacagtggagctttcggtagagtcacaatgacagcagtttaaagctggaaagaaatctggaaattgcttttctggcaactgacaccagtttctaggcagtgcctaagaactaggcaaggatttttaccctgttgtttaagactgtacactttgcatctcacaatctatctgctacatagtaagcaaatggttcattcaggcagcaatcactgatttgctccctaatatgtgccaggtgctttgcttatttttttggaaaataatactgtgcaaaaacagacagggacctcaccctcatggaactgtgctgtgctgagctgaaatgaatcaagtgacctgcccaaggtcttcttgcacagatacttaagtgatggaatggggattttacttgggggcccttccttacaatgaaaagacctgatggttttggtcttcccgtctgggatgttctttccattaatagccacactgtctaaatggttaataacatggactttgaagcccaacattctaggctcaaactcaggctctggacgtgggcaagttgtttaacctctttgtgcctccgttttgctatcgggaaataggtatgacaatcaccctaccctcacagggaggctctcatgagttaatgtctgtgtggcactcagagcactgcttaactccaagtgaacactgaacatggttagctgtttttcagtaagatcaccccaactattttatctaaaatgtcacctcttcactctctatcttcttgccctgctttggttgacatcacagcccttataatcatctgaggttatttaatgtctttatttttttttttgctgaatgtttttcttttccactagaatataatcttatgaaagtgaggactgcattcactgttacatctccatattctaggaacatattcaaaaccacctgtgaatgagcaaatatgtgcacatagaaaactttattaatttaattaaataattaaatgtaattatttaattaaataattacatttaattattttaataaatttagtataatttaattatttataattattaacaaagttatcagaagaactagcctaagagtactttcagtttcatgctctgttcatttgattcctctagtaacttggctaatagatacaaataagccaggaaaatagcatcaacatatggtaaggtcaagctcatatttcatatttaatatacctaccaagcaagttttaggtgtgctgcacatctttttcatatttttaaaagtctataatttaagtaatagtgtccggatgaaataaagcaagaaggaagaggtttaaagaacttcagggacctgagagccatgttctgacctgcctaatgaaaagctcatgaattgatagtgaggtcctttcccccgatacagagtcagcgttcaaagtctatttctaagctcaatttattgttaaatctcattaaaataaagtgataattttatgggtttgaaatgtgttataactgacttttctgattgagactgctagcccaagtgcttacaacttgcttaaatgttgtaaatgtgttaaaagggggaatgttgatgtgtatttcctctgtgttcaaactgttcagattttatgggaaataataaagctttacaacttgttctttacaaatagaatgctagggactttgcagcaacatgagaaatctatttattattttgtgtcagagcaagctgggcatcttcctctttgtagactgccagagttcattgttatttgggacagagaaggaaatagcatgatagtcagggagataatattaattttacagaaatagaatcttattttattacaaggaaggccgtcagtctcacaacttgcactctatttgtgaagaaatattcttaagcatatattccagtaatatgtagtttaatacctatgtgaaaactaatttcttttcctcaagcatcaacttttatcacagaactttaaatctagaagtttaaagtttaaactttttaaatctagaagtttaaagtttaaactttttaaatctagaagtttaaagtttaaactttttaaatctagaagtttaaagtttaaactttttaaatccagaagtttaaagtttaaactttttaaatctagaagtttaaagtttaaactttttaaatctagaagtttaaagtttaaactttttaaatctagaagtttaaagtttaaagtttaaatctagaagtttaaagtttaaatctagaagtttaaagtttaaagtttaaatctagaagtttaaagtttaaatctagaaatttaaagtttaaatctagaagtttaaagtttaaattttaaatctagaagtttaaagtttaacttctccttatattaaaggagcagtatgaatattctttgagagatgaactttaaccatattttgtgtgtgtgtctctgtgtgtaatatatacctatagaccatagtctggggaaaactcatttttcacttcttcttttcatgcaagatcttaggtgctgtattttgcaacgtgccgtgtagcattacatttcatgatattataagctgagttttatagaactgtttcaaaaattttcattatggaccttttatatcataattgagtatctagcaaaaggtaaaaaaaagttccacttatgaagctgaatatcaatcactcaactattcagttatgcttaggcatagatgagtaagcttgttctttgacagttaagacatatggtggtgtgtgtgtgtgtgtgtgtgtgtgtgtgtgtgtgtaatagatgtgccagataactaaaatctttgcttagtactttgagggaaaaagagattcgtgatgagtgcatttattttattccattctatccacattttgtataaaatccatttaaacaggggaactaaattgcttacagtagtaaaatgcatttccctctgtgaatgttggtgcctttatgatgcatgctgatttggactctgacacagtcataatctacataccaaacataggcattttgctttcaaaacagaaactggcactgctagagctgtaggagtgagctggctcaccagagtaatctctccttcttggagagatttggcttattgttgatggcctgaagtccactgtcttggacctcagagtgggctttccagtttgtagtaatgggttctgtagcatgccaagactatagagacccccgaattcatctcttttatttcccttctatgagggaattcctgtggtcataaggcctgcagcttaacagatgagcagaaaatgtgctgaaacattggtgcttaaaaatatacaaaatataagtgggaatcagtgtctttagctttatctttgcaatgggcaaaacagaaatgactcaaaagtgatttctttagttatggagcactcaggtttctcttctgccttttgtatttccatatgtcactgctatctatattctgtagatactctacctgtgacattctgggattataaatatgtgagttgcatgcttattcactttctcccaccttttcattctatcctgagtagtctaaactgaaagcttttgaaagccttgcatgttttccacatcaacccttgaacatttatacttctaaaaaaggatgctggactctcttgataactctgtccttcaagtttgcctcatcggtgatgccacttgactgaaagtcctcttggtaatccagtaattaaatccttctagctgaggcccaagagagatccctctgctgaattgcactgcacagtaaatgacattataatgaggttttaacttattagttaaatgaatgaatggaaactttgctgctgcaattcattagatttttacgttataaaccaggacttgctgctgcagatgagagtccgtgcaattttcccttcgtataattaattatcatatcagtgtattaaagatagtttcactaaaaggagaaatacccttgtatagaaagtctaagacagtctaacaaaacatggtgatcacttctgtatgtccctgagcttggtgtgataggcactgttcagatacttctgcaatattatcaaattttaatcctcaaaacaaccctctgtgatagttactgttattattcctattatatatgaggaaaatcaggcacagagaggttaaacaactttcctaagatctcatagctagtaagggtagagcaaggattcaaactcaggcagtctctctctatagctctgcacttataaataagatttcctctcatccctagacatgaacatgaagatttgcttatatataaattcatcttattgatatgtttcttttgaatttcttcccctttttctaatgaaaactgatgatgctatttagaaagctttatttttttttacctaaaatgtttaatctcagaaaagtactgagaaaaataacagtactcatgcattacccaccaagaattttaaacatattaacattttgcctctttatttctactttttgtttttaaaataaaataaccagttatttctgacaaattcttcttttcagtctcattctttccttcccctctttccattccttgtccagagcaacccactcttaagagcagaatgtaaatccttccagactgtgttcttatatttctaccagaagcacggaaatagccataatccatatacatggtattgtgtttttaactgtacacaaatggcctcatggtgtatgggctgtactgtttcttggctttttcactaaacattacatatgtgtgtgtgtgtatatatatatacacatatatgtgtatatatatgtatatatatgtgtgtatatatatgtgtatatatatatacatatatatatgtatatatatatacacatatatatgtgtatatatatatacacatatatgtgtatatatatgtatatatatgtgtgtatatatatgtgtatatatatatatttttttttgagacggagtttttctcttgtcattcagggtggagtgcaatgtcatcatctcggctcactgcaacctctgcctcctgggttcaagcaattctcctgcctcagcctccctagtagctaggattataggtgcctgccaccacaccctgctaatttttgtatttttagtagagacgggatttcaccatgttggccaagctggtcttgagctcctgaccttacgtgatctgcccgccttggtctcccaaagtgctgagattacaggtgtgagccaccacagccaacctaaacattatatttttaaaacctctccatagtgatctatctagctataattcattctcagctgctatatttctttcttgcagatacaccatattttatttgtttattttcctctaaatgggtgattagttgtttccaatattttcctgttataaacaatactgagatgaacattttttgggtacataatgtctcacatactttgcctcctggatcgggattgctggttgggagggactgtgtggtaaaatctagcaatgaacatagaagagcaacagctgggaaggaggggtatgtcaggattacatttgagaattagagaacaaagtcacgcaggaatatttactataattatgagataataataaattacactgctaacagatagcccaagtccatacttcatgaagtctctataaacaaatgttaggtatatgtgaggtttaataaagagaactctaggctgagagccaagagacttggattttctctccagctgtgctctaacctagctttgtgccatagcataatacattaatagagttgggcacagaggctcacacctgtaatcctagcgactagggaggcttgaggccaggagttcaagaccagcctgggcaacaaagtgagatcatgccactgctctccagccttgattacagagcgagaccctgacttattttatttattttgttttaatttaattacttttttttttcagacgaagtctggctctgtcgcccaggctggagtgcaatggcatgatctcggctcactgcaacctctgcttcccaggttcaagagattctcctgcctcagcctcccaagtagctgggactactggcgcacactaccacacctggctaattttttgtatttttagtagagacggggttttaccatattccccaaactggtctcggactcctgacctcaagtgatctgcccgcctcagcctcccaaagtgctgagattacaggtgtgagccaccgcatctggcctgagaccctgacttcttttaaaaaagcaaaacaatacattaatggtctctgaatctcttttctcttatctgaaaatgaagaatttttggtagtattttcttatgatttcttccagcattaatctacccaagttaaggctggaataagtttcctttatgatattaatacctctcctcagcattgaactaaatgatccacaggcccaaatcttcatcgtcccccaaactgctgccctgttgtccctgaatatagcgtccatttgtaattccaggcagtgggctgtaatgggcccttgatttattgcgcccttttcctaccgtgtaaatagcccagctcactgcttcttgggtgggataattatgaaccttgtggccctcagatttctcagtgggatcgggctccagttacccacagtggtaactggcttgataacagcattgtttattgtttctttcctactcctgtctcacttctctacttctggccattgtattctgaggtcacctgagattcttgtctcaagatcttcttgctggggaaactcaaaggaagatatccacctattcaaatcctgcctgttttcctccctctagcttcattctatagccttggaaggttcgtcctggcctgttcaagcctgttttcctctctctagcttgattccacagccttcgaagtttcttcctggcctgttcaaacacaagctcatggagctgcaccagactcttaccacatttgtcattggaaccaagtaatgcaacatcacatatgattatatgcgtgttctttttttaaattttatttctcacagccttggaagctgggaaatgcaaaatcaaggcctggcaggggctggcttttgagacagctaggtgttagctgttacttcctatggaggaaggggcaaggaacctctcttgtgtctctcttttttttttcaatacatttaatagtatatatagttaaggcctataatatgagacacattcagatagtaaaatgattactatagtgaagcaaattaacagattcatcatcttacagtttcccattttgtgtatgtgtgacaagagcaattatatctacttacatagcaaaaaaaaatcccacatgccacaccactttcttaactatcctcctcatgttgtacattagatctctaggcgtgtttattctacccgtctgttactttgtatcctttgagctacatctctccgttcgtctcacctacattcatgttcgtactttttatgtcccttcccctcccaagcataatataaaccgccaagagccaggaactctttttttaatttcatttttattaaaaaaaaataatgcccctctatgcctagcatggaactaatgcagaatgtacccatgtagtgtattgtcactgaatgaataatttagtctgagtaagtctatatccccaggactgattttgtggatgccagccatctcttcttggatttctttgccttttaattaacttcccattagacttgtggttcttagtgacctcctgagggcctgaaaatcagaaggttgcagactgggccatctattttatgggagtaatataaagacatactctctttggtcacgttttcagaaccttttgactaaatgggcagaagtaattgggaataaaaatgtgttgggaagtagaagttataatttcttatttttttctaataaggactttaattctaaattcattcatagctttgttttaaagttattgtcagtattttatgaagttaaagacaaattcaaacattaatgattctagatgttttgcttcaagtatctttgccactgtttcctcctgtgagatggagtctagattttctttccttctcttcctctctctctttttcttctcttcctctctctctttttcttctcttgtacagaataagcctgattttttttaattttgtgatattttaaaaattctcttttattttgattgatattgcatatgcttaaaaattggtagaagaggctgggtgcagtagcacatgcctgtaatcccagcgctttgagaggccaaggcgggtggatcatgaggtcaagagatcgataccatcctggccaacatgatgaaaccccgtctctactaaaaatacaaaaattagctgggtgtggtggcacacacctgtagtcccagctactgtggaggctgaggcaggagaatcacctgaacgcaggaggtggaggttgcagtgagcagagatgatgccactgcactccagcctggtgacagagcaagattctatattaaaaaaaaaaaaaaaattggtagaagaattcaagtgagtgaaactgagagtttatggttttctccagcaaatcagtgagtgttttccctgaacatggatgctttggctctggtcttcacactctgtgagatgaggaccagcccttgtggcctctgacttccaagacttcagtacctgagggtattattacatattttatgagtttaaaaattgaggaaacttttttcccctccaacagtgaaacattctatttatcatttgttgaacctgtctagtgagtactgattttgtagaatacttccccaaaagctgattttccagattcagttcttttcaaactgcaaccagcccggctgggcagacagccctctccttttgctccgctttattcttcctgaattgactttatcactgtccctccagccatttccaggattcatcacagattatctctgcttgttggcagaaagcaagcaccgccgagactgaagggcacaattgccgaaaggttcttctttcagttcagtcctcattctaatttttaacttatttggtgctgctgtggaaaagctgtttgcctgaaatatggtaaataaataaataatatcctacatatggagtccataaaataggatgcagaaagctaggagctcaaatttagatccaaggcagtaattctccttgcttctttttccgcttcccttcttagcctcccttttctccttaaatgatcaggctgaatggggttgtcaggattgaaagaacaggatcccagattttataaaattgtttactcctctctgtttgaaatgtgtaactttgcagaattgagtgtaattccagtcatctcctaaaaggctgggatgatggccagggcgaatgggcttcctgaccttttctgtgtggagaggcttcacggaggagcactgagggcagaagacacagagccagtcttccatggaggcgacccatagcagcgggatccagcaatgtgtgaagtcatgctggttttacatatgaaccaatttgaatagaatccttcattttttttacataaatattacatcttaaccttttcatagaagagcctcggttttctttccaaaggtataaaggcgaggtctgtgtttccataagcagagaacatttatcctctgtcctgcctccctctagaacaaaatccattgctgtcttaatttccagttttgattgtagctctcagtgtgagacctcccagtgctgtagagtgtgtttcctctatgaggctcactcaccacaggcataaagatcggggtgaatttcccagccgcctacatccgggaatctctcattcggactcagcaagatcatttttatttttgaccagaaccttataaataaatcacaaatatataaatgtgatagggaaggcgcccatcacaactatttgttcaaacaaatcctgggcccaaagaaggagtgaaaaattaacttcctatcactttattttagtagttcatactgacagcaaatatttaattatccattattttgaattccacattaaaataatactcataaggtttggattaatagaaaatactcatatttataatagttagagctttccagatacatagaggcaatatagtctagtgcttggtaattccctagagttggaaaccttggtttaaacctggcctttacatcaaacaagctatgtgtgcataggaaactctgagctctttgtttcagttctctcatctgtaaaagagacacaacaatagtgactaactcacaggattgttctaaggataatatgagatgatgtgtaacacatacaatacctaaaacttggtaagcactgttaacattaactagtaatagcatttcagtctcttttctgttcattacgacatttaatcttcctgataacctcttattataatatacactgtggtagactaactttgctttaaagggccagatagtaaatatgttcagctttgccagctgtatggtttcacttataaacactcaactctgccagtatagttcgaaagaagccaaaggcaatgtaaatgtaagggtgtgtctgtgttccaataaaactttgtttacaaaactaggtgtcaaatgagatttgacctggggactgtagtttgctgattcttgacaactctctacttgctgttacaaataagaacatgaaagcagcttggttaggagattgactgtgagaacattgctacttagtggtatatttcaaagtaatatccatttttttaaaacttatttcagggcttttctgcacaactttttgtttgtttgttgcttttattttgagactgagtctagctctgtcacccaggctggagtgcagtggcacgatctctgctcaatgcaacctccccctcccacgttcaagcgattctcctgcctcagcctcccgagtagctgggattacaggtgcccgccaccatgcccagctaatttttttgtatttttagtagagacggtgtttcactttgttggccaggctggtctcgaactcctgacctcgtgatccacccacctcggcctcccaaagtgctggaattacaggtgtgagccaccgtgcctgacctgaacacctgtttttgatggcaatttcttatctagtgatcatctgcaatgtctgagatatagacttatgtacatcattggttagagtgtgggttgatgtgagcagtcttctttgactttgttttatagccaagagttcagctttaaatactgagcaaacttcctgccagcatggattttggttagaaaaagaaatgggcaaaagtagatgcctgtttcaatcctgactgaggaacaaatgtagcacctcaaagcatttctttatacttatacatttctttaggttttttatataacactaaaatacttacttttttttttcagtcaaaaatatattcctgagttctaaatctttaatttgggggacatggatcaaaattttgaaattttggttgtaaaagacacctagaggggcacgaagtctgtggcttgtgcaaaatcttttacacatgcttcaaggatgcacacacatatacaaacacacactctcacacactcacataaggtaaggagggtgtttgggtgtataaaagcaaacagtagaagctgcctcaaaccactgtatccagtatatatcctgatccaacatatatgtatttagattcaaatttaataggtctggcgtcaaatttctgaacccatcacaaagtagaagcaataaatacaaaaaaggcatattgttcataaagcgtgactggctgtagcaagagatgacagctgacctttggatactaaactagccataaaactgaaaaatcatgccatgataccttgttgaatcacttcttaagtaaaggttaacttacatacattacattctgattgtttaaacagaaacaagtgtagtatcttttaggattaggtcattttaaatttattctgacaattagaagttttgattcttcaatttgttaaattgagttttctggaaaatgtacctctttctgaagttgaagttggataaatgtagcaattccacatgttcatcaatgtgttacagcctaaaattcatcttttaaatgagaatattaatttcatgtttataaacatattttctaattgatcaactgtatttatttttatttatatatttctccatgcaaaatagaaatagctctttactcagatgagtgatactgaatctaatataaaagcaaatttgtatagaagaaatccagggacagcagcggtcagaagataattcacaacttgatgaggtaaactaccttgaatacccctgagaatgagagagtaagcaaggagacctcgagtggccaaagcagagatttcagttatatttactggacaaaatggacaccataatcaacagggaaacacaggatgtactttgggtgagtggtaaagttctgcccatatgaaggcatactcccatttatttgctcagtcttggcctggtgacaggcaacaaatattgaataagaccctttaaatgaattttcaaaaaatgaagtttagtgatttaaatagcatttaaaaaaatcaaattcatagtaagggtgcagtaaatatttggtttacagtttcatcttgcatactgtggaaagacgatgagcatggaacttgttatcaccacgtagaattcctaaaataattgtttcaataaatacggaatagtagctcaggtttcagatttttacatgttattgactgagcctccctttggggaaaatttaaaagttaaaagatctcttttaagatgattcagaaatgcaaggtttatttaacatcttcctcattgccatattgtgttctgttgttttcctcatatcatgtaacttattatcattttttattacttagtttcatttttacttcctttacctactcactcattaattcttactgccagtattttaaaacctttctgcaaaaaaacacatgcaactgcactgggtcagtgtttctcctgattgataatccactttccacctccacatctaagtatacaatcattgataaaaatgaagcccccatggactcttctcctgagagatctcattcttcctgcttatcagcttctgccctctgtctgagggattccatattggcatctccgaaatggagatattttcctatcaggtgtattggagttaaaattgagagagaacatgcaatcatttttatcttttcctgaatcatatgcaagtttagcaccaggtcgaaaattcaagcttagacttgtttgtgctctaaagattgagaaagttgctcagattgctctggagtgggtcatgagttttcttcctggatttttgttcaacacagatagccatctttgatttattggaacctcttgctagagcatagttataactcccagagaatccttttgaagtcaatttcagctttttcatattcaaggaaaagaggaataaatcatgtatccatttttgatctgtagtttttcaggaatcattctcaatgttgttgaagaagttagaaaagcccaagctaatcactgtatcatataggttttccgaaggcaaggtgtagaaatttttagtgttgtttaagcaacccatttattttgaagtattgaaatgttattaatcctaaagaccaggtgatagtttatatattcttgaaggctttaaaaatataattagcctctctgttacaaattgagtccacattcatcttggggctaatttatttcctttacaaaactaacgagtgtttgtctacaggatcagtgaactaaatctaaatgggggccaaaccttcaacttcaccctctggcaactctttttcccattttcagaactcttccaaatcccccgccccagccccagtatttccaattgacttatagaaacagttgcattgttcttttgcccaaatcccaagcattccccagagagctgttttcactttctttagagcacttacagtttatctctgtaagagaatagttttgagtttggcacttagtctgtttctttttcattctaataggaatcgccttagagctagctaagtccctgttagtcagcttcttaagtgctgaccagacttcttccatctgtatagaacactcactttttcacatcagaggtttaatgaaactagaaaagaaaactctttaaaataacaataataatgaaaatctctaatagattcaggcaactttacatatatcttttcaagattgggtcaattttgcaaaaattttgagggttttattttttaatatggcctcaggttagagtcacacaaatcagttaaaaaatatatttctttgagttggaaatacacacttatttcatccctgtacttctatataggggagttatttttaatgagaaaaatttatagctgactgccaatgacacataaaaattagtatgcattattaaaaataaattaaggcagaaagcagccaaagtggactttgttctagagtcttggtaaacagccaacagcagtgctcacttgtcttcatgtgacattaaatagtgcccgtctaaaaagtgattaatagataccgcgggttggaacaggctggcattcgtctgtttcttacagctcctgatacacgttgaatgccctgcatacctatagttcttaagggaatagtcactgttgagacatttagagaagctgatatcagatgagggcaatcttgttttggctattttaccacatctcaagtatacaaagtctacatataaacattacgtaatgccttcagacattgcactgattcaaatagattttaatgagaaaggccaacttttcctgtttcttggtcattcagagacttttagggagcttgaattgtcagtatctcctaatctctcaactatttttttcttttgatttttaatctcactcagttagactgttgggaagagaatacaataggaggattaatggctcagagcagaaatgtttgcttgttggacaataggaagggaatttggtagaagttcttacccttcctgtttacattcagtaatgttgctggtatattgaaaagactgtcaatagtgggtatatatttttttcaacagtaatttccaacatcttgttgttaggtgttcatcaaaataagaaagacggagaaagaagaaaacagagacaaaaagaaaaaagataatggatttgagaagtcaagtcaattcagtcacaatatgggagtaaaggacagattaaaagaagtttcttgtgtgagtgtgtgtgtgtgaatgagtgtgaaaatgcgtgcatgggtacatgtgccttagagtagaggtaattggaagacttgaggagaaattactcacttttcttttaataccaatgaccagacagcttgccaggtgctcactcagatttgtatcatatctttacatactgtcttctggataggtacaactatccccatttttcagatgaggacacagaatcttagagaaatgaagaactagatcaagatctgtttgaacgtaagtggttgagtcaggatttgaatacaggctttttgtttttatcactccagagtctcttttttcttccttggtaaatccagacttatcactggagattctggttcaaaattactctggcagttttaccacctaatatatgttactccaagaattttccaagtctgattaaatagattaggtggagtcctccgaaaccctttcctgatttcctgggccaaggtaaagcatatctcagagcaaattttaaacagtactttgtcattgaagacctaactatatatgaagcattgtgtaggtgctgagaaaggcacagaaaaatatacaatagggcacttgccaccagtgccttattaattagataaagagataaaacatacacctgtgaaaagctaaaaaaattactattatcaattgacaatttggcatagcaaaacaaggcatgattaattgccagataacacaaaatgcatgtggtagaatttgagagatctgtaattggacttcagtggcctgataattcttaatggaagcggtttaagctggagggaaaggatgggcaggatttagacagggagaacagaggtgggagatgaattcaggccttaacaaaagtgtaaagaagagcaggacagcaggaggctgggttgaaggacataaacaacaggaaggtaagtaaactactttggacaaagtggggctctgcatagataggaagtggaaaagcaacctcaaaaataggttgggctcaggttttcaatcctgagtgccagcatagactgagcctgttgccatgggtacgtggaaaatgacagagtcagtattgcactttgagaagattattcaggaggcagggtgcaggatagaggacgagtgtctacaaataaagagtgaggcaacacatatgtccatcctgcattgggccacaccaagaacctaccatgtgcacctctcaccacccactggcgctcagactgctgcacacagtagcccccaactcatctacccagatccacttttgtccccatccactctgttctccacagtttcagccagagtgatctttacaaaacataaattattgtcacctcctgcaaaagatttcaacgtgacccataaatatattcttattttttcctccatgtcctatccctcaacatgacctacaagacctggcctctgccttctcttcggtctcatccttcaccctgctcactcttgttttctaggcatggtggtctttttaaaaactgtgtctcattctttgtgttcaacatgccccctctcatgatagggactttgctgtttcctcttcctggcattctcttctttcccctcattgtcttgtcaactcctacttatccttcacatcaacacactctaatttcaagacctccttgactaggtcagatccccttatagaagggtctcacagctccaagtaactatctctcctttgcagcttttattacatgtgcggtttcaccacttatctaatagttaattcatgtttcttttccgcagtgtccacagtgtttttgttctttatttaattcaagaatctagctcttagtggactctcaataaatataatatagtggaaacaaaataatatgtggttaaaatgtaaggtgttgtattagtccattctcatgctgctaataaagacatacctgagactgggtaatttataaaggaaagaggtttcattgtctcacagttcagcatggctggggaggcctcaggaaacttacaatcatggcagaagggaaagcaaacacattatgcttctcatggtggcggcaagaagaatgagagctgagcgaagggggaagcctcttataaaaccatcagatctcatgaggacttactatcacaataatagcatgcagaaaactgtctccatgattcaattacctcccactgggtccctctcaccataggtggggattatgggaactacagttcaagatgagatttgggtggggacacagccaaaccatatcagatgttataaaaatttctatatttgaaggcctcagctattggcaacattacttaattttaaatacatttggcactgattttaaaaaagtgttacatagtattggaattattttcagagggctgaagaatccttcataccttggagagtgagtgagcactctttagcaggcctcttgtgcttccaacctaaatgcaggcaaacgtcctgttggtatgtaaagctgccacccaaatgcagagaacctctagagtgcatgctgttctcattcaaactgtcccatctgttcagacatggtcaagctctctgagccctgggagaacgaaaacaggccaggattaccagtttttacagattttaacgtgaggcttagggtctgtgggctaaaaggttgattgtagtttttaagttaaacatcaacaggggctgaaaagaccctaaaattacatttgggagtcatacaaagacaatacagctccaactgcattactcgggacctttttgctgctgaaacagaaaaaatgataattaaccaatcaggatgaaatgtcaatttgagaggaaggtaatgtgaaattttcctaaatcatctaaacaccaaaaaatctgttacatctgatttccaacctgctctgttgctatgaaaacttactctccactcagctctctgaacgctacatattcatgcaattataattctttctgaaagatggactctgtaatgatatgaaggcgttttccttcagtctgcctagagtttttccagagccacttaataagagccatgctcttttggaattattttgctttatccacatttttcttcatgatccaaataaaagatagttttttaaatgtgaggtggcagttgtcttgggatatatctctatggcatttgctaaattaaagctcatcttttcaagcccagtctttattttgttttcctatagtttgctggcaaaatcaaagcccttgcttccttactcttgcactgtggagcagactggtaggatgatcacaggggagtgagcaggcttcagtggttcttaaaaagacaatttccatttccttggcagagggaccccatactgcgctccagccaattcttaattctttctgccattggttccgaggggcaggcttttgtggggagggattatttgtttctttaaaatccaccgtggttcttttccctcccaccttttcccctttcttttgtggcctggaacaatacaatgttagcgattcagtttctgacttgcagagaatccatctatgcttggaaaaatgcagttcaattatatactgcagcttgaggtgagatagaagtgaagatggcttaacacgtgaagtgggtaaaaaaaatgtgtaattgaaacagtatgatgttgatgaggcagtgtgtgaggctgtcaggaggcattataataagctgatgaacgagactagcttcctagttctgctgtatgcaaatgttccattatttttggtggaggaaaggaacctggcatattaattggctttgtttttagagatgcaggtgaagccttttcattttgctttctgaaaagaaacttgcaatatgtccttaaattatgtttaattttgagtgtcgacttacaaagaaataaaaactcttcatttttaaaaaatttaaaacaaaaaaaaatttgggggtattgaaccttagaaccaatcactaaaaattctgattttgtgtcgactaaaaattctgattttgtgtcaactaaactgcatatgagatcttcgagtttttaacactgaaacataatagttaattttttaaagtactataaaacagaatatagaaaataaattacactatactatattttctatatttggaagtttacagttgtttgcataattgacaagttcgtttcctggtgcagtcatcagcaggttatacaggatgtatctatctgtctctttcttcagaggacactgtgtgtgtgttgagaatgaaaccgaatgtgggtggtaagaggaaatattaatgaacttttaaatatctctttccttgaaaagactgaaatatgaggtcttaagtaaaataaatcatttaaagtataaaatgcttaaagatccttactttttattaccaagttattagcagactgccatactgaataccttttatgtagttttttttttttttggctaacatttccaaacaactttaaaatatagttattcattaaccgacttgtgactaatctttttcagagagagaggattaactttattcctctccagttttaacgtgaccaataaggtgatatgcaagtgaggatttggggaggtggggaagaattggagagaggtaatagaactgatccttgagtcagtgggatgttggaagtggttttccattactttccttggttctcagaaaaccagggagatagggaggatgttatcaggccctttgaccttctggaagtgactgtggacttagcaaaagctagttggagctaggggaggaaggaggcagatagataaagtaggaagaaataattgttctccctaagcacagaatccaaggtggtgctattaaaacaaacaaaccaaaaatacacacacacacacaaatgcacacacacacgtctgtgaatgtatacagagatggtgcggtggctcgcgcctgtaatcccagcactttgtgagcccaaggtgggcagatcatgaggtcaggagttcgagatcagcctgaccaacatggtgaaaccccgtctctacaaaaaatacaaaaatttgccaggcgtggtggcacgtgcctgtaatcccagctactcaggaggctgaggcaggagaattgcttgaatccaggaggcggaggttgtggtgagctgagatcacaccactgcactccagcctgggcgacagagagagactctgtctcaaaaaaaaaaaaaaaaaaaaaaaaaagaagagatatatatgtgtatatatattaatatgttgacaccacagagtacagtattagaggaaacagtgtgggtgcatgtgattcaaacatcagttgtgaggccgaaagagaagctagtcaacaggtgggggtcttttaactccttctctccctccactgatacagaacccccaacactcatatacagtgtgtttccagaaatccaacctggctatccctttgaggctgataaaggagccaagtatccaacctgagatcctgtggttcatggagtctgagttcctattgaacacagatcatggttgcctggatgggaaacctggtttaaacatttaaatgatcagaatcagagcagcctgaaacagtcatccttgatgctcaagttcctgagaaataattactagaaacaaaatttcattgtttggaaacttttccagaaaatgataaaataatactcgtgagaacatagatcacagaaaaagaaagttcagttctaatgtagtatgtttcttttacctagatttattcattgttcctgtgtttattttctttaacaaatataaacaaagaagaaaaggcagcctcctgtatagaatgcttacacattttataagttaaaaatacatatagtcagccgggtgtggtggctcacgtctgtaatcctaacactttgggaggctgaggcgggcagatcacgagatcaagagatcaagaccatcctggccaacatggtgaaaccccatctctactaaaaatacaaagattagatgggcatggtggtgtgcacctgtagtcccagctacttgggagtctgaggcaggagaatcacttgaactcgggaggcagaggttgcagtgagcgagatcgcgccactgcactccagcctggcgacagagtgagactccatcttaaaaaaaaaaaaatacaaatagtcattttatagtttagtctaagcatttattacacatttcaaaagacaaataaactctctcctacttttgtccacctgtaagactcatttcagtacctattttattttctcctagtttttcccatggtcttagtttaagaattcccaaattctcacttattgaattcactcacagaattctacttcccactacagttctatcaggaataggcaagatagaaagaaaaaaaaaaaaaagaaagaaagaaagaaaaagaaaataaagaaagaaaaagggatgggaattttgcaaacatgggggcctgattactaaaagccttatgagatgctcatactcattctttaaagaatattggaaataaatcagtcatgcatttaattaaaccatcctaaaatgtgcccctcttaaaaaaaaatgagtgccataatacttcccaaattcccggaaatgttgtatgtctaagaaagcaagatctgaactgtaggtgtatttcagttggaaattgtagtttacattacttctaattcgaggcctatgtttggtcattaaaagctcccagctaaaaacagtgaccctgctctccatgtgtgcgcaatcttcagccaagtcccaccagagcattggcccttcagtggagggagaaaggatgatagaaaaagaaattctgtggatgtgagaggttagggatagaagggtatttgggcagctctggctatctcatatctggaatttcaccttttatcttcctggaggatgactccttatatggtctgctttgtagaccactttcttgaaaagcaattgcatataatataaaacagaggatgctgtgctaaaaagaaaaacaaccctccttttattgatacttttttctcaaatatagtgatcactacacgatagtaataatggtttgatatttgtaaatcttaggtcttaggaaaaaccacatatggtctgttaacctaaatgatctttagaataaagtacagcgttctaatcaattcaattcatatttcacatgtagttattctttgactaaacaagtactttttgttaaaggaagcaggtaaactaaaatttatgtatttcctcttctgaagtccctgacgtagttggtttggaaaaggtctccaaccaaccagggtgctgaacattcatcctgagtaatgtgctgttttggttgataacagttgtcatagtcatttcctcctttagttagcattttggcctaaaggtagtagatttatggtttttagcctgtttcatttcccagctgccccacaacttttttttttttttttttttttttttttttttttgtgaggcagagtctcgctctgttgccaggttggtgtgctgtggcgccatctcggctcactgcaacctctgactccctggttcaagtgattctcctgcctcagcttcctctgtagctaagattacaggcttgcgccaccacctccagctaatttttgtatttttagtagagacggggtttcaccatgttggccaggatggtctcaatctcatgacctcgtgatctgccctcctcagccccgcaatgtgctgggattacaggcagaagccactgctcccgcccacaaaacttcttttaaccacatttacaaattgctgggtgcttctgcatacacacataatgaattataaatattagataaaaagtatgttgaagtaaattgaacattaaaactcaaggagttggccgggcatggtggctcaagcctgtaatcccagcacttagggaggccgaggcgggtgggttgcttgagctcgggagttagcgaccagcctgggcaacacgatgaaaccccgtctctactaaaatacaaaaagttagctaggcatggcgttgggcgcctgtagtcccagctactcgggaggctgaggcaggagaattgcttgaacccaggaggtggaggttgcagtgagccgagatcgtgccacttcactccagcctgggcaacaaagcaagaccccatctcaaaaaaaaaaaaaaaagaaaagaaaaagaaaagaatctctcaaatgtgaaagtctggatacacaactatgtttgcacaacgctcaatttggcataattataaattgcactccagcctgggtgacagagcgagatactgtctcaaaaacaaatgaaccagaaaacccccacaaaactcaaggagttaatttacatttagaccaatctagatgtgtttaaaataaaagtaaaaatttcagttctgtaagaagtgtctactggggcaagtacaattagtcctggcttacacatgagaaataattgcctattgtctattattttattgcctaggttactgccaaagcttgtgggtgattcctctgaccctttgtactaaaggggctttctgaattgcctttcttcataggtttcttctgtattgaaaaggctttcatggcttttcatgtccttagaatgaagttgaatttcctaagcctgacattcaagactctcctaaatttagatgaaagttaccttcccaacctcatgaatcattatgctaccttaagacaatttcaaccaagataggcttttccttgttacctccatgacttccttcattcagctgctctaaccatgcagtgacctctctaatcctccccttctcttaaggaaccgtgtggtagaaattatatagacttaggcccatgacagactagaattctatgttggaaaagccactgcttccctctggggctcagttcctgactcagtaaagaggtatcagttactggcacagtaatgccccataacaaacaaccacaaaatttcagtggcatagacacttatttatccttcatttgtgggtggctgggctcagttcaagacttcttcataagactctcattttttgatgatcagtgagagataaggattgtttttctcatgggcttggcagaaaatctgaatgtacatgtgcaattcaaggctttgctggcgcagtgtccactttggcctcagaaagtcacatcatcagagtggggaaatatagtccactcctagtgggaggaactacaatgtcattgggaaaaaaggcatagatatggggatgaggtaaagaattgagaacaatgatggagcctccagtagtattattaagaggttaactcagataatctaggttaggtttctgacagggcatgtggcacaaagaccctgaacacgtttttctttccccctgtactttcctcacacccacttgttcaaactctccttcttcctttagtcttgcagctgttattctatcactggcacttcctgtgcttttcacatagtaagcagtaagtaaatggtttttaaacataattctataatcattatttgcttttttattgaaatacatatggaacagcctatatgtagcccttgtatcttctcatcaatcctaagttttaagttcaagtagaatttagttgccaatttagacacctatattggttcccaaatgtaatgaaacaaagctaataaaattctttaaacaaaaaacaaaaacaaaaaggtattgtctctgcttcttagtagcactttctctatagccatctctttgagtgatgtctgactttatcttctgccaaagatagataatgtttatatcagacaaaaaaataattataataacataagatcgtaagaaatgacttgtcagcttatattaatctgactttggtctctgatcatggccaccagatatatttggtggaaccactcccttgtcagaccaccttgcaggttaaatctgtaacccaaacacctccccacttctcttttaattctcagctttttaaactttaagtggcttaaatttgatctttacattccactgtcattccagcacatacacaaaaatatgtattttgtgctatctccttggtgtagtgactgtgtggtaagatggaaagactattattgagcttggaatcaagtccctgctttggcacgcgttagctgggctgcagttttctcatcaggagcatgattcagattgtttattcttatatatcctttttgattattaccttttgcagctctattcactggaaatgaggggactagaaaagagaaaaaagagataaaacattgactaacgtgtctttgtgccattttcagtcactgctttggaatctggcaggagagctaatattcctgtttcatttttattgggcttaaaatatatgtttatcttctcttgatgaagatttggtattttttttatccctcggatttcttctttgaggtgactaaatgtgctgtttcttagaaagcttggctggaacttttcatctagtgtgctagagtctctataaaacatatctaaataattttcaaagactttgctttaaatgcctgttgaattctcctgggtaatattagctgagtttcctcatgtacatttggtggtacatttttataattatttctatttggtgctattcggcttttcacaaaaattatgtatctggtcatatcccttggtctgtgggccattgtgactcagatttcagattgcatacgtatgtgttaaatggagtttcattctcgtaaaagaaaccttactgaacatgaccactcttctagtggtttccatgtgaaatgaattatgttctattgtaatctggagtcttttcattttcctgtgagaaatggtttgaaaattgtattctgttgtttacactgttgggtatctcttaggaggcttatacagaggataagaactaagatagctttgctctccttacttcttggtgtatctacatagcataaaaattaagatttatttcttaaggactatgaatgttttgtaacattcaattttgagacattcaaatatgctgagtgttttttaaacagatactctgtaaaaatgaatgtactaagttctcagactaaggtgtttttttttcccactcatatgtagaggaagtttggtgttgtggttaaaattatgaactctggggtaagactgatttgatttgggtatcaatctctgcctctatttgactgagtaaatttcataactaccttaaagctccgtttcatcacctttaaaatggggataataatagttcccatcacccattttactcaacaagatttatcaaaggcccaatatgtgtgagtttatgttgtaaatggtagggatgccccataagagaaaattcctatttttgacttctactgaaaggaaataagcaacatgagtaaatgtgcatgaaaaagcagtagaaacaactctgataaaataggattgggcactatattaggttcaatagtttatgaaatcctttctgcagaggatatttttaagctggggctttaagaaggaaatgagagaagagcattcaagcaaaggaaacacatatggtaacaattctgtgctaagaatgagtttgctatattcgagtaaaaggcaaaaaggccagtgagacttgagcatgatcatctaaggagaaagtcattcaggtattagacaaagacaggctcaggaactgtagagtcctgtaagccaagaaaggagatggggttttatttgaagtatgttgggagccactggaaggttgtgaggaggaagcaccatggcttgcttagtatttttttacatattacttgggatattgtgtggagaatggaatgtacaaagaaggcatgttatgaggctactgcaatagcccagatgagaaatagtagtggattagatgagggtggtacttctggagatggagacaaatgggtagtttcagagtatgttttgggggtgaagtcaacaggcttgctcatggattggatatggggagtgaaaggatgggaagaatcaagaacaaatcctaggtttttggcttgagcaactgatggatgacaacaccatttcctgagatacgagagggaggagaagcaggttttggaagtgataacaagagttgtttcttggccttgttaacagctacttcagggtattaagtagcacttgaaaatgtgaatctggagttagggggccagtcagggataaaaatataaattttggagtcattggtttataagtattgagaatggatgagatcacctaagcagagaatggagatggaaaaaagaagcttccccagaatgaatagtgtagtgcaccagtgtttagacatcagggagaagagaaatcagcaaaggagacagagaaggcatgcaaactgagctagaaagaaaaatagaatatgaagcccttagcatgctcatatatagtagcttctctataaatgttgatatattatgtgtgtttccccagaacactgagataaggagactgagagatggtccctggaagtgctggtacggaagtagaaagtgaggcaatggaaggagaggaagccagcaaagcttgtgttttcaagcaggttaccagcaaaaaactgaagctccattctgctggtgaccgctgggaaacaatatagaatatgcctcagagtagccgccccagagggtgaggacatagatgtattcatcctccaacccccatttgtcattaactgagggctgctctctggtgagtgaactcctcagcactttggggctgctctatatgggccaagaaaaagcccttaggggttgcagatgctgtttgcacaggaaacagtgtgtgcacccacagtgtgtgctagaacaggtgctgagcagatctgacagtggttcctgttatcatgtcccttacgtgactggctctcatcattatacctttcttcattgaaatattataggaacaaaggaaattccaattgataaaaatgaattattaaaacaagagagaattcaaaattcttcataatggtcataccaaaagatgtgatgaactcattgaagcatattaaccaatggctcagtaattctccttatattcttgtttgaaagtagcaataaattttaaggcatattccttgagtgccaaagacatcattaaatgtgacaccatcaaatatgaagatgaacacatataaccttgatattttgaaatactagaataagaattcataccatacagtaccttgaaatccaatgcctttctcccaaagggatcaaaggttacgcttgatgcttttcagggcaccttgtacacaggagatcacttgatcctaactcctgggatcagaacgaatgaagcgattagtgtcacaggcgaaactgaattgcttttaagcttcttatctgagcaagtgtcgatactgagatcaagacttaggtttgctaaactctgatttggtttcctcatctctctgccataatggaaatagtaaaatgtttcctagtgcttataatatgccagacactgccctaatcactttacaaaattagctaattttatcgtcaaaacaacactatggcttaagtagcattattgtcttgcttttaactactcgggcatcaagttaggaaactggttcagttcacatctcataagtacgaaagtagggattcaaacccaggcacctgcctccagctctgttctcctcagatgactcttacacagctgttacacagcttatgtggcagtaataggctgtgatcttatccctgactatatgaattacttggaaaaaatcacacacatgatgtgtttactactttttccataaatccactttaaaaatcattttaccagaggttaaaaaaaaccctcccatcagcagtcttatttataattgaaaaaatttaggttcctttttattaaatctctttcatatggtttaaaccatatggtgactaattttttatacagtctaaagtgtatacaatttgttcaatgtagttttgcctttttgtgaattcctatgctttatcattaggctgaaaagcatgcaggataccagaaatactcttaccagtaaacttccattgaaaatctggctatggaagaaaagtctgccagccagtactttgtactttggaaaggaagccatagatccagatattctccaagaaatacaggcagtggctcatgcctgtaaacccagcactttgggaggctgaggtggattgatcacttgagcccaggagtccaacaccagcctgggcaacatagtgagaccctgtctctacaaaaaaataatttaaaaattagcctggcatggtggcatgcacctgtggtcacagctacttgggaggctgaggtaggaggatcatttgagcctgggaggttgaagctgcagtgagccatgattactccatgacattccagcctgggcaatggagtgagaccctgtctcaaaacagaaagagagagagagagagagaagaaacaaagtagttactttatcactccccaaatgtaatttatcaactgtctcttcagtctcatttgctgttacctgcctgctataccaagtaactaatcataattttcaaaggaatttcaaatatgttacgtcatttgatctcagtaagatttttgatgccaggtagatctgcaagattactttcataacacaggagaatctgatattccacctttagggaaagggattgctcctggaagctctttccaactcttttcccatatggaagaattttccagtcccatttcactctgagatattattattacttttcctggctactttatattagtgactattttaaatcctactggaggggatttaaaggctcttgtgcaatcctttcatagcccatgaatttcaagaataagagttgcttaacttactggccccagaattctgtttccacttatctctatgttaaactagagccacagagaaaaattatgacccagtaatttcttctcttatttaaaatgtcaagctcctatgtcctgaaagttagtactagattttatatgtctgcattttagttttagttttgttttttatttcagatcggaagaaaatgaagtattctgttaatttaaagttacttatggcacatccctgtaatactaatcacttaaagatgtagcaatttatattttttacagtgttaattcataagtggataggactgtgaacaaatgaattaaaccgaagtccttataatttaaacattcctttttggaaagtactttaaaaataaactgacttaaatacttcctatttgaattattattttctttattcttctcatattggttctaagatatgcaattttatatagcatacgtaatagctaaatgttaaagactgaatacctgtgcttctctttaaagtctgttttgtcttctggctaaagccagattccatttaaaaaccttacagaatatgagacactattttaccattattgtttgtgtcaactgcagccagagatgagctcccgatatctctggaataatttagaagttgatgccaagtcatgattctggtcaatacagtaatttcagttttgtaaagtttatttatttaaaaaaattagttcagtgtttcattcatgatttttgtaataccacaaggaagaatagaaaaatgtaaggataagcatgagaaacaaattagttgataaattattataagcttcttataataatgtcaactcagataactctccatgtaagctgcatatgagcataaataaagttaactgtatgattaatctctactattgtgtttgcatccaagagatattaaaataaacattatggttagatagagtaaattctaaaaagctgcaaaaacatttaggttatatatttaacacatagtaatatgcctgtgtttacatcttccaattagataaatttctgataatttttgtctccttaggattttctaatgaaaatagagagcagtattttaattgtttagtatcacataattgttctagccttcatatacaatttaaaataaatggcacaaaagtgcttggtaaagcactttataaaactatatgaatttcatctgttattctgactttaacaaattatacaaatatcatagatgattataagttaaaatacagatatgctctagtagcagaatttccacataagcatgctaccgtacatactttaaaccaagaacttccatttctaatgataagattgactagactagatatgttgacaatccttttatcacgcatgaaaaacacttaatatattttatgtagtatcctcaataactgtttaagatatatgattagctggcttgaaaataaagaaattgtctaaggtcaaaggactaagtgagagctggaatctgaatacacaagggaacattgatctcctttgacctgggcaattcttaacgtctctgtgggggtaagaaccaaagcccagggcccatgcaaggtgaggagtgtttgcaactacaagctcaccatctaatggattggcggcacacattcatgcgacttatttgctcaaaaactcccaagctaaatatttactttaaggttctcttgggtgatttatagcagaaaatgagagtccttgttaaaggtacacactctcaatacaaatcacaaaataattttatgaataaagttaaaatggtcacaaactcagtatgaaaaaaagcactaaatgtacgaagaagtcaccatgatctaggatccacaaaagcagcaaaggtaggattatagtattagaatcattaggtaagaatgtaactaagtatttgcattacatttattaaaataaaagggaactaaatgttcttaagaggtgagagactataaaaaattattaaaccatttttttaggagaatcaaatagaaaattagcaaataaaataataaattttgaagagcacaacgtggatgaacaattaagacctggcaaactagaagatctaaacaattgcagcctgaagagtcaaagaggtagaaaatatgggagccagatgaagagatgtggagggtgtggtgagcagacctagcacacattcaaatgaaattccagaggaaagcatagagaaagcggaggacactggtttttgacaataaaatgggtaagaattttccagaattaatgaaagacataaatctttagtttcaggaacaccaacaaatcccaagcaggaaaaagaaaaataaatctacatctaaacacattgaggcccaatcatgctactccagagacaagactaaaattgtaaaagcagccactgagaaaggacgactcacccacatgaccaacaaccgttattagactggcaggtctctctcatggcgttagcgaaagatggaaaacattagaataaaagcttcagagtgctgggaaccacagctgtcaaaatagacttataaacccagtgaaactgtctttaaagaaggagagatacctttcaagaaattaagaacaaagaatttgctagcaacagacccttccagaaggaatttctacgttatgcacttcaagaagagaatcctaaaaggatggcacaaatatgaaaataaatagcgagaaaagaaattcatacatatatagtatatagataaatctaatataatattgactgtataaaccaataatagcatccgttcataagattcaaaaacagataaaaaaaatactggacaaaagttacatgtaagctgagaaaagggagatcaggtttaaagtgtttttttaaagatctttctattattccagaggtgaattcagattacatttaaacattgttaaattaggtatgcatgttttacataataaactctaaaataatagaaattagctgtgtattgcccaaacaggtttagcacacacacacacacacacacacacacacatgcacacacacactcacaaacacatacattaattttgcatcaaaaatattgtcttctgtaatttcaggaactattttctgctcataaccttgtaggccctacctgaatccaacaagaaaaatgtaaaaataatgctcaatcctggtaataaaagaaatcatatgtttaacaatataaagatccatcaaaaacaacactttaaagagatgaatgagactgagacctttgctggcctacctgggaggaaacgtgcctgtcctgagttcatgctgcccctataatgcaggattagagaacacatcatatttgtcctcattatagagatcgttctaatgaggaaaaaacttatgtcaccgaatctacttttctaaacagaatccacgatctcttagaagaccaggaagcccttccaacgtaccacatggtgctgacactcaatctctgcctaaatgaactcagagaactataactggtgggacatatatttagaagaaatagttatgaaaaccatagcatggtgctgccattgttatttgctaggtaggagtctgctaatagttatctccttcatgtggcttcaatttctatatgatttggggatattctaaagcactagtatttaaagtgtggtgtggggacctctggaggtcccccgggccctttcgtccaggttcatgaggtcaactctattttcatttaaatactaatgagtgatatgtgccttttttcactctctttctctcttaaatgcatggtgttttccagagggctacataacaggtgataccttaacatattgaatgcagaagcagatacgagaatccagtcgtctttttttaaaaccagacattaaagatatttgcaaagatttaaacaatgccattcttctcactaaattttttggttttgaaaacatggttatttttatatgttaatttatattcatctgtattgttaatctttacatgaattaaatattttttaaattctcgcttaatttctaatatggtaaatatctatagatataacacatagaaacacaactgtaaggtcttaatttttaagaatgtaaaggggcttctgcaaacaaaaagtttgaaaatgacttctctaatacaacagaaagggaatatttatagtccagtaagactttgaaaaggtatagagttcttaggtattttggaggagactgtggctggcgtcattttgtaatgttcctatgtagcaacatctattgggaaaaataaagcatgtgtgtatttgggggcaggtgtttctagtatttcttgggcaaactttgagtgctatgtattatctgtaatctttgtttggactttctttgtggtaaattagaaccccaaatgttttcataacttcaaccttgaactgttgttttaggatagacaccaataaatataaggggtccactgggaaggcagagagcatttttagatttatgaagggggaaaaaaatcaatagtgtccctaaggccgtgtaagtcatgagtaacacaagtattcttatgcaaagttgacaatatcatgaaacataaacctttgctttggaattttaccagaaattaaagtggcattataaaggaaagtcgatgttttagcccgtatctcaggaggaatttgtccttctgattgctttgctctgttacctcactttggctgagctctgtgaagaatttttttttcttttcccctgaaaagttaggtgacctcctcacattcttctgccttctggctcattcactttttctcccccttcaatctttgattaaagcttctaggcccctaggagttcttatttcttatacagcaagccatgcactttgtcctcttgttaaggaatgaattaataagcttaactccctctttgaagaagagtttggaatgctttcttggagaaaattaatattcaattaccaaggttgtcatctcaccaaatagaagaataaaagacatagcatagccacacttgaagataattgaaatcgaatttcagtttgtattataccttaattacccaagctttcaggggaaattcttaattcttatgtctactttcttatgaaagtgagtacatttttcctgatgcatatttataacaagactgtttaacacactgctttaaaagaacttggattgagtggttcttcttgcaatggactttggagttttagacacatcctagttacctatgaaattcatagtgtttatcttttttgacattgcataagtcctccaaaggacaataaaaataatacttctcctaattgcatcctttatattttataatattcctgtgatactttgattggtgatagtgaacaggtacataagaggcagctcagggtacttccttataggtaacccttttcctgcataggtttttaaatcacagaatatacataaacatttatgttggttaattgtatgataaaaatattttatagttaataataatttaaagatcaaacaaaaactttgtgagggcaaggagagtaagaaattgataatgtatcagtacatggagaagaattacagcatagcatagagtgtagaaaaatgaattcatagatggtaaatctacacacagataactctgggaagaattaaaatctgtgcttggcatctgcattttacatttgtttctctgggaacttggaataaacaatgaacctgcagaagcaattataaaagctttgatgcattataaaataggcaggggttttttttccccaaactggggtaaaattataaatgaagccaagtttatccaaggctgatgttgacctgtcaagctaaaatagaaccgacttgagaatccaaggacatagcattttgttggggctctagtacttatttgctgtgcaacattgagctaattgcttaacctcttaatgccttagtttccccatttgtatattgaggataatcgtgtgttctctgactacttcacaggacttttgttagaaaatatcagatactgtatgtaggcactttcaaaaatgatcttatattactgatttcaaagagttattattaagctcccttaccctctgatttctcccattctgacacatcttcttaaaaaccgtcaaagagtctgaaaacatatccctccccaccctttttttcagccaagacctcactcttacaatgtccaagaaatattttatattaaaattaacaataaggggccgggcgtggtggctcacacctgtaatcccagcactttgggaggccgaggcaggcggatcatgaggtcaggagatcaagaccatcctggctaacacagtgaaaccctgtctctactaaaaatacgaaaaaaaattagccacgtgtagtggcgggtgcctgtagtcccagctactcaggaggctgaggcaggaaaatggagtgaacctgggaggtggagcttgcagtgagccgagatcaaaccactgcactccagcctgggtaacagagtgaaactccatatcaaaaaaaacaaaaaaacaaaaaaaacaaaaacaaaaacaaaaaagcaaaaaaaaaaacaaccaataacaggaaggtactaacaactaccagagccttgttatgtcttcatccaaaaaacaactttttttttcttaatagtaactttattaaaactaaagtcttttgactccatagccaaaatgactttgataaagaaggagaaagttggagggttcacatttcccaatgttaaaacatattacaaaaatacagtagtcaaaacagcttggtactggcatgaatataggcatatagaccaatgaaatagaatttatcatccagaaataaatccatgcatctatgggccactgattttcaacaagactatcaagaccattgcatggacaaagaataatatcttcaacaaatagtactgggatgactgaatattcatatgcaaaaggatgacattgagcccttacctcataccatttacaaaaattaactcatgatagattaatgatataaatatgagctaaaactataaaacccttagaaaaaaaataggagtaagtcttcatgacttagagttggtgatggattcttacatatgacaccaacaagtaataaaagaaaaatattaatagataaattagacgttattaaaacaaaaaaagcccttttgtgcctcaaacgacactatgaagaaagtgaaaggacagcccactgaatgagagaaaatatttgcctgtcatatctgatgagtctatctagaatatataaaggacacttacaactaaacaactgaaagagaaacaatgtaagtaaaaattagacaatgaacttgaaaagacatttgtctaaagaaggtatacgaatggccaacaagcacatgaagcacatgaacaggcgtccacactgtcagtcattagggaagtgcaaatgaaaaccaaagtgaaatacctcttcacacccctgataatggcaaataataataaaaaacaagtaacaagtgttggtgagaatgcggagaaattgaatggaccctgcatactttgctggtggaaatataaagtggtgcaaccaggctggcatggtggctcatgtttgtaatcccagcactttaggaggctgaggtgggtggcttgcttgagcccaggagttcgtgaccagcctggacaatgtggcaaaaccgtgtctctattttaaaaatacaaaaattagctggacatgatggtgcatgcctgtagtctcagctacttgggaggctgaggtggaaggatcacctgatcccaggaggtggttttacagtgagccaagattgtgccactgcactccagcttggttgacagagccagactcggactcaaaataaataaataaataacaataaataaataaataaagtggtgtagctactgtggaaaagtttcgtgattcttcaatatgtaaaatgtagaattaccatatgatccagcaattctacgcctagatatagatgccaaagaactgaaaacaggtgttcaaacaaaaacttgtacacaaatgtttatagcagcaatattcataatagccaaaaggtagaaacaagcccatatatccatcatttgatgaatggataaaggaaatgtctcatatacatatgtataatggaatattatttagccataaggagaaatgaagcactaacacatgcaacaatggagatgaacctcagaaacattacactaagtgaaaaaagccagacacagaggccacaaattgtgttactccatttatataaaatattcagaataggaaaatccatagagacataaagcaaattagtgattgccagagggagacaggagtggggagtgattgcttaatgggtatgggatttccttttggagtgatgaaaatgttgtggaactagatagtggtgactgctgtacaacattgtgaaagtatactgaaagtcactggattgtatacttcaaaatggcaaagtttaaatattaaaaaacctaaagtaaacaaagtgtttttcaaatatatcagtcagtaaccaaaccaaacatccttcatgtatttacatgaagtatctccacaacaacagtgatatcattaatatcagtgataatcatagataatgataacgtactcattatgcacaaggtgctattctaagagttttgcatggatttgcccatttaatcatcatgacgactctctgaaataatcttcatatttttattttaatatgagaaaaccaagacacagaaagtttatgacttatataacatcacatacatggttaataagagatttgattctaattggtctgtttccgaagccaaagctcttacccagtacattgtattgtctctgcagcaaaaaatggaaacaaatagatacttcttggacctgatttttttattagaagatgttaagaaaattatacaacagaatctgtatcaccattgtctttttttttagaatttttaaaatatactttaagttctgggacacgtgtgcagaatgtgcaggtttgttacataggtatacacatgccatggtggtttgctgcacccatcaacccgtcacctacattaggtatttctcctaatgctatccttcccctagcccccaccacccaacaggccctggtgtgtgttgttcccctccctgtgtccatgtgttctcattgttcaactcctgcttatgcgtgagaacatgtggtgtttggttttctgtttctctgtttgtttgctgagaataatggtttccagcatcatccatgtccctgcaaaggacgtgaactcatccttttttgtggctgcagagtattccatggtgtatatgtgccacattttcttcatccagtctgtcattgatgggcatttgtgttggttccaagtctttgctattgtgaatagtgctgcagtaaacatacatgtgcatgtgtctttatagtagaatcatttataatcctttgggtatatacccagtaatgggattgctgggtcaaatggtatttctggttctagatccttgaggaatcgccacactgtcttccatgatggttgacgtaatttacactcccaccaacagtgtaaaagccttcctatttctccacatcctctccagcatctattgtttcctgactgtttaatgatcaccattctaactggcttgagatggtgtctcattgtggttttgatttgcatttctctaatgaccagtgatgatgagctttttttcatatgttcattggccacataaatgttttctttgagaagtgtctgttcatatccttcatccgctttttgatggggttgtttttttcttgtaaatttgttttagttccttgtagattctggatattagccctttgtcagatggatagatagttttctatagctaggaaaaaagtttctttggaagaactgaaagctggcctatgccagatgttaacaaaatagcaatacatgctaggagttagttgtttattatgtcctctacacagtcctcattggttttgtgtttacctctgataatagttgctatatacatatttcagaaatttgcaaactgttttgtttttctcaacatattctatcaagtgtttttttttttcatctcttgaactgagatagaaatttgagaatgaaaatggttggtttttggaattttaggagagtattttaaaagtcagtttcctgaaagctgtttaggcaaacatttataaaaggcaaaatataattaacaaagaataatttcaaaaaatattatgcaaggtaaaagatgtctaaagtctgaataaagagtattaaaacactctttccgatcataaagaacaactttggtgatataaaaaagctgtttctatttggtgatcgccttatacttcaagagggtctaatcagtcctttttgaaaccgacaccttcaatgtctcctaccctatctgaaaccaaaaaaggtaaaatgaaaattcatctcacccactagtctccagcctcttcccctccgttatttttcccctcattgaaatgtaagtgagggagggctggaactgattcttctctgtcagtgcttagaacagtacttagcaaacatagatatttgacacattttgaatgagcaaatgcacgcatacatgaataaatgaatttaccaatttctttgagtctgttatttctgcaaattatatatttatgtatatgtatatattaacatataatctatagattatatgttctttacataaaatatctactcaatccatttccaaataattttaaacatcacaaataaaattaaaagagaaataatgacataaaaaaattcacaagtatccttaatatagagtacgctattggaaaacagaagggaaaatactaatactttaatcaaattagaaaataatagaaatagatttctgctaagtataattaataaaaattttaaaagttccacgtcactaatttataaaaatacacaagtggaattaataggagataccattttcttacttaaaatatttgtaaaatctttaaatcataatgttcaattccatagaggaatgatgaagtaaggtatatcaagtgaaatatataccatcatatgctgatggctgttaggactttaaattggtatagcatttggaggaaataatttagcaatgtgaatcaatagtttcaaaaataatcttactcttgctctcataattttacttctagaattctagtatgagaaattatgatacaaatatgcaaccataaacaaaagaatgaaaaatctctttaagtactgatctagaaataactgtatattaagtggagaaagcaaaatatgtatgatgtatattgtatgctaccttttttggcaaaaaaggacaggataattacatatattcatcttcacctatatactgaaaggtaaaatataaaagattatatatattaataacaatgttacctgtggggtagatgaggtggaagtggataaataagaccatggacgggagcaagatttttcactgtctacactttgtttatataaaaacaacttataagacaaacaaaggtattatctactcaaaaattaaatattaaaaactattaatagaaaaaagtgggatttgtagaaatgcatgttttcaggttgaagggaggaaaaatatataaatgcttttgtttgtgggatgttgtcataattatgtttgggttaaaagaaaattagaaatgtacacaaatacttattggaagctagctatatacattacactgtttttttacattgactgaatattggaagcattccaaatactttgatatattcacataataaaagaccattgaagttaaaatgatgttgtaaaataatacataaaatggtattaaatatatggaaatgcattcatggtatgttaaggtagggcatggatagggaagcaaatgagatgatagtatgtaaagtaggaatctatatttttaaagtaaaaattttcaaagcatgcatacaagcttatatgtacatatagagaaagaactggaaggatattcacctattaatgatagtgcttttctcagggtagggggatgatgggtatgtttcctattatctttattctttaaagttcttcaaataaatactttatgaaacaaaaaccaaaattcctccgcttattaaaggcttagaatgggctatttattatattaagcattttgagcatagtctcttaaatttcttaaaatcacacaaggtaggtcttatgaaccattttacagatggaaaatctgaggctcagagagattgagtaacttactcaacactgcacaactagtgtaagatgcaaaactcaaacgctggtctgtctgtctccaatgctatttctctatcaccctactaaataattcaacaaaaaaaccctgcttgcaattggaaaacatttttcctactagttttctttttaagtggcaaatcttttccttggttatcagaacttacatttttgtgaagtgtgctaaaatgctcaagaattccctgacagtaatttaaattaaactatcttgcatatgtgaattatttcatgtttttttacagtagataaaatatgctaatttgtgtaaatggtcttctgggtacagatgcttacactgaaagcaagcttatcttaaaagctgcttatctttcatttgaggcttctttatatgcatagtttatttttctaatgctgtctcaatataggaataattttaaggaggtatttgtggctaaatgaaagattaaaaaaaaaccaggtctcttggctttggtaaatattaatgagctcatagaaaatcttgttactgaagtgggccctcttttgagagttttctgccatcttggccctttgtgggcccttctcctttgttggggattagcatactgggttgtgtgtgctgttgtgagttctgcttcagttcctttgtgtgtgctgacagaaggctcaccttggtctattaccagaatagtctaggcatcttaatattatattggatttctgtgagaaaaaagcaaatcatccagaaataattaatctgacttattcatttaaaagctttaacacaaaatggacagtgttcatttcggtcatttatatattgtcatcattaacaaagtaaagtccaatgtttattaattttcaagtgaggagaagttcagaatttgaattatttttatcgatattcacacatatattgtatgtgcaaaattattacagcacatacacaacttgatttaggcactctgttttcctttagaccaagcatcatgttcacttgcctacagatttctaaaaattatttttagtttcataagcagtaatattttttaattgtgttaagaactcagagaaggtaatgttggcgctattattaccacattggtcatcctctaaaaacagtgttgtgaggttggtgttagatataaattgtgaatgatgattaagtacatttactgatttcattctactatatgcaatcctgaaatatgagaataggtatatttaacttgttaggtaatttaatgaaatatatttgctgatatcattctactatatacaatcctgacattatgtaagaagaaaaaaggcaattccactattgacaggatataggaatgatcaaaattacttaacataaattttgaaaaattaaatttcccatgcatattttaacttctccattagtccaacaggttgtatgatgcttataagggaattatttggcaaagaaatattttctttttaagaatgcagtatatgagtatagtcacaaggggtcataaattcacacccagtttttttaaaatgagcccattggattaaaaaaaatcagaaaaactaaagcagttgtttgaaaactttttttaggcaagaaaaaaatgcattaagcactttcaagagttattactgtcatcatacacttcttcatcttctttcatagaagttcaatataccagacatttttactgtcatgaagagagaaaaatgatagttcaagaatataacaagagtatttggaaacacagatagaagtgtcattagcccactattaagtctgtactgaaaaacgttctttaaattttgtgctcaatcatttgaataaaggatttaagtccttttataaaaactgtttttggaagaaattttataagaatttttatcagagccaattttgagctgaggttgtggctggtaatattcagttgttgataaatggagtgtgaatcctgagagaaaccacttcaatagtttgagaaagaaggagacaatttctgaaaatgatttcctaatctgagaaacagagctttcttctgagaaaagttttaataattttaaaaactacagaaatatggagtcatggtcacatatagccatttttccatagttgtatttgtggtgagttagaaaatagatatataataaaggtctggaaatgcaaacagtcaaatttaggtttgattattattagttttgagagaaagacagagaatagtacttaatataaactatcattatgttacttctaagtatgttcctttcaattcagctgtactagtaaaattttactttttttttttaataagggttaaaatcatggttgaaatctgaagcatagacttgatatattgctttcctatgctaaggttcctagccctggacactaattctaggaaaaatattgaaaagaggaaaagagctctcaaatattaaaactgcaccataaagttcaaaagtaatataaactttattttattttattttatttttttttttgagatggagtctcactctgtcgcccaggctggagtgcagtgacgggatctcggctcactgcaagctccacctcccgggttcacgccattctcctgcctcagcctcccaagtagctgggtctacaggcgcccgccactatgcccggctaattttttgtatttttagtagagacggggtttcaccgttttagccgggatggtctcgatctcctgacctcgtgatccgcccgcctcggcctcccaaattgctgggattacaggtgtgagccaccgcgcccggcctataaactttattttaaaagcttgactggtattaagaaagcctataataaaactcaaatgtatttttttaaaagatagctaatttcttcaatgaaattcaatatgatctgaatttttacttagacacagctttccaataacatattgtggtagtaagaatgctggtccttccaagatgtccacaccctaatctctggaacctgtgaatattaccttacatggctagagggatgttatatagttgtgatgaaagttaaggaccttaagatgaggagattatcctagattatttgggtgcgcccagtctaatcatatgagtccttaaaagcagagaaccttgctgtgatttaatcagacagagatgtgcctgaaaaaaagacacagagatacaacagtgctggctttgaagatgaaggaagacgaccacaagtcaaggattatgggcagactctagtaactagaaaagacaagaaaatggtttcttcccaaatgtcccagttaacacttagtccagtgagacctgtgttggacttatgtcatacagaacaccaaaataataaatttgtgtagtttaagccactaaatttgtgttgatttgttacaagagcaatagaaaattaatacacgcgatagtaggttgaataatgtccttccatatatgtccatatcctaattcccagaacctgtgaatgtttccttaaatggcaaaatggactttgcagatgtgagtaaggactttcagatcgggagattatcttgaattgtctaggtagaactggatgtagtcttaacagtctttataatacagacacaggggtggtccaagtcagaggagagggtgataagctgatgggaccagagactgaactttgaagatggaagtaggggccacaagccaagaaaaataggcagacaccagaagctgaaaaagtcaaggaaatagatgctgttttcagagactccagaaaaaaaatcagcttgaccacacttcaactttagatcattcaaatagagtttggacttctgacttccagagcaataagataataaattcgtgttgttttaagtgattacacttgttgaaatttgttacagcagccagaatacactaatagagacacatttatgatataaagtgaggtatatatatgcaagaggctgcatgggcataggatggatttttgattctttgaatagaaattttgctataagatcatagaagctatgttttcaggtaaaacccagtttactttaaaaaaattttttaattgacgtataaaattgtatgtatttaccatgtacaacatattgtttggaagtatatgtaccttgtggaatgactaaatctagctaattaacatatatattatcttacataattatcatgtttgtggcaagaacactttacatacactgtcttagctttttttcaagtatttacatctatattaagtgaatttaactttaaaaacttacaatgtagtagcttgtgagaaaatggcggtcatagttcacatctgtattttcacacattgagtaggcccctcccacatcagctctgggttttaccagataacttactttggctgatagaacagtgtcaaaaatggctcaagcaaaggcttaagaagtgcttttgcattcgacttgctctttcttgtcgctgataccctttttcactgtctgaagaaacctgagttagccttttagaggatgagataccttgtagagaggtcccagctaaggcccctaacgtgagagttttgctgtcatagaccatcaaaccccagccaaactggtacagactggaagaactactcactcaacccacaaaatcagaagtaagaaacgtttgtttttttcagccactaagttttgggatgatgtgtttctcagcaatagataaccactgtagtgcatttattttctcaggctgtaaggtgcatttcagacatgactgttcctccagcaatcataaggaggtagcattagctatcctatattagatttcttctgaatcatttgttgcctttggtttttcagggaggtgggctagaaattggactagggacttcctgggcatcctgaaactactgaaattgagtaccttgacttgtacttttcagaaccaatttttaaaaatctttatcctccagaatatatccaactaaaaaaattaggttagaaatatttttgtaaagtattttaccctttgaatagattctgaatgaaaaggagaatgtacttcttgctaaatgtctatatttgtataggcctatatgagtatggtagaagagaggttgtctaagcagccacctaacatgttttaatgctgcggaatatcatggctgatgggtgtcctgcagaggcagtgttacagcactgaggacatgcctcagaacatttccctaggcattctaacatgttcagagatggatatcatagtggttaaggctatggctgtggatatagactttcagccatccaattctggttccgctttttactaggttatttacttcaccacatggggacaataattgtacttattcattgggttgttatgaggctttaataagttaatgtacaacatttgtaggagttgctggctggttgttagtgctcaataaatgcctctcattgtatgtaccaggcgattttacccccacccagagtctgccttgctgtagctgtgctactgtcctatgttggagaggaggtgttacctcattgggacccttcagtcaggtggttgaagtcagagctttgtagaaaagaaactaaagatccatttgcttctgatgaaaacttactaccagaaaatttcctgaaaaattaaagaatatggatgcagtccctcctggtctctcagagagctgtatattaatctctagggctctgaaggaacagtttgaagacaacttggccagataacctctgaagtccccacaccccgccccaatgctgctctcaaattaccacctcatggctactcctctcatattaggaaggtgatatttatttccatggaaaacaacaaagttaactgactcctttgggaatggaaagaatgacaatgtttccttcaccatgaactcaatcaactaaaataaccattcacgcctcccagctgctttcaacttttcactaccaggaatttccctttacctcttgacagaggaactcctgcagttatcttctcctgtgaccgctcatgtttgcaggcaaatatattctccttcagaggagctgacataaaagtattttaaatcaaaatgggatttaatatcacttgttattaaaatacatttctggtgcctgttttaagggtttattttcttgccaaatagtttagtgtaaaaggagagaaaataagtaaatcttatactatctaaggttaaaaaatttacgttttgtgatcatgatgtttgtattgagaaagtatgtgtgtgtgtctgtgtctgtgtgtatagcctgtaatgtgtaaggatatgatagaaactatatcacccacgcatttcattctattgccttcatgcttagttatttgataaataactgtatctcttatggcctaatgtaaaataatgaatcaaatttccccagtgctgaaactagtcgaggccttttgggaatacttttcaaaccattaacgcattaatgtgctgctacctatgtgtcctgaaagggttactgtaggtttcaaaaagggtctaatttactagctaatggtatttttttcgtaagagtcacttggctttgcggaatcgaatttcatctttctgcttttgggttaattcaattgaatttccagcaaactacattgtttcattctcattgcagtcagtccctcatcttacaaaccattgtgttccaaaaactcatttgttatttggttatttggaacttagaggtagttttcaatagaaaaattaaagctacaaatgttgggtgtgttcccagaatagcccacagaagccaacttaacccatcatatgtccagtcctcatgctgctatccaacaaaaccaacatgaatagcagtgcctataaaggtagcgtgctttgccagatccaagctgggagtcccagagctcattcttctatagcagccctgtcagtaggagtgagaactttcctgtcttcattcctccaacctcaaaagaagcaaagtgagaacacagcccagccataaaccatcaacagtgactgtgattgtttgggccaggggttgggggtagaattactcagggacaggggactatgtaatagagcttaagcatcaagatagaggcagaggagaatgaagagtcaaaattgtttataagttgtcaggatgtagtgaggtcttagaatgaggagtagaaagattgacaactaggtgactgggtgagtgaagacctgaaactagattagatttaaaggcttctgccaccctctcttcccctttacaatttcagagtcagctacagattcaagttcacctaagtaggattgcttggtaaagagcaggcatttcactcactggaaggctttataagaaatagctcattttttctgccattttttttgcccctgaggctcttgctcgggtggaaggagggaggccaagggagaatctcaggagagcatgggagcagattagagtggtatgatagaggttctcaggcagagacaaaaaagggatctcaatcttggtgtgcctctgctcctatctctgttgttataatgggaaaagtttgaacgtcaaatggaagagaaagtgaacttctagaagaagggatgtcaatagaggagcctctcctgcatgtctactaggacagtatccacgtgtaataaagtcaaaccaaggtggtctttctggatttggcttttctgacagtttcctgagaattgtctcaggaggaaaggatgcagttctcaaatgtttctttggaggaagccatatacctgtctaaggaaaccattataatcttagaaatgagcttttgtaccagatgtaccacatatacaagattctcataggaggatccttgatgagcctttccttctcctgtcttgagtgctcttctcccctcatttaacccagttagttcctacacgcctcttagcatgcccatgtcatgtgctcacgaaaacctttcctgaacatgtttcccagtcaggctaggccagaccctgagatagaagcacactcaaagcatattttgctgctgcttttcattatttttactctctgtcacaatttgaagtacataactcattggggaactcctttttaaatggttgtcttccccttcaagaaaccatctccatcaagacagagactatgaattaaccactgtatccagtgcctagttcagtgcctaacacttagtaggtctttgtaaatatttgtcacgaactatcaagaagcagaaattttgtatcttaacatgtctttgtagggaggtcacctttaatgcatacctttgactattaagaaacttaagtagtgcacagagaagatgtagagaactgttaaataaaataaattgacttaaatgtatcattgcttagtataagggtggactctagacagcctttatatctcaagaaatttgcctacttctatgtcaaaattgtattagtacctatgaactttccaaactagttaatgctgttttgagttgaattggctttagaaattctaaagtggagagctgcccttggcttgctgcattgagcagactacagttcttaggtaggaggcaggaatggtcctgaggaacagtcagcatctctgccatccatgcaccacggtagtctagagcaactgagaaaaccagatgcctccatagaacccacaggtgtagacattaacaataggacactgtggatctttgtgttgatttcagccacccacccaagtcattaatttatagtttatgcccttcacaaaggaaatgtttttgctaacaaatctcttatgatttcatctatttgtcttttcctctttgtgttttgtctcatacaaataatagttaacatagtgacacaaacaccactaaaatacttcagtatttttctcaggacttattcattttacctggaaggaaattgccgtataacccatgccattagaaaattaaaaatgcaaccatttctgcagctcgtacgtcatatgctatgtaatgaaaacgtgcctagcctcctactcccttgtatttgccaacagaacttaagcaagttctgtctgggctgcactcacactttcttagtgccagggagatgattggatataaattacatagcttatatttcctaatatactaaaaagaaagggaaaaacagaaaaggaaggaagtaaaggaaggaaaaaaagaaaaggaaggaaggaaggaaggatctctaagtgtgtatcaccagaagcttagagagatgatattttaactgtagaaaattctcgaagattaatctactatatcatgattctttgaacttcaaagtatacccccaaaatataatatgtgaacagttgagtactattgcatatttcagtcaaaactaaaaacaataatctgtaactgaatatgtaacttagaaaatatcaatataaattttaatctaaatgatctgtttattcctttctcaaataatgacttcattttagtaatagagtgttttatttactcatataggcatacataaatagattttaagcattatttgtgatgaggcataaacatgaatcttctaatagaaagtggtaccttggggtaaattttattagggaaagatttcacttatgtgagctatcaaagtgatcaaattcatggaaacagaaggtagaatggtaattaccaggggctaggaggatggagaaaagaagagttgtttaatgtgtacatagtttcagatctgtgggaggaaaatgttctggagatctgtttacaaaaatatgagtatacttaacacttctgaactatacacttccaaatgcttaagatggtaaattttatgttgtgtgttttaatcacaattttcaaaaagaaaagaaatattcataagaaacttgaatattcttctagttttgcaaattatccttattgtttagcctcttaattgtatatcttacaaaaatctagatttagaatacaaaattattatgtgtattttatcatataaactcatttgagatgttaaatgatttagaaacactataaaattatagacagtttgtattcactttttcaaagttagttaaaacagtgttgatgtttctctgaatattgtcatgtttcataaaaacgttaatcttcagtaatttacatttattagaataatagtgtaaaacatgttatttacgatcattaaaagttagagtgttctaaccaattattactatttattgttgttattattattattagtttgagacaggatctcactttgtcatcccagctcaagtgcagtggcacaatctgcttactgcaatctctgcctcctgggcgcaagtgatctgctcaccttagcctcctgagtaactgggactacaggtgcatgccaccacacccaaataatttttgtattttttgtagagatggggttttgccatgttgcccaggctggtgttgaactcctgggctcaagtgatctacccaactcagcctcccaaatgctgggattacgagtgtgagccaccatgcctggccgtaaccaattattttaattaatataaataatcagagtataacaaaatacaccaaaactggttatattatctttataaaatatgttttataaatcactaacaaataactaatctggttggtgataaatatgtctgcttttacttattcctctccattttagtattgtaattttttagcattctatactagatcccatgtacagttgaagttttcttttgtttgttttccctgtcaggcttttaattaaagaataataagatcttatattattatagatcttatatcgcttatataactaaagagtacattcaaccaaactttaactgaactttacttgtttcatactggtggaaataagcacaatgtgaataacacctgagactgtcactggtggagagcgctcatgagcccagccctccttgggcttccttactggcctcccagccccacccttggcctgtgccatccttaatgtgaaatcccattacaccttacctaatctctcaaatggcacctatcagatcttctcttttattcttgagtattcagttcctcccttttttttttgatctttctaactgacatgtttacagccatttaagacacacagcacatgtacacatgtaacttccctcaaatccatgtgcttcttccattactctgtctcttttcttctttgcatagcaaaactgatctgtaccaattagtgaccgacatccttaatctagcagacaggttttagtctagttttctattgtccagatgatgttgcataatcaacaatgtcaaacttcaggggcaaacaattctgaagttaaataaagcactgcctagttcttgtacctgtgagttcgctccacccttgggctctgccctgctgtctctatttcttctggaactcaatggctagacaggcgtgtccttctcatgggaagagcagaagcacaagagggcaagtggaaatgctcagatcctacatgccatcaatttttcctttttcttttggctaaaacaagtcacttgaacaaaagaaactatactccactgatttttgtgggtgaaactgcaaagtcacacagtaaagaatgtggatatatgaagaggggaagaactggggccaagaacatcatctaccataataatcttacctacctttggagtagcaatgagtactataggcttttgccttctttaggaaataccctcttcctgtggcttccataatgaaacattgtcttgatttcctcccatccctctggctgcctttgtttagtttcctttgctggtccagctttctcaagacctggtaccaccatctcctcatctttttttttttttttttttaatatggcctctctacttagtgttatccatgattctggaactcattgccacccaaataaagctgaagcagagatgcttaaattgttcccttagtttcaaaaccatatatttaattacctattttatatttcttccaagatgtttcaaagacacctcagactcaacttaagcctaaatttaaatttaaaacatttataattattccctcttgtacccccagacttcttcagtgctccctagctcagtgaatcctactacatccattgagttatagaagccaaaaaaaaataagactcatcctcaacacttcttttctcattaagctctattgattttattgcctaaatagtcctggaatgtatctgcttctttctgtcactgtggtttctccctagtctaatccaccattctctctcacctgtagcattgtattatcttctgaacctcatctccttttgcccccatctgatctgttctctgcattggagccagaaaaatcttattgaaaagcacatctaataatgtctccttccttttaaaatacttcgaggactttccattgaatggatagaggtaaaatgcctgacagacctatatgcatttttgtccctgtctcatgccatgcttaaccgtattactttgcagttccgcaaaaaacatatcatgagacacagattttgtagggcatttatttggaatatgaggccaggaagtaggagtgagggaataaggagaatgaggaaaaaacaaaataacacaagcaaaagccattgtaagagtgtatgattgagtttgcctctctagggaacggtggtctgatttcatagcacatctagaaagtctgcagattaggacccataattatatgcctgaagaataagcacctagttgcatatatccactggctccccattgtttgagggttgcactcacttgtgtttagctcccctgcatttcagagccagacacgtgcacatcctccctgtctttgcctagttaactcctatttatttttctgaacccacctcattcctgtgacagaaaacccctgcctctaaatgaagcaggttcttccagttttctcaagaccacatgcctctactatacaccatatatatcttctttgcagtgctgattgctgtgatgagtttgcattttttaatgattatttcatgaaaatctttctgccctctggactgcaagcttgagaagaccaagtttcatgtcagcttttgattttcattgccttaccagcacccaacctaggacctggtacataaaatatgttcaatatattttcaacaaatgtgtaagtataggtgtgtgtgtattaatatgtgtgcatgcatgtatatttataaagggaaactttgaatttttagagcttaaatagattactatcaatatctaaaaaggttatcatttttaattcaaatttcatattctatttttacttattgctttcttttagtgcttacatagtcgaattataccagaggcatctgtttaaaaaaagtcatacggagaaaaaacagagaactcttgctttacattatcatgatttatctgacagcttatagtattggtggcacttttctgtagaaagttatcgctaggcagttgctttaataaaacagagatttttgagttaaaatgggtaatatcagaccataaaagacaatcctttacaatcctgccttattcagtagaagtcacattcgttagtgttgagcaatttgaggacttaggtacttacaaatatatatatatatccatcccctaaaacaccatgtccaaatttttgtttcatgaactgggaactgtgacttgataacaggaaatatgtggcaaaaatagatgagtgttcagtctctggggttttatgctgatataaaataataacaaccaaaatgggaatggagaggcagatggaaatcaacaaattatttttaatgaagtaaaatacttccataaaagtaagctaccagttggaagttatcactatttaataaatgttttttatatttctagttaccatgttgtatgccagatgatccagcattaattcaacaaataatatggtacccttggcaaatagaatggtcatcatggagatggacatagtctccaccttcaccgggatggttgttattgctttatttaaaaatgcagttattttctctgaaaacatctatacagatctatcatgtcctgagctttttctaatttcttggaagggaagccaaagtagcatgcatctaattcagtctcagacctcagcttccaagagatgttattaactgtggtgaaaggattagtaaaatagtaaatggattatgagatagttgtatctgtgtcaattagtggttgctgtcaattactagttgcttatattcactttctctcatttagggagtgtggagagtagaatattaaatgtctggtgggcacagagtctcttttcatctggtagttgtcttagttatacacggggctataaactgaaaatggtgtgtaaccctttaattgaagactctggggtcctaaaataatttcctcaagaacactctggcccatagaataaacattttgaaaaatattttctttggtttattgcatatttgaaatcagataatatctgtcactccaggatctataaactcttgcatgtgggatatttttaggtaaagtgatttttttttttttttgaggaataccaaggggatagtggatttccatgaacttaaggatcacagtttttgttaagccgaatacccaacttgaacaaattttctatttttttgttgttgcttattgacagatgtgccatgaaggtgtttttaaggtctcatgaccctaaaaatggcttacgataagcaaaagtaatgtcagctttgtcctgaggggatcttgattcacttatcagctgaaaacagctgagcaatcaaagcacaggttcttccttggtggaagtgacaactctagttcagaatcttccaatctgaatctaagatcatccttagaaattagggtgggtggagaaaccagagtgatgtgtgctggagccaatactccatcagagtgggagagtccactctttcctgttgctttccccactcaggccttgggctattttagatgaggtcaccttagccatgttctcaccactccagctttgggccatctctgatgagttcacctcagccatgttctcatcattcctcctctggggcatttcggatgaggttaccatggtgggcacatttcttgcctcatgtactttagaatgccatgtatgcttttaaaatcagagacaagtgcctaacaacttcttatttatatgtttttaggttagatgtaaaatgacctgagaactgcagccctcatgagcattggctacgtgaatttttgattaataaagtctagtaaattcattgactatatagccttatctaccaagaaaagataacttaatttttgaaaggattacttagcttgctttggagagggtcaaaatttagtagaaggtgtgtcaaatgaacattattgctgaagtaagtctgaaaaattcaaaactgttgatggtgagaactgaagtgtttattatattaccctgggtacttttctatgtctattttcctttggaggaaaacatagttctaagaatctaggaggcctgtggatgtatgaaattaagaggaaataaatattctatcaataggaagaacttcaagaaaacccaaattgtccatattctgaacataacatttgttatatgtgttatactcaatttagttgcttttgtttatctgagatttctgtagctttcaaaactgatctcttaagatttactagtaatgtgagttattaaggggggcaaaatttcattaattcattctgttttctaaatactttcccttatccttgcctctctcatgcagtctttcattgtttctctcccatttattttacaagaaaataaaaaatcttactgagacttttaggccttacatgatttggcatctccagtgaccagaaacatctcctgtctcaccattgcttactaaactccgtggcttccatcaattcctaaattatgtcaagcttttttttcatatctgaatcttgctttctgttccctctttctaggttactttttatgtatgttactccttcttctggtctgagcttaatcatgtcccctcctcagaatagtattgtctgaccacttttctaaattcaacatttcatcttatttttctcacagcatctgtttattgtcttcattgcatttgacataatttatgatttgtaaaaatgtgttggcttttctccttaggtagtgagcttcatgacagtaggaaccttatgtatcctgattattaattatatccctggtactaatagttagtttgacatatgggaggttatcacaaaaattataatgtatgaatttcaactgtaaattggaagcttgtcaagccccttcatggttagtgactgacctgttttcctcaatcttgatctaatgaggctttagactactgctcctagctttatgaaaatatttctaacaaataccatgagaacaaaaaaagacaatgtttaaattctgaatcttgacaatgttatactcttttataagtgatatgctttggctctgtgtccccactcagatatcaccttaaattgtaataatcccacgtgtcaacggtgggaccaggtggagataatgtttcccccatactgttctcgtgatagtgagtgagttctcgtgggatctgacggtcttataaggggcttccccttggctcttttctcattcttctctctcctgccaccatgtgaagaatgacatgtttgcttccctttccaccatgactgtaagtttcctgaggcctccccagccatgcagaagtcaattaaacttctttccattataaattacccaatctcagatatttcttcatagccgcatgagaatggactaatataatgtttattgcaaaagatgacatttttgaattaaatatctgaaagaaaataaaggtgtcttgtagagttttgtttccttcatttgttatcctaacataatagaaataaagaagtaatacaaagttttaggaaaacatagcaaatgaataatacagttatgactttaaaaggaaatcactttcagtaacagtaaattaaaatcttaattattatatttcacttctctatagcaaattgaaaaacaaaacaagcactgtgaaacaaattagaaattcagtcgtaatactctcaaatgtactaaggaatttagaagagtaaatttcatttagtttcaaaagattaaaaagtacaactttggacaataacgttatttttcttaggtaggcattaaagaaaatagatcccatatgtctctttttaaaagactgtatctaggccctggccccggaccctacagccatcaagatgttgatgcctaagaagaaccagattgccatttatgactcctttttaaggagggagtcatggtggccaaggacatccacatgcctaagcacctggagctgtcagacaagaatgtgtccaaccttcctgtcataaaggccatgcagtctctcaagtcccgaggctacgtgaaggcacagtttgcctggagacatttctactggtaccttcccaatgagggtatccagtatctccgtgattaccttcatctgcccccggagattgtgcctgccactctatgccgtagccgtccagggactggcaggcctcggcctaaaggtctgaagggtgagtgacctgcaagactcacaagagggaaagccgacagagatacctacagacggagtgctgtgccccctggtgccgacaagaaagccgaggctgggactgggtcagcaactgaattccagtttagaggcgaatttggtcatggacatggtcggccacctcaataaatttggagagggttattttgcattgtataaacatccagccaaaaaagcttaaaaaaaaaaaagaaaaaatctaaaccctcactgatttcagatttattaaaaaaataaacacaggtaatttccattttctagtgtctcctttgctgcgtatttcttttgtttaaccagaagatcacttgtgccactagatttatagaatattaagtgttactcacttcagtatttgtaatgtcattatccattttaggataatttcaacatttgtttattctggaaagcagaagtaatctgcattcagatacaatggcaattccatgcccagaatgcttccctgagcttcacggcttattaaagcatgcagtcctgtatttccacagccatactaagtagctggattcaggcctgtgaatttggtaatgctcagtacatttcaaaacgtggactgggattgaatatttaggtaagattgacttaaagataattagttcatatattataacagatgctttaaaggagtttgtgactgagcaaatccactgggggacccatgcactgtacagcattttaatagcttcccatggagctggtttttatccagctaggctttagtgtgctgccatctccttgtgtggagaggatttgagtctcactgtggatcctatcattggaattactctaagaatatcatagaaaatactgaggatctctttaggatttcagtatcagagatacttgttctcatccttagataagtactattaaagtagtttttattaggtaaacactgcaaatcttgaaattgatcatttttttctctctttaggttggcttctataactctaagaaccaaatatgggggcccacttataattgcagtatttcatggcatgtatctctgtatgaatccacctatgctctccatcttactctcctttttctatctcctttttcaagttcatattcaattcattgtaccttgcttaattatatgctttctgttaagctgacttgcgtgcctttttgaaatgaggtagattattaattcattaattactgtatagattgcttttctggctcattgtaattttcaagtcattagcacaacaggagaatttataaggtatttttgatatgccattagacgtatcaaaactagacattgggaaggtcttacactcttcatatgcttatgtaccttatatttgagttaattttcttaaataatttctactacataggaagctgctgaaaaattttaaagagtatttgatagcataactaatctagtacaaaaattaattaataatcttggaaaagacatcattaatgtttaggtagatattccatgccatcatttgcataacaatatcacattatgctttatcttcatattcaaagagttttcaacatacaaagagattctattataaaggtgtatttataagttagtcatttagaatgcagagttcattttcatgaacaatcaagtttctaaatgacagctaggttagcccataaaacctgttttgcccatagtatataagaaataattttaatttacagtgacaaattacagaaaatattattttacatcttaaaatagaaataaaagcacaaaaattaccttattttaattttgaaggctaagacaaaaatggtataattaggaaatcaggacgtagatacgcaggttcttgtagatgctggagagaaattctgggtatctttaaagggaggaggatttattgtactgtgtgatttcactccactgtatattagttgtcccttctttttataaatatatcattaatggtaggtgcttttctgattatcaaggaggattaagttccctttcaacttaaaaattaaatgagtaacagaggagaggagcagcaaaagacagagtaagtgaattggtattcctgagataaacagatgggagctggagcagaggcatctgagtaagggaagtgcttacctgggcattggacatgggagagattttctgaggtggctctaaatgagccataaactgctgaaatcatgagggtagagaggattcatgtgttgcacagaactcccaaggggaaaataacaactgcagatgaagggatatggatcacacaggtccccacgtttcctgtcgggctgggggcagggtggagtgagggcagggagggatcccgcgtagatggcaagttctttatttccaggtggtggcaagctgggtgtttgcaatcttggaagtgcttatacttataaaactttcacttactctgggggtatctgatactataagcatacagaaatgatgcagaattttattttaagtataaagttctgagcctggggccaggtacataggaaagtattaattaattttagttcttattattttctggcatttaatacaattgtcagtggaagttattaatactcactatttattattactgaacacagtcctctaaatcatgagttaagtaaatctaaaacaaaatacagagtactgtttccccatcactctgccccagctccatttaggaccttgttccctaacatgcaccatccaccaggccttttggttctttttaaccttttagtttcccttccttcacattattctgagttatctgctatccctcccagaaagtgaacatatgccctttaattactctgcctccattcaacgttttgaacctttcctcttcttccctttaccagccaacaactacaaacttaggtctccacttattattgtcacatttttactagcaatttacaacctcagctgttcaaaatcgagccctgattcgtcaacgttactgaaactgctattatggaagtgaccaaaactctcctttgtgcagaatttaatagtcttttctctgttcttgttctctttgatttttttgcagtattgcagtatcgaggctgttagccaccttcttctggagctcctcctcattgtttctctgagacctcctcatcgcacagctcagtctattgaaatcttgccctttcaggttccatcttagatgcctcctccttattggacccttcctgattctcccagctgccctcaataccattttgtctttgcctctattggaaagtctgttttcatctttgacatatagatatttgggtattgttaagatctctgctctggattctgagaatgaggttcttgggaataggaaattgccttacatttacttactgagtaaattcccaatcaacagttgctgaggactggctttctttctccatgcaacctcctgaaacattgccattgctgtacattattaatatttgagtcacgatatctatacctgaggtttaaaagctgacgaattgctcatttgattgccagcatcataccccgactggtgagtgtgctccatttttggtgaacacagaattttatacatttatttcagtgagtttactgccccttccttcaaagtagttctcacctaaacttgttttttattcccaagatccttattatgaaatagctgtttcagctcactggtatgcgagagcaagtctaatagcactgaatcctgacactggttctgtgttccagctctcactggttcctctcctggggtgctttttctctgactgcttttttaaggccaccaatctgaaatgcagtttccatttgacagagctgtagatgagcttactctgaaaacacactacttgcccttgggtctaaggtgctcatttgtagtccccgcacataaacctaggagctccttactttgcaatctgcaggtgctcagcctattgcatattggaaagaaatgttgtcaacaatgaaaacaagtcagtaaatacttaggcattttctcactagtaaattgctgcaatctgaatcatcaccatgttctcccaattcttttcccattccatactaggtagatttatgtgacatccctgaatatggcttctgctggtggctgctacctgaggtctgttctcctgccaccctctccgctcagggcctcggctggttcacatggcctcctgctggtgaggctgatcacttccttgcctgggacccttattaactctgcaaggtatccacagccttccccaagagagattggcagtcacttttatgcccgccagggtctgtgtcatgctttcagcacaaccctccacttattccgtcatgtagcatattagggattccctcctctcgaacttatctcctctcaagtgtctatacaagctaagaagacttactcaggagtggggtcatggtgtctcttcactgagtgacagattcttctttctcagctcctttgaaatagataagagctagtagtactgactcaatttataagatggcaaaaaactaagtaaataaaaccatgccaaatcaaaaacaaaaataaaacccacctaccctgatgtcttttaaagaagccttttgatcataggattggacattctctcacttacttactgagcatttatttctcaggtgtctacttagggtaaactccgcaaaagttcctggtaatgctttgcctatgtcagtgtggaacttggcctattaaatgacaggcagacaggccaggtgcagtggctcatgcctgtaatcctggcactttgggaggctgaggtgggtagattgcttgaggccaggagtttgagaccagcctgtgcaacatgacgaaactctgtctctactgaaaatgcaaaaattagccagatgtggctgtgggcatctgtagtcccagctactggggaggctgaggcacaaaaactgcttgaacccaggaggtagaggttgcggtgagctgagattgcgccactgcactccagcatgggagacagagcaagattccgtctcaaaaaacaaacaaacaaacaaacaaaaaacataaatgacagacaggtaagctaagcacagaacaatgtcagagtgcagttaccatcgagagcaggaaaataacagagaacagagaaagggggaaatgagcttcacaggatggggttaggaccaaagaaagtgatccaggaagtggatgttaaggaatgaatgaaaatgcagagaaaaggatgtaaaggagatctttgtgatatttatgcaagtcttctgtattttcaaaactccttctaaataaaaagttaccacctcaccaggccaataaagaggaagctaagagaaaggtattcacaacatacagtatgcaaaaaaacttgtcgctcatttggtgttactagaccttcagagtcacggggaaaccctggagacaaagctggtgtacatgcagttgaatctggatggatttggatttctaaaagggaaagacagaagagttctaattaatggaatggaatgatgtgattttctttttagaaaagtttctctctgtgactttgtggaaaataggtaagaggtcagggatgcatgtgaagggaccgtgatctaggtgaaaagtgatggaaatctgtatcaaggaggtggcaatatgactgacagtaaaagaagaagttcttgagatacttagaagatggaattaatagggcttagtcactgatgggatttaagagagaaggaaaaggatttaaagatttagacttatctggccagagtgattcaaattcatagaaaaagtaacctgtgagaaggagcaggttaaaaggaagaggaagggaaccacttctgttttgagcagcctgaatctgcactgcctatcggatagctgagagacggtgtctagtggcagctgtacatctaaaacccggacttgggggaaagatcacaatataacttagagatatagatttgaaagtcattaatagatttagactgtcttaccctggaatccatgaatagtcctaaggggttcacaaacctcagatatatgtatatactttccccttgggctaaggatctgcactgagtatttccagttgccttatcccacatgcatatatgtgcatgagatcacttatatcccttctctgtcctatgtctatctatgtccccaagaggctgatgtgtttgctggcattacccgactcccttgccatttcttatggtgaggcattggcaggagatgagagggaaggagaaggaaaaggttgggatattcttttcccgccttccccacattgggtcccatttctggcagaggctgtattcctccaggactatggtcctgtccagagtcccctccttcatggagccagcactcccaagcctgcagtaacacaaggccttcagtcccagcgggtcccactttttgctcttgccgtcctcttggtgatttgacatgcttttccagttgcctgaaacctgcccatacatcatgaggagtcccttcattatggtctttgtaccatctgaggtggattgtttcttgccagattccatgtgtctttttttggtgctctagtatacacttgtgggagaaaaaaactcttacaagctatggggacggctgaccacacccacagattgtggcccgtaaactacctgtgaggaccagcaagtaccttcatggatccttatttaccctaaaacagtttctaaaatcttagtgacaagaagttgttaccagacatcccaggtgaaactgcacccagtgagtattgtaccaaattcctaggactggcctcaagtactgctgagcttagaaggggaagagaatgtgagagttcagaatctatgaatgtgtccagcataaagagggctgaatgttacagtgatgccttcaatctaacctgaatgttcttcttgtatttttgatatttattttttttctccactttttgaggtggagagggggatcaggatggatggaatatttgatagacaaggaacccaggaatttctccaccctgtccagctaaaactatactgcttggcagagttcccaagacggcactgtgcaaacaatggcagtgaactggatatccaagtgctgccttaccagctgaaccggtacctagtgttccagcaaatacttcagttcaaaacttaagcagtgcctcctgccctctttaaatttgagaatacatatcaagcacctggagtgcaggttcttacattttaagaaacagtgaccccactcattagaaaatgtgattcaattagtagcttaggctctaaccagtcagattaacaactccattctctattccctccccgctttctctttctcccctacacccatccttactctctctgaggacacacaggagttggcagaaatgggtctggtatgaggagagggctgaaagctccctgtccctggactcgcctcagcttctcttctgccatattcctgccattttttttttcctactgactctcctcgctggcacacttttttcttcctgactttttgttgaaaacgaagcattagataacctgggggacaactgaccttgtatgcctatgtttacaacatgttgccacccataggtagccaagtcagtgattcatcaggagttagtagatagggtagctagtggtggtgagaatagaaccattcacctcttttctcttccagaggaatcagggggtaagatattagggttgaaagggaccctagggatcactgggtttaattttttttaacattttcaaaacgccttagaaacctgtatttaaataaaatctttaaaataaatcaacatatgaaacaggccttgttctggatgaagtaggttggaagtctgagtccacatgaaaacaccatggctccttcccattgtcactattgcgtggaggctcctgggaaccctgaatgcttcatgaagtccacctcgaaagccttcagttatgaaaaccttatgaaaacctgctgtaccacagacttaaaggacttgctcacagaagttaaatggcctagagaattggagagcctcctaaatctaggaagcagcaccttaatccacattacattgccttcctcttctctgccccttcaaatctacaacattggattcaggatcacacagctgacaccccattcacattgccctcacacttacgattcactagaaagctgtttatctcagaagacatttttatatttaaaatggtgtgtgtgtgtgtacactgaagagtgtagtcattataggtttattctcacgggtagtcggccaattctggacagggagtgctggcttacactgttagccaatgagtatctgaccatcgcccatgctatacttccctcatttagaatggcacccctaagttatttatttactctggcatggtccttctgtctgtgattgtaactgctctggcacacggttttgactattattagctgaaaaagagaatcccagtgatagtgctggaagtgctgataaagtgaacacttggtggtaaaaggcaattttatggcagcgccaggaagaaaaagagggtcaaattcacaaagcaattagagattggtggaagtcctttgagatatgagggatataaacctcactgaagccttgtaagattaaccaataattgtatggacaatatctggaaagaaaggaaaactattgctgaggcatatctccagttaatggctattgaaagaaaaagaaaaatggttgcttatgtttgatattgaagacaacatattcaaaatgactgtgctccaaggaatccatgtaggatagattaaattagtttgtcatctcaaggagcttgttcttaaagttaagtgttgtactcatttatcagtccaggtaaggatacagtaatcaacgcaaaagaaggcaagatctcttttttcttttgtgttgtcatatactcaaaacaattttcagctctattccaagtattggcttaaacaattctgattatatcagtttaactggactataaatgatacttaaatatttcccagtaagccgttggtataacatcataccaatgactggaattttctgatcttcatggttggtcacacagttagatgtgcgaacaaacattctcgtataagagcaaaggccaggcgtggtggcttacacttgtaatcccagcactttgggaggccaaagcaggagaagtgcttgaggccaggagttcaagaccagcctaggcaacataacaagatcccatctgtaccatcaataatcaatcaataatgtatttatttattagtccaaatgaaaagaaataaacacttcatttttttaatagtacagttctattatatttttaaaatatagttgccatggtcaacagttatccagaatccgacttggtataaaaggattaatttttttttgttttttgttttttaaggaaaaacactagctggaaccaactgtgtggacagtgaaaatgatgaaagactgagagaaactttagaaatgcaagtgagggagtaaggtgctaagaggcccttagaagtcttggcagatgaaagatactgagtgtcagtttgcctgaagacaatacatatataaacagaatgggtttgactcagattccaccatttattgctgtgcccctaggaacccactcagtcttactgagcctcagtttcttctttggttaaattggggtaaccatacttgtctaatttactttctttcttttttttaaaaaaaattatattttaagttctggagtacatatgcagaacctgcaggtttgtcacataggtatacacgtgtcatggtggtttgccgcacccatcaacctgtcatctacattaggtatttctcctaatgctatccgtcctctagtcccccaccccctgacaggccccggtgtgtgattttcccctccctgtgtccatgtgttctattgttcaactcccacttataagtgagaacatgcagtgtttggttttctgttcttgtattagtttggtgagaatgatggtttccagcatcatccatgtccctgcaaggacatgaactcatccttttttatggctgcatagtattccatggtgtatatgtgccacattttcttaatccagtctatcgttgttggacattttggttggttccaagtctttgctattgtgaatactgccgcaataaacatatgtgtgcatgtgtctttatagcagcatgatttataatcctttgtgtatatacccagtaatgggatggctgggtcaaatggtatttctggttctagatccttgaggaatcaccacactgtcttccacaatggctgaagtaatttacactcccaccagcagtgtaaaagccttcctatttctccacatcctctctagcatctgttgtttcctgactttttaatgatcgccattctaatttactttctagggttgctgcaggaacccagtggaatagagtatgtgaacatttcccaggaatttgggaattgatatcagttttatttccctgttctcagttggactgtgtgtaatcttaaagacccagccagatatgaacctttccctttttaacatttttaaagtttttatgggatctctttatggtgcctaggcttgtctcaagcacgtggcctcaagcaatcctcctgcctcagccttccaaagcactgggattacaggtatgagccactgtgcccgacctttcctctttttttttgagatggagtctcgctctgttgcccaggttggagggcagtggtgtgatctcggctcactgcagcctctgcctcccgggttcaagtgattctccttcctcagcctcccatgtagctgggattacaggcctgcactactgcatccagctaatcctttgctcttttaagagagtgtttgattgcacatattcctgagtgaacagccataaagatcagaaaattccagtaacaataactttttaaccaacaccttctaaagagcaccttgaatttatttctcaataaagaagaagtaaggaggttttgaaactcaagaaaaggataaaggaatgtttgagtttgattgagaccaggagacagagtttaagataattcttaatctattattaatagtgaggccttaggcctcatttaaaaaatgacctccttatagaatatgaggtggtacccttaagacctaaccattgatgagcttacaaaaagagatatgttttcccccatcggaaagcttccctctcagtgcagtttgaaaaatgaaggtctaccccagggtagtcatccttcatgtaacattaaatattaaattaaattggttggttgtagagccagtgttttctttgaattctttagtgtaaagaggtatttcttctggaatattttctggtagtgtatcttatttctttacccacctgtgatgtagaatctcttctgtcttggcaggaagagaaatttgtactacacttatttacttttggcaaagcagttcctattttaacacctacttgaaagtgttaagacttttattttattgttgttgtgagggggatgaattatttatacaaatttctccctttaaaccagaacaatgatacactgctctgtaaatatctgttggaaaggctttcagttttaactcatcatattgtaccgcacctatcaagtcctttactgggttttgcatcagagtcaaaacactcaaaaatgattcagggttctagatgacttcttagctgtaaaataagtttgcctttttctcaccattttggtgcaaccttacatacacatctggttgagatcattttcttgaagtcaattgaaacctattggaaacacacaagacatagcacaaatattgcatttttggagtacggctatgctgtgtgtcaaaaacctaaaatcatttatttctataattgagctcaaccatatgaaaaagtattagctacaagaagcaatcagcattatttatgacagagaaaacacagaaactaattaaatgtccaatgagttacccgaggaaatgttgaaaaaattcataagaactagctatttaaaatgatgctgtaaaaatatttatttaaaatatttattgacatgaaaatcatttcatgaaattctaaataaaagaaaaagattgcaaatagtatgaatatgtgatctaattttggtattaaaatatatattatttatttaaattgttaaaaatgcatagaaaatggtatgaaaggacacatacgaaaatgtgtttatctctgggtagtggaaatctaagtagtgtttactttttttttctttttgcctatttatttactattttgtgttttggattatgctgtggtgaacatatgttacttactgcataaaaagtaagaaaaactgttcaggatgatagacccatcttcaaataggggactacaggagagggaggtggtagaaattgaccattctgtagggggaccattctgattttaggatttctctttttagctttggtaaaaataaacaaaaaataaaactatgtcttaaaatataagtataaaaactgtgtttgttctatatgtttatactgaggttcaaatagctctcgtagatttacactttttgagtgactaatctctacatttttagtctaattttttcatttgctttttgaaccaatataggtgatattcacttctagaatattttatgatgatgtctgtatcacaaaataatagttaaatgcattgcgtgctgactagatctgactagattctaggcctattctaaatacttggcatgtatttacttgcctaattctcacaatatcctataaggcaggtactattattttctctattttacatctggatgaagaacctgaagcccacaggagctaagtctttattggaagttgtaaaacctgtggtagatctgggatttgaatcaagcaggctggctccagtgccatacaaatatgtgtcacatatgctacattatattttcatatttaccaaagatgttatgatggttaattttctgtgtcaacttgactagatcatagggtgcccagatatttggttaaatgttaactcttggtggctttatgatggtgtttctggatgagattagcattggaatcagcagactgcataaagctgattgccctctccaatatgggagggcattgtctgattgactgagggcctgaatagaacaaaaatgtagaggaagggagaattcactctttctgcctgatggcttgagctggaacatcagtcttctcctgttttgactggtactagacttatatcatcagccctccagttctcagaactacactactagcttcctgggtctctagtttgtaaatggcagatggagttttttaacctccataattacggtagccaatttctattggctttgcttctatggagaaccataacacagatttgatgaatgaaaatgctcatttaaaatgaaaggaaacttcaaacaccatattataattataactataaagtaggtaatatatttttaatagaagaacaaaaacacccaaagaattttattttcacaaatagcttgtaaagaggtttaaaattttaatttgtatttttttctctttttgttaatatgtgtgtgacacattttgtatgaatgtcacaatataccataccctaaaatacatcatttttgtgccactggttaatttaatatttcttttctttgtaatatttatccaaaaatacacacacacacacacacacacacacatatatatatatatttaaacatatatgtttatacttatcctatacacacacacgttatacttatcctacacacacacacacacacacacacacatacacatatggtgtatatatgtatgtgtatatatatatgtatatgtatgtgtgtttgtgtgtgtgtaggataagtaattctttttttcttttttgtatgtaacccataaaataattagaacgtgcaaactcactctgtgttttcaaaggtccaattcattatcacctcacaccttttcaggaaagacagttatcaaaagcatctcaaatttaggctttcactgtgtaatgtcaaagttcaaaaagcaggaaaagaaatttatgcttacaaacatctcatggtgcatgacattttaaaaagcgtccgccatcctagaaagagacaataaatgtttttacactttaatctttagactgttaaaaattttcacactaatttcctttcacaggcctaaaaatgtacttttccccctctaccattttttcccttatttatatcattttatgttggcctctttcttttcactttcttccattcttttatctctttcatttttctccttctaataactttttatccatactaataatatagatgaagatagtatatgtgtattagttcattttcacacagctgataaagacatacccgagactgggaagtttatataagaaagaggtttaactggacttacagtttcatggggccagggaagcctcacaatcatggtggaaggcaagaaggaccaagtcacatgttatgtggatggcagcaggcaaagagagagcttgtgcagggaaactcccgtttttaaaaccatcagatctcctgagactcactcactatcatgagaaaagcatgggaaagacctgcccccgtgattcagtcatcttccactgagtccctcccataacacgtgggaattatgggagctacaagatgagatttcggtggggacacagagccaaaccatagcagtacacaaaaggtgttgctaaagatttttaaacataaattgacaatacttttaatgacagtgagtcagtgctatttttcaagaataaaaagagaagcaatgccagatttcccccagtgacataaaagagaaaagtagttattccagaaaagattgtattccagtttctggtaaaagaaaaactgactaaaaagtggcttaaacaattttttctctttcttcatataacaagtccaaaggtaggcaatttctggtattactttagcaactccaagacatcagggtcgaggtcagtatgattctcctgacttttccatctagtggtgaagtggttgtttcagcttcagccatcacacccacattcaaggtaggatgaaagaaatcacatttatcaggacagaaaaatggcgctagaaatcccctgcaaatttctatatgagctcactgcctcacccatgctgcagggccaattctagctgcacaaaagactgagcagtatatttttgccactaaaattgccaactgaataataaatcaggtttcccttaaaagaaaatgaaaactgaatatctgatagatgtattactagatatttctatgcaataaattctcccaaaatctagtggtaagaagcaacaaacatttactatcaagcagtttctttttctttttgaaccctttgaccaacatctcatttcccctatttcccagcccctggtaaccaccttttcactctctgcttacttgagtttgagtttttagacttcacatataaatgaaatcatatatttgtctttctctgtctaatttctttcacttagcataatgtcctgcaggttctttcatgttgtcatgttatcacaaatgggaggattttctttattatggccaaataatattctattatgtatacatatataaatggatatagaaaataggatgtgtatatatgtcacatttgcctctttcatcacaatatgcctcaagtgatagagtgactcaccaaagggcttaactcacatctaatatatagttgacttcattgtacagtaagtctgacatcaagtatggtgcctgttttaatttgctagggctgccataataaagtaccacaaactgaatggcttaaagaacagaaaatcattctcacccatattaatgtgcacacagattgaagtgtccttatgtgatgtagctatacttactttttggtgtcaaacatcttaatgtcttttttaaaactatgagtcagtgagaactaccacctgataggaaagcatatttagattctttttcaaacaaatctcattgggtctaatatataatagttttacagattgtatgtcttatctttataatatacatttacttgattactggtgtttttatcccaaagttacagttctgtttgttatcatttgatattatcatagaggaatagcctttaaagaccttggaagtagagtattactgcaaggtttgaaagaaaaacggcagcattaaagagtgtcagctcttatatgtatatgctttttaggaacataaacttagaacattaaaactcttaggtcatacttgtcaataaatgatttttttctcaacagtactttataaccttttagaaatttgccaacaggtgacaatactccctaacagtctgctagaagtgtcagagctcaggatatctgctttttaattgccatattcaaggtctaattattttctctatattggggtaagagaactgtaatgaggaagtaaaatcattaaacaccagtgagtaagggaacagagtcttcttgaattctgatgtgaattagcttccccagcagagctttggctgtggataatttctatctgaatgtctccttctcagttatttgagaggacacataaaatataaaggaagactgctcaactcttgtggtctttaaagagaagggaagacaatggattaaaaggctattattacatctagacttatagactgttaatacttaagagtttattaacctcaaagtgtcaaaatgttctataaatgagtaagatactatgtaaatcaggctacacatatgataaaagttgtcattagaataagtggcctagaaatatataatactacacagttttcatactttttgaattcatagaatttagacactcagattcctttaaaaccaattttgctgctttatttattatttatcatattgcctttcacagttattcttttctgtaattctcagctgttttagaaaactaccacaattaccaaactgtctcaaaagcaaaatttgttgctgtagctactagaaggctaagaaatcacaaacatttgattctgtaagagtctatgtgtgtgcctgagtgtatctcatgcatggttttatgataaagcatgctaaataaattgtttatatttgtgtttgtgtgtatatgtttaccacttatgaaaagaacatacccaatggcagagattgaattaagtgctttctgcatgatctcatttttccttatgacaattcttgaatgaaggtattgtacacatttattagctaacgcggtgggcttagcaagtggctgtattagtccatttgtcttgctgtaaaggaatacctgaggcggggtaatttattttaaaaacaggtttattttggctcatggttctgtagactgtataagaagcatagtggtggcatctgtttctggtgagggcttgtagaagcttacaatcatggcagatggggaaggagagcaggtatttgacatgatgagagaggaagcaagagaaagagagggagtaccatattcttttttaacaaccaattcccacgtgaactagcacagcaagaactcactcattactgaggggaggacatcaagctattcatgagggattcacccccatgtctctaacacctcccaccaggtcacaccatcaacactgggggtcacatttcaacatgcgatttggaggggacaaacatccaaactacatcagtggtttagctgggatatgaacctaggtctgcctgtctctagagaccattcatgtaagtacatagaaaccatattcttccttgccactagaaaaaaccctctagcaatttttgccaatgttgattataaaaaattttatatggacccataaagaaaagagcaaattttgagcctctctgggaactgtgaaaaaaaaagatctgtcctcatatcaacctttgacaattcaaagagcaaacagaagattgggttacttctgtgatcacactgataattccagcaggcaaatcttagtcacaacaagtccctggagtccagccaatctggctgctttgatgctaggctcagtagaactgaaccaaatgtgcgtgggaaagagaagaaccagatattgccatgactgctcatcagtcaggatttcagagactgaagaatgcagactgaacaaacctgaacccatacaggaaaaatgaacatagtaggagcaaaccatcgccctctcatacagcatagggagggattttctggagccaaagagtgggtttggggtttcgtagtccaaagtctggactcaagggaacctcagataaccagtaaaaatgatcatccatatcttgggtctcctaacaacttgacatgagtagtttaatatgttgaaacttcagtttccacccttgcaaaatgaaagttatattgttctcttccaaggctgttggtgaggttgaatgagataaggttgatgaaaggaacctcaatacagtgcctgatacacaataatgacaataattatatcataatcacagtcataatcacaataatgccctttctagccacatatggcagagacattggtgcagtggtcctcaaacatacgggtcagatttgtcgctcaagtctgtgatctaatgacatgatgaacccattagatgcctccctatcatctggatattgttccttgctttttccaagatctttttgaagatgacaatatattttcataatatttcactattttaaaagctttctgttgagcataatatacatattggaatgtgcaagtatcagttatactgcttgatgaaattttaccagctggatgtttttgtagccagtacccagttgagaaacagaacactttctccagtcactatcctcccgcaatgaagtgtaccttgggctaatagataagttttgcctattttccaaatttaaataaatagagccatatactctgtatatgtttacacctcacttcttttagtcaagataatggttgtgagattcatagattcattcatgttttgcatgtagtcatgctttgttcttttttattgctatgtaatattctattgtgtgactataccacaatttatccattttcctattgacgggcatttgattagcttccagtttggggatattatgaatagagattctataaatattcttgcacatgtctttagtgtacaaatggaagcattcttgcatgcctaggtttgggactgctaggtcatagtatgcatatgtttagcatcttttcgaaagcaagggtatcattttacatttccaccagctgtgtactgggttgttttcaatgattattgtgtgttaggaatcattcttcctgcatcacggttatttttaaagcatccacctgagaaaaatgcagctctactaagggctggttcttgtggacattagatcccaccaagatggctgagagcaggacgtgccctatgatatgtgtatgtgttagaggctggaaagctatcagaaccatgtacctctgctgctgttttatggcttcatatattttggtggcagtccttaacagctgtggatttatttttctaatgtttgcttggaaactgaaatgagtttgaaagcagcccgattcatatagaccacacaagtaagaagaagcatattagataacacaaatatgggctagagtggcgccagagaacaaaaaagaaacaactaatgattaggtaactagtggacccaggcatgaaatttagtaatatgctgtttaaacataaaaggctaagaaaaacttgtttgaaattgtagaagtgtctgacagctagtgtaaggaatgtgtgagtttccacgctgacatcctcccataccaacagcagtttcaacttatcaggtggccttcaattttagcaatgaggagaaaaatgggtaataaatatgagatcttgtgttaattcaaaccattcacaaatctctttattttagggaaagtcacgctaaaaccacaaaccagcaggaagaagtaaaactttcaataatgggttgagcatcgactgagcttgaggcctgacacgctgcattcccattttatcctcaagccaggccagttgtgtgttttcaccaacatgtttcccacagattggtcccagagatgctaagtcacttgtcccaagttccaaaagtttgtgaatgacagagccattttcaaattgaggttgagctgattcctcactgcttcatgttgcgagagagaagtaatagggaagtagtatgatttggcagtaaacagcaggcaaactataaaacattatctgatggacgacacaaacgctctttacatctctgtcattgcgccctgtccggtaggagcagctgaatgccatttggctctttcaccttctgctatctcaggaaggcaagctgagcttagacaactccgtgcctttgttgtcccctcacctcatgtctgtattcatctctgttcccttatgttgtaattttctaaccttttcccctcccatccagtggccttatctgaaaaatgaatcctcaagttgtccacagctcttcactaagacccggtctagatccaaaatgaattcagaaggctctcagccagcggggcaatgtgtggaatttatggtagtttgggggcgtaatcttagtgcagacaagtttcctttgccttgttggaatcacatcggagccatcaaattatattgcttctcaagatgcagttaaagtgatttgggatgtgctcctctggctctcccacttgaagagctttactgtgaagcttgagcttaaggtagagatgagctggtaggcccaggtgaggaaagtggttagattccttgtgacatctggaatcagtacttgactgatagagttggacagtactttcatgatcaagcattccaaacacctcatttaatgagggaagctccaaaagtcaaatccaagaatgccaagttagggaggagtaagagctagaataaaaatctctcaatgcatggtacagtcctctttgcttttttaaaaaagttattgtaatctcacagatgagtaaaattaagcaaaatgaagctagctggtttaacaaacttcattgtagcatcaaccaaaaatgtgtgagtcagcattaaattgggccagatttggggtgggagaaaaaaatggtcagatttcttccaccaaaaggcatcattagatgtcttcattccaagctcagagtgtacatacagcaatttgctgctcacagcacgtccacagcaaattatttcccttcgtcaatcagaattgtggtcgtctaatttgccattctcaatactagtcacgctttcactctgtgtaaaaattcagattttcttctctcttcttagacacatggcaccttttacctgcaaaaggtaattgcagtgactgtattgacatgtaatgatatattcacgagctaatcacatttgcatttcctccgcttgctactgaaaagctgcaaaggagtccctgtcatcatgtgtaggtcctcttccagcccagcattcacagcaggctggcaacaccaggcattcagtcagcaggtcataatgactctaccgctttctattattcaaaatggaatttaactgggaacttcatattgtattgtacacttaacccagttttcttatttgttataggtttatattgttaagcagtatggtaaaaataaaattctatttaccaaattctccttaacagatggaatgtttaataggccaataaataataggttttaaaataacttactaatctttatattctccgtattcttaatatccttcttatctactccagaccttttattttaaaactttagaatatcttaaataattaccagtcaatatttattacatcattatattctgcatttagctttattgcttatattttaacaaatgtaataaagacaatggcatatgcagcttgtagtttgttgctatgagccaggccctgtgttaagcaattagaggatctaagtgagtcctcaccttaactgtgtgaagtagatatcactgtcctctttttacagatgaagaaactgaggttcagagaggttgaatcactctttcaatgccacacttaaaaaagtggtcaaaccaggagtgatggcgagtgcctatagtcccagcaactcaaaaggctgaggtgaaagggtcacttgataccgggaattcgagtccagtttgggcaacttaagagaccttgtttcaaaaaagcaaaaacaaaaataagtggtcaaattaggatttataatcagaactatctgacattaaagtgctcttaaaagtgaaaacacgactgggcgcagtggctcacacctgtaatcccagcactttgagaggccgaggcaggcggatcacctgaggtcaggggttcgagagcagcctgaccaacatggaaaaacgccatctctacaaaaaatacaaacttagtcgggcgtggtgacgcatgccggtaatcccagctactcgggaggctgaggcaggagaatcgcttgaacctgggaggcggaggttgcagtgagcagagagcactccattgcactccagcctgggcaacaagagtgaaactccgtctcaaaaaaaaaaaaaaaaagtgaaaactcattattctgcttttgaaatggagtgacctttcttccttgttccatattcacatggaccatttcatccacaggaaaagaagaggaaattataaataccatgattcataatttaattactagtgaattgatagatagtaatgaaacaaaagtatgagataacagagaggaatgagagtggtattagtcagtcaaaatctattcagatgccagcaatggaccgttttcacaaaatctaggatctttataaaaacttttttaaagatagctgaactttattgattcaaatactaaaacttttacaaagaaacttttttagttttattttatttttaattgacaaatagtaattttatttaaggggcatacagtgatattttgatacatgtatatattgtggaatgatcaaatcacagaactagcatatctatcacttcaaatatttatgatatttttgtggtaagaacattaaacatcgtctctgtttgctgttttgaaatatacaatacattactattgactataatcactttgctgctcaatagaacaccagaacttatttttctcagctgcaactttgtatccattggccagtaatagttccccctaccccgccccacctcaaacctctggtaaccaccaatctactccctacttctatgagttcaacttttaaaagtaacttttcatggaaatctttctaaaatattctataggcatttctgtatagcatttaaacagatgacctcaggacatgacttgaaaaatccaggatttcactacgtggtggaatagctctggtccgttttcatttgtcttgagctctgctctcctgatgtttactctcatgtctgaatccacttggttcttgccttagtgacttctcttccatctagtgtgctatggaccatataacacagagttgcaaaaaaatctgtgtatggagtgattgggattctgaaggaaaaccttacagaggaaagtggtacttcagttatagctttttggggtaccagacaagttttacaattttgaaatactgatttatttatatttcacattgttcactacatataaatgcacatgtaagaaaatgatggtaaatgtacatacagaaaaattaggcatagaagtgtacaaatgagaacccatatcaaggagcttcttggcagtcaaaccaaggcaaaaagaggcagatttagttatgatttttattatcatagaagataatgtataacagccgtgaaagagctcatagaaagcttcatgtatctttttttaaaaaaattccctaagtcagagctgtgttgtagtgggctaaaatttctttttctgtttttctttttcctttttttttgagacagagtcttgctctgtcacccaggctggagtgcagtggtgatctcagctcactgcaacctccgcctcccgggttcaagtgatcctcccacctcagcctcccgagtagctgggactacagtcatgtgccaccacgcccagataatttttgcatttttagtagagatggggtttcaccatgttggccaggctggtcttgaactcctgacctcaagtgatctgcctgatttggcctcccaaagtgctgggattataggcatgagctaccgtacccagcctaagatttcttcttggtgttgctttcactaaaaaaataatcattagcagtaataacaactgaacaattatattaaaatactgtggatcaaataatgaaatagagagttatgctccctagggccttaactatctattcagaaagcaaagataaaactttatacggctagccaattcaagttagtatatgttgtcattactgaatttatgtaaattttagatataacgttctaaccccagtttttcaacttcataactaagatatgtagttgaagattcctcaaatgcttacgaggacattaacatcacccaaatcagccaaaatatgtcatataccattgaattggacacccacatctaatgactggttaatgcagatatgaaaaggccagccccttcacctcaattcctgacaactgtaaagtgtatcccagtttcagagacctccacagggttggcggaggcctggtgatgaccgcctctctgcccaacttctccctctgcccagtcctgcttccctcacttccactgtagttgttaatctcaagatcactccctaataaatttcctgattttctgtactccagtctctatcccaggtgctgcttcccctaaaaagaacatgccgcattacaggtcactttgtgcaagccactaagaacactgttcaagggaagttacagtctaatttacaagacaaggcacagcagtgcatacacaggctgaggggcaaacaaacccttcagcttctgaatgctgttacctctcagaagccagggagattgctgagagttgggggagccaaggaaggcttctcagaggaagcatcttttaaatattttcttcttccacccaaagcacctatcttggaatgtcaaatgattcaacactactacttttccatgtgcgtttgtaaaagtatataacaatttgagggatcatgttcttatgctgtaatctttctaaatcctctttctaaatcctaatgatgtgtatgaataccatagaagtagcaatagctcacaaaggcctgcaagaaggtagttgtgtttcctgcatagaaccctgttcaattgctgcctttctcttaagattatcatgtagcttttcaccttaagaaattaatatgctgtcatctgactaaataatgcttttggctgaaatactggtcccaaacatctcttattttgttgtgtctaatattttaccatctctgctcagcataacttattctcctcataatttcactttttctctgcttacactaacacgtggttttaaaggaaatattgatgattcatggtgataatagtacgtactttaatgaggttctgccattcatcatgttgttacatccatgtattataacactgaattgtagtcacctgtactggtagtcttcagtttggtttccccagaagcagactctgagattttaaggatttgagggtaggtagtttattagggaggtaactccaagtaggagagaggaaaagtgaaataaggaagaaaagcccatcaataaatgtatattatcaagccacttacaactgtgagcaagtatagcttaatccaactaaggaactctggtgacccctgtagaatatgtacctccctttcccacctaaaggcaagggatctgggctacttttacccaactattgtcagtaatctcttaagaactgttcctcttagacattaagtcctgagcactctcagtttcccaagtgcttgagcaaagtaaattcttgaagtcagagaaagctcttaggcaaaataaataaaatgcaggtactagcagtcaggcctaagggctctgagatggtaaaggcagggggatgtgggtgatgtcctgaaacatcatctacactggctaattaagagaaaacacaggattgcaatcacattgcgtagactggatattctcttcctcgctcctacagtcaatcacgccccaatttctgctgatgccatttccctgctagctctggggactccctttcctttgctgtttttgctgtcttctagccacatatgtctgctttcttgcctgttaataccccaagagttcttgcctctgagcctttgttcaggacggagcttgggtccctttgctaaaatgtgtttttaccttgtatatttctattgcagtccttctccaagctcactttctctaagatacttcacacatctttctgctatagttggtggcacttcattttagcttcattttagcacttctcataatctgaccttttattaagtcgggttcatagacatctctgtttctcactcaattgtgaatttctgaggggcaggtgctggcatgcaattactgtggtacccactccagtgcttcacatgtagtagatatttgataaatgcttgttgaattaaattgaataatttaaatccaaattaggtcagaaaaggatggtgttttaagtgggggggggggggcaccagattcagttacctggatagggaaaacatacacttgaattttctaacagcttgcactcaagctgtcattaaaattaaagtcctttattagatgctttcattgttgccgaaataatactccctgtgccttggagcagtagatgtaacagcctctcttagttataattttgtgacatcaggcatcaagcagtcgggaaattgcgagagctggtaatataactttacatatagtatatcattacaaatgagaaaacagggcctgcgggcagggatgctctgtaacatatttttctgagaagaaagaaaactcaatggaataacagtaaattctgtaaaaaacattttctccttaaaaaaagacagtgcccatttagttatcctttaataatttcaattaacttctgcatggcagcatgctaaaagaaacaaattgcctctcagtcagaaaactgtctgtctctccctgtcagtctctcatgaacacacacaaacacacacacacccacacacacacgcatgcacacaactctaagagcaatcattttaggagtctgggctgactctgaacactgctccaggaattaagggcctagactgggcaaatcactctgtttactggaagtatccaccatttcctctcctgtttcccacccatttctatgtttgcacacttgtaagctaatctaatttaaacaagaaaaaaaaagcctttaatgggatgataaccagaaaaaatgttcccattgtgtttaaatgaattcaaatgaagtcatattttgagggaaggggagagggccagtccccctgggggacttggagtcaagacagacaactgtgggtaagctttactggcaagcctctttcaatctatttcatagcttacatacccccgctcctctgatgccccagcccaaacaatgatacacagtgtgtcaggaggctgtagtagcctaaaccccaaattactgtgacttaaagtcaacgtagtattatttttgcttcttattgttgtgtttttctgtttttattttcaatctcacctgagaaggaggcagaccaggggtaatctgggagatccatgatcattagggacctagactccttttatcatctttctctctgtatttgtcttccatcttcagtgttgcctcatggtcacagatgacttgctggagcaccatcaatcacctctttgttccaggaagaaaaaagggggagcaaggaaaaaagattaaaaggacaatgcttcttcagtacatcagcagcttactttctcttggccacctctatcaaaaaacaagaatggagaacatattttgatgaaaatgcatattataaaaagaagggaagaatggctatcaagtagacaaaacacacagacatacacaatattgcttctgtcagatccttatgtggattgggttgcaaaagagtagtgacagcatgctttaagtgcctaaaaagtctctgtaaattcccagttctcttgttgatagtgtttggttcactcagagaaagatagagagagagagagagagagagagagagagagaatatgagggaagaggcctgacattttcttgagaactgaaacctttcttttaagatggcttgcctttatcaccatccgaaattctaagcactggatatttgtaccagactctaaggtaggacagcacaaatcctttgttaacatgacttggtccttaactcttaatatccctatttcttccctgagggagagtttggctgggaaggacgcaagtatcattatttttcttctgctggccaaagttgtctctttgtgcattctcagctttcaaaagaaattgagctgaatccacttttaaactctaagggattcgttatcagaaaagaaaaaaaaaaagagagagagagatttgagttggctttgaaggaagtggagactaggaggtccaaggttgaactccttgctcttaaaagcaaaaactagagtgagtcttaggattgcagtgggctctgtgcaccagtatccatagcccttggagaggaatgcccacagtcttttgttgagatgatcacctatctcttcagaatctccaatctagaatttcccatttcactttttagtaagaatataaagttggatactgggtattcagattcctgtttctgctctctctgtaccctgaggcctccaaatacgtataaagaaagaggcaatgtggcagtataacagctaagataggagtggtaacatgcctgtgggatcctcagaacagccaccactgggaaattcaaatgatcataggcaatttctaaggaggtcaaggttgcaggcttaagtcttacatgaatcatttagctctagtacattcaccagccataagctatacacataatgatgatcattgctaccaagaatttatttatttctcatttttgatctgtcatgtacaatatgatctaaatgtaatagaccatttgattcaatattaaatgcctattaaagagatggtcagtttttaagttttaataactaatttgaagcttcttcatcaatcttctctcaattgccttttatattttaaatgatcgtttttgaaaggctttgtcattgaatatattgtaacgtgtgaaaaaaaaagtgtttatactaaatgtgacttatcctcaaaggtccacagaaaagaacatctgtcattgttaaagatcatgcagcctttttcctctgcctggggaaaagttcaaagttgacagtgagttcacttgaagagatgtaatatgaagtcagagcgaaggtaagttgacaggaccaggacaagcaagataaggtttaccaaggagtcttggcccctttcatctgttccatgatctcacctgaaacaaaatccttgttctgctttatcttcctatgtatccaggagatttaagtagtaactgaagctgtctgtagagtaagtacagtagacataacaccacacctcgttttccttttcatgccggggaagccatgttcccgtgttgagactacctttagtggggactttctattcctttccagaacaccatttacaagggaagagggagcagaattattcctctttacagtgcttggaggagattcagaaggtgatcttgttcggactataccttccttaagtattatttccctgaagaaatgctgcagagtctattctgtggcattcttggaccacaggattggaagcacttgattgggaataagacagcacatttctaagatctctttactatattttggcttttttactcactataaaacatttacctagagggctttctattaaatttagtccagcccattctctgacaggtaagtccaggcatcaaaaagtgtgtattttctaaatattgaagtaccattcagcctgtgaaaaataaagcaaatttgtactgatgtggaaagatgttccagtgcatattaagcaccaagaaatgaattagatttgaaagcattcataatattatccttttttaaaagtgggagttggtagatggatgagcagacacattagggcgacttgctgcagcctctggggataagcagtgtatgcagaaactttgatagtcaatttctttattaagaaggactgtggcccggtgcggtggctcacacctgtaattccagcactttgggaggccaaggcgggcggattgcttgagtccaagagttcaagagcagcctgggcaacatgttgaaaccacatctctactaaaaatataaaatattagccaggtgtgatggtgtgcacctgtattcccagctactccggaggctaaggtgggaggatcatcagagcttaggaggttgagggtgcagtgagccgagatgtagcctccagcctggggcaaccaaagtgagatcacatctcaaaaaaaaaaaaaaaaaaaagacttttaggaaagagaacattctgattatttacttttaagtagtttgacttaaaaaccatattaacagggtttatttgaaccctggaagatagtggaccatttttattttcttctttgtactttttgtatttaaaaaaaaattcctcaaactagtggtggtgtttttttttttttttttttttttgagacagactcttgctctgtcccccaggctggagtgcggtggtgcgatctcggcttactgcaatctccgcttcctgggttgaagcaattcccctgcctcagccccctgagtagctaggattacaggcactcaccacgatgcccggctaatttttgtatttttaatagagacggggtttcaccatgttggtcaggctggtctcgaactcctgacctcaggtgatctgcctgcctcggcctcccaaagttctgggattacaggcatgagccaccacgcctggtccccgtgttatttttaaaaggtatccttgctgtaatttttctttatattaaggattctattttagacttttatatatactattctaattcatccattaaaaatttaggcctatatcgaaacctgtaaatctcttaaataattattcaaccagaaaaaaaagttaaatgcaattaaactttgccatatgtgtatgatatgcctaaactaaatggtaataaaaccatccctggttttcattagttagatatgtgtactctcagggataaaagaaagaaataagatcattttgcagcctttctttgaatccagggcagccatccaagaggccaaaaacgtaacgcctggaaaaaataaattccttttaatcttgtggattaatcaggtagtgcaaattttttttttttttttttttttttttttttttgagatggagtttcactgttgttgcccaggctggagtgcaatggcaggatctcagctcactgcaacctccgcctcccaggttcatgcgattctcctgcctcagcttcctgagtagctgagattacaggaagtagccaccatgcctggctaatttttgtatttttagtagaagcgaggtttcactatgttagccaggttgttctcgaactcctgacctcaggtgatcctcctgagttggcctcccaaagtgctgggattacaggtgtgagccactgcacccggccaggtcctgcaaattctgatgcaaacttataaaccacccaccttgatttacattaggaatataactgtatttaccttcccaacattacataaatactatgatgagaaatcaaaattaaagtgctcaaaattgaaagaaaaaatgtagttttgaaataggaaaaccatataaaaatgaaatttagattgcattttctattagaaaaatgtaaatatgtaaatgattacttaggatgctaaaatatgcttttattcacttatatgcaaacaaacctaaacaacatatctaatatgtaaataataaaaccaaaattatcttctttatttcaattggcaacttttttctccttaagtgcatattttatataaacacttcttatttgtttagaaataaaaactgcatgtaaaattcttttattcatttttatagactgcaaatatgccatagccttctgtgagctcgataaatatcaggtgataatttggttcatttaaaaaaaaaacaaatattttacagcttttgtcagattttattgctttaggccaaaggtcaatccaaggcccagggcaaagtataggtagtgtgttttttgagtaggtatacattggaaggagttgctgaaaaggattatatgtcatatttcagaggtacttccataaaagggatgataaccaagctggcctgatgagccacaattgaagttgttccgttttataaaagagtacaccatttcccacagtaggactcctcaaatgaccttcaccaaggcagaggcatattgtgctgaggcttttcagggattaattaaggggctgtgaatagtgtaggctagacataattgtatgtgttttgtgtgcttgtaaagttacctgttatgcatccccttaccttgctcatataattaaaagtagactccaaagaccaaaatttaaagcagcccctgttcactaatcgccccatggacttttgcagagatagttccgttttgggaatgaatttgtaagtggagtttagaccacaaacactcaaaataatgctttcatctgctccactggttgaagttgcccccagcggtgttgcttctcctctgtacatttcctcaattgactttcaggttacctctctgtgcgagctctgggggtgccagagaaaggcagagaaaaagagagacctaagtgcttgaggcagaacatcgacagctaccagtacgtgttctcagctgcaggtttactcagctgttccaaaggacagagaggcagggcagccgcagggtctgctctagactattctttccctttgagaaaatgccctctgaaatttcacgtggctatatgcaatatctatatttggtctagagtattataaaaacgaactagtcctacattgtacaaaaaagctaatttaataattgagagtaatttttgtttaaatatactatgttgaatcatgcatctagacatttgagcttaagttttgagactcagtatgtactgcaagactgaagaaatgtatcacatctgtgctccaacgatccctgtgtctgcagagtgcttcgtggtttaggaagtgctttcacaagcacatttttggatacttacaaaagatgtgaggtttacagaggcgttattgagatttttcagttgagaacactaacacccaggatggaatagtgggataaaaacacagctatcagtgtcaagagacatggatactgcccctggttttacccatggccttttctggatatatatatttttttctctgggcctaattttcttcatgtggaacatgagaaaatggacaaaatagctataaaattttgagcatcctgaagtgatgaccttagacatgaatcaaagactcttgaatctcattatttccatgatcccctcaagttccacgggaccctcattaccacttgtaaattcagtatctactataatgaagaaattcgtatatgtaactgtaaatcaaaactggtataataaagcctttcaaaaagcatataaacaatgtataaatatgaatacactcctattttgttaatatatacatgcatttatattatatataattatattttttacttggtaaacatttcaaattagaatattctctaattttgaaatgttaataataatccatttattgattattgttgatgttgatatcattgaaaattttacaaaatctttttatattcccaataaagaatcctatctttctcaacattatgaacatttatcttacagttacataatgtttagaattaatgtatttatctcaaaacacttgagggtttttttaatgaaagatgcattatataacttgcctcatatcatgtatcatgcatttggtatttaacttagcgaactgtttgttatcatggaatggcggccactgtttctctttttatgcaatccattagaacattggattagcactaaattattctgtattaattgtgaatataagactgttagattagttctgaattgttctgtgttacttgtggatacacacacatattttaatacagaacatatatttcttctgaatccatttctctctcctacttgaccgtagtaaacatactctgcactccagtgtcagtgccaggttatttttgttctctaagattttaattgcattcattattttgggctcagtactggttaggaatagtcttcaaagattaaagctgtttatgtggatatgaaaaatcatttggtgatctgccgaaaccctcctgttcataagaggaagcttttctgtcaaaagaaagaatcagacacataaaacagattttctcaattgatatcacagctctatagagtcattaggctaaagcacctgcaccttgaaatgctttgattgcccagtgtgctgtgaggacctgggctgtcaccttgaatgctgatattcccttcctctgagttaaagtaacatcctagatttatcaccatattggaaattcatttaccaagttgattcagtttgttttccccactcagtgttgtcctagtcagcagatgggccccttatttattagaatggtgcggtcactgaattgtatccaccaagctctgctacttttgcagtggaaatgttagcagttttatttaccaatgcaaatatttaccgagaagctaccaaataaaagttattttggattttttttaaatgtctaattgtttatgcaatcatctactcaagaaacatttactgagcacctatttttacatgattctatcttgtttgtggcaaggaatacaaaggtaaataagaggaaacagcctggtctaatggagatgagggcactggagtactaaagacatgggttacaatttttccttagtcatttattaaccatctggcattatcttctactctgtcttccctgtacttgtgtgtgtgtgtgtgtaaagtgggaagaatatatctttatcaggttatagtgtgaattagaaattaaacatatatagtattcaataaaagcatagtggcagaataaacagttcttctcagcatcatggtagtatcaataagacccggactgtgtcctcaaaggagtgtacattttgttggtgtaatttatgagatgcctaacataaaaactctccaacttattcattacatagactgatacttcattttatctccccccaccatgccccccgccagcatattttctggctcatttgtccctttagttctcttctgtgtcatccagagtccagtcaggaaacaggaatcttagcagttatttcaattgaaaaaggttaacatagggaatcgattataccggggttggaaagctacaaagccaaaaagagacctgtgagccaacagcaatcctaaggatgggggaacaaattaaaagacattcgcgttatcagattccaaaagctcgaagaaaagacccccaaaacttaggctgagacctccacccagctggggctgataactcacaggctgcaggagggtcccagtacagccatccttctcaagctgctatctctaaggtacaatgagaattgcaccgacagtgccaaaaacagtagaagatagaagatgaggctgactgctgctgctggagggaagagctatggccggggcttctctgacagtaatgatgggtgaaaaaggaaggagtaggtcttctcctgcctgccagtttcataccagtgtcctatggcagaatctaacagggagccagctgtgaagaggaggtgtagcttcatggtcccaggtgcagcatcacagagccaggaatagaaagggattggggcttacttactaactagcacaggtctgttttagcagggtgactttatgtccagatttgcaggattacaatttaccctcaaagactggagaactcactggctcctttcatttcgtctactatgatatgttcacttttgaagagaccccaatccacatgaatgttgaaagtaaacatttgtagttatatactcaaattatcttttgaaaagaatggatctgacttttcctacttactatgtcaccattgaagactaccttctcaaaagacttctgttgttactttaaaattcttaaaagacaaatcttcatgtaattctgttggtatcaacaagggaaacacctaatgtgggaaattaacttgtcattcttctccagttaaaatggttagaaatatgaccattaccattaggaaattgtatatgaggttaaacatttattaaatgcaaacacttttccaataaatttaaaataagagatatttctcgttttttttctggtttcaactgaaatagaagatgacatagcctctgtaagaagatgtagaagatgaattttggtatttacaagtttgcatgttgttgaataaaggtttatattaggtttcataattaattctaatattcaaatatctgtttgtagagcattttaattagtttaacaaatgtttactggggtcttataagtgccaggcactgaggaatcaaagttaacaagaccgccaaggtctcagcatgcagggagcacatattctagtggagacaagtagaaaaacagcaattaaacacagaaacaatgtaaaagtgcacaaagggaaaaaaactgagttattttggggagtgtgtttgtataagtagccatgaaagtcttcttgaacagatgctatttaagatgagaactgaaggctgaaaaggaaggaggaggaggtacctatgtgaaatacagaggaaataggaaagacaccattccttaagcagaatacaacttggcattttcaagataccgccatagaagctactggagccaatgcacagggagaggagagagaatgagtttgaagggattggaggggccagaccgtgaaggaccttgtagggcccagtaaacagttgggattttattccaaccaaaatgggaaaccatggaatgttttaaatctgggagtcatgaaagctgatttatagttttaaaagtcactctgttgactgcagagaatggattttagaggttagaatagaaacagagagagtatgaggagaagaaagccaggatctagggaagagataaagatggtggtttgagatacacttcagaagtgaatcttgaaggactagcgagtaacttggacatgagcatgggtaggaaaatgggagtggggaaaggatttacgaatgcttcctatggattagaataagcaactgggtagatgttgatgtcattatgaatctggtagaaacaaagagaggaatagatacctgaaagagtggaagaaaagtgaatcttattttagacacataggatgtttgagacatctgtgaaatattcaagtgcaaatattaaatagacagttgaatatccaagtttggaaattacagcaggaggcaaggccagtgataggaattagtaagttatttatttttgttttcgtttttttaaaaatcatcaaccatgtatctggatatgttcacttgcagagagaatctgcatagtaaagagaacatccagcattgtaaagactggaatagtaggagtgacaaataaattcagcagagaggtcagaaggaaagcaggagtcaagtcctgtgaaaaccaggagagacgattggtgcatgaataaaggagccaagtgtatcttgtgggagccaatcgaacttgcagagaagtccaagtagatcaagagacagaagtgtccattagatttggccacatggagatttccattgaccttgacatgaacagttccacattatatgaagttttatgagcctatatatattcagtttttatgagcctcaggtggttgataggaaggaataataatcacgacaacttttgtcaagtctgaggaagaactgtctgctgacttatcacattttcaattaggggataatatttgatgtaagtggctctgaaaggttttctgtctcctctctgattggaatccataacttgaaattgatccagtgtggtaacaagaatgctattctcctgtttgatctcttaggctttttcactgtagggcattcgctgaaaatgatgaccaagaattgtttaagtgcaaccaggctgggaaagccagtagtaaccaccgtaggacagacaagaggtacttcatctgaataaccataagaatgatagagcaatgtttttttcactcaatgtcaatttaaattacttgaactaaaaagtgaaatatagtttacttattcgaggatactctatagcagacaatctaatgtctgtggatgttattgaattacttccttatcggagggcaagctgaatttgtctgcagttattttcgtttataagagtacagcatttattttttcttaactgtgctcgactttttgttttgatggcaaaaagcattacttggaatgctgaattttaagtatagaattgtgcccttcatattctcacatacataactttgctttaccacatagagacctgatatgtatacatagctttaatatatatcttgtgtattcagctttaccaaatttgtgaacttttcttattttaaatctggttttaaaatttttgaaggggcattctagtgttgctttctcccaacaaaccccagactgatgccttaaaaatttgtctcaagttacatatagaccacactttctcaacattttctcttagatatctcagatctaagatgtctggaacaagctcacactctttcttccataagccccctcctcttccattgtttcttatcacaatgtatagtatcaatgaggaggtgaagccaaaaatctcgattttatactctcccttgctaccataagcaattcattatcacagtctgtccgtgttactctcgcatctccttctctgtattcattgacttgacccctgctgagcccaaactaccatcactattcacctagactgttgcgatatccttctaaatggtctctatgtatttctttcaacccatttcctagaccgcagtcagaatgccgttttcaaaatccaaatcaagcatatcattcctccacttagtactcttcaatgaccggccattgcctttgggatcatgaccaaaattcttaacccagtctaccaagcttgcatgatctggctcctgcagttctctcctggctcaccttgtagcactctgtccccactctctctctccattactctgctccagacatactggccttcctttctggactatgccaagccccttcaccctcagcgcctttgtgcctgctgtcccatctgctaaggatgctcttcctctccgttctttctcacctagttaatgcttatttctacttttgactcctactcaaatgacatttcctcatgaagtcttccccaagccccgggttcagccctatccctttgtagcactggctgctttctttcacagcacatatagctgtagatttttattcctgcactgggatatgggctatgaaggatattttattaacatttgtttctaattgtacactaccaattccatggggacctggatgatgcctgctttacttgacctttgtattcccagtgcgtattgccagtagcgtaagagtgttcactaagcatttattgctggatgaatgaatgaatgaatgaatggtgtcgagaggactgcggagaaacataaggctgactctgcatcttattaccaagactggaaaaaacaatttaaagttcatatcctactgtgttaatagaactttctgtgtatgcaaaggtcagtacattttaagattaaagttgattttctatgaacttactatatatagattgaggtgtaattaataatgtcaggctatggggctctatggacaagtaattattttcagatatgttctacagcatttattattgttaccatcgataactgtaatagctagcattagtagcttgcaaaacccactcataaacctgatttcatttactttaaatggatttagtgtaaaattcaattggaaacagtgcttaagatatagatttgaggtaaatttaactttactataaatatactgaacaaaagtctaatttttttccctgtgtttttaaagtttcaatttttctataatttctcaacatggatttgtcttgataattttgcagcacaggtctggtttgggaagatcattgcttttctatttgtagctgaagtctctgccagaaaaaagtattcatcatgtgtgtaacatggtatgattggcagttatataattgatcagagagagactttttttgtctcatcactggatttcataagttgatggaaccttaatggttgtgtagctgctacccatatttcattagtgcatactacattatggacacacagtaaatattaactgtgttaattcaaatgtaatttataatttaggaagtaaattgatttctgtgtctttctgacaaatcctttcatttctttgaagtattgtttattttagtttgatgtataaatacagccacataaacaagaaaaggtaactctgtcaccttatgttttaataactttgaaataatgagacatttataagtatgctgagattttcctccaagttaatttttcattgtgatttgttttaaatctttctactaaaaactatcatattcagattttgtatgatgcaagaatgtgataatataaatcgggacagatttttctggagtaaaattcaactgtatatattgaaatatataacagttgtatacagtgaatatatattgaaatgtaacagttaatttaacattatttatgatatcttttaacattcttcctaacatacatttcctcttttagaaatttacctaaagtaaatcgttagagaaggggcccttgtagaattataaaaaaagttatgaaatacaataacttaatactattttatcctataaagatttcttatttgtataaatatacttctgatgagattttgattttgaagaaattaagtcatttttccctttgtatcccaaatcaacttgatgaagcccttacttattaacattttaatttgagaaatcccagcacaatcttactattaaaataataagagatagtaattttgattgtcattgtgacctttttaaacaggagctaaagcacaccaattggatagtttatgcaaattgtaatgttttcttttaagaaagtgcttaaaattatgtttcaaaggtttttatactcactttaatcttagcatagatgatgttgagttctgcattaacgaggaaagtatcaccttaattatgtaatagggtaacataacatcattagataaaggcaaaaataggcatggcattgccgctaatgtgtttaagtttaaaataataatttagatgtctttgtgtgtttccttagaagttgctctgaggagatagtatgctctgcttcttggccagcttctggggaggactggctctcacattaagtatattaggtaacagtacaaagcaccaggacacatctatataattgcagagaccttacttgctgggttggaatctcacttggggccctgtttgttgatatatttgcaacaaaaagccattaacttacagggtcaagggttaatggaagaaatattcttgtcttcctattatcttgcaacgttttgctgggagctgaagaaagataacgcttttctctcccagtttctcctggcagttttaaaaatggtgacttcttgtttctgtgactaaataaaagattagatgccaatatggaaagctttagaattgtactcagtcaagctgacagttcagacaagtgttccatcacgaccacctttgctgaggtcactggatggtcccagtcacagaaactaggaggaaggcacctaaataatttcttgatttctatgacttcagttttttttttttcctgctccattttaggtaagttagtcatcttgcacaagaaggcgagaaaatttcataaaactttaaaggagagaacaaaaactactgctaagtccaaaaggaattctatgtctaaaagagagaatttagctaatcagattggtgcccctcaaattccaattattttagagtgtataaagagagtgaaataaatccttgtcccaaagaaattcttattcattaaaactatgttgatgattttaaatggaattatggattaaattagtttgcccagattttatgggtgaaaatcattgcctaccaaaggttatttctgtcatttttaaaaatacattacatagactaactgtttcattataacgtatctgatgagagtaggttgcccaatgcaatttaagagtcagtggaaggtcttttcttatatgtaagcgttccactgggaaattttttccggaaattccaccaattaggggattctccaggttaattaaaataagtcctttcaggttataataaaaatatcgctgagtactttagggaacttgtgaactcctttctgtttgaaggccggaatacctttataatttcatccggaggttagtcgtagccatgggtatagttaccactccagaattgtcttgaattgaaaaaatctcagcctatttaattgtagtgctctgccaacaaacacaggttgtgctggtttgatttgacacagcttggatggtgggtttgactaattttcctaattaaatctgccacaacagtcaatgcatgtggacacatatggttacagtcctccatttcacccataatttagcttgacaacacacatgtgagttttctctttactcaatgtttatacaaagggactttttagcacataattttctaattttcctgaaattctaacttcaaaataatacaagggagaaaatggaatcacaagtctgcttaatttaaaatgaagctggtggaaaacttttccctaattgggatatttgttttcttcccaaattagttgagatcatgctttatagcaggttagccagcatggctgataggctgataagccgtttcccctgcgcccctcagcagtgacagcgtgcttctctacagaaaagctactctgtgtctttgcaaaatgacccaagcctcagtcccttaagtccgtggaccataatcattagaccaatttgtccacttagcatctcatgtagtcaaagggcagattttgtatattcatttgtgcagactttgtatattcatacacctgttaaagatttcagcgttaatgtttttccccagagatttttttaagaccttcttctgtaatctgtttattttacatattctcacaccaggagttttttatacagtaatagctacaatggcaatatatattgaccttctgctaaggcatgtttctaaaatatctctcatcagaaaaaccaagcatatttggagtttccagggagagttttatgtatgctcaccagtaacctagtcaactgtgcagactgctgctatatggtggttactgttttggcttcatctgtggtgctagggtgactgaacttgatgatctctaatagccattccaactggacacctctactgttctatgaaaaaggaaagtgaaaggcaaaagcagaaatgcaggcaattgattaacaccgagcatcactgtactttcctttcacggcttccagtcctatttttctgattgttttcgttttgactttccaaaagatgaaattgtagaaacctctctcttaagtttcatccagaaaaggtacagggggtcaatatcagtgactttgaggacttcaacataattaattctagaaacatcaggaacatagcagaatttaattatatatgtctttatcaaattacagaacttgagtgtggctggcaagggcatctcggcccatcatcaaatgtgatgtcgcatgtgctgaactgagtggtgtgcctgcagaagaagcctgagacagcatgcctgagtttctttttaatgcatgatcatatgagcacctgctctactgtgcaaactgtttctaaccatagaaggcaggaatctagttcactagtgggagaattctgaggtaaaaattggagtgaagaaacttggatatggttttcacatgcttctgaacatctttacattaattgagtttttcttttatggctaaacgcttttattaaaggaagacttaaagatctagaatgacttgtcattgttaaattttcccttctgctatatagtttcagaaggaagttcagaagcattaaaactgtccctcttcttagcacacactgttgatacatgtgcttacacattcagtcacacatacgcaattatttcttttaatttagacatatctagtgtacatgctgagtgtgcctataagtgttaattataacaatatttttgaaataaaaatatataatatgcataccttctatgaagtaaataatgatgaggcaaaataataattgttccatctgatatcttcgtaaatttgtattacaaatgattatctctcgtgtgtctctgtctttggatctcatttctttgtatttctcttaacaagcacacacatacacacatacacacacacacacacacacacacacatccttggtgatttcaaaagaaataattggttttacagtttgtatctgcaaaagatttttttttcagttagaatatctcatttttaatgatagtattagagatatgcctaccattggcattctactatgattcaattttttattagtcatctttcacccgttgcttaacgtcaatggctctttcattcttagaccctgagttgaaatgaatttttacatatactcaatatggtttggggcccaccagttcccactacagtggtgctccccatcactcacatacaattttatttaagacaaaacagcagctccagcagaaaataagtgtaatcttctcctttgtaagttgtaattgaggttatggcacagcatattgcctgtggcagaatctattaccaagaagtggagaccatgatttgaagctggctgcagtgtaagcaaaatgaattaattatcagcagtacagaattgaagggaaatacagggtttcctaaagtgaaatatattggcatttttaaatagagaacactcactgcaaggaacttattgatgaatcaccaagtcttttctacttttcttgcctttcagaatttgtatatactcaggttaagatgactatgtgtaaattaaatcacactttgctcagaatgcatagaaatattttatagtatattttgttctttttcttagttgttgaaatggagtctcactctgttgcccaggctggagttcaatggtgcaatctcggctcactgcaacctctgcctcctgggttcaagtgattctccagcctcagcctcccgagtagctgggattacaggtgtgcaccaccacacctggctaatttttatatttttagtagagacggggtttcactacattgaccaggctggtctggaacccctgacctcaggcgattcacccaccttggcctcccaaagtgctgggattacaggcgtgagccacggcacctggcctgttctttattaatttaaagtttgcctatttttaacatataactgttactgtcacttggacaggtaaatgggcaaataatgaatggactaaattagcttcagtattattctttaatagaaaaataactctctccttatcaagtgtggctcaaagaaggcaaaatggaacgttttttgagagtttataaacatttataattttacgtcataagttgtgaactttagtgaccataacttttgttggtaattatttagcaaaattgagtatcttcatagcagcaagataattagcttatttgtatttctttatgtgtggttttccatttaatttaaatttcattcagttgactaacaatgatttttcacttttaaatatcaccattcaaaaaccaaatacaattacattttgccaaatttatttttaatttttttttctaggaataggtcgttatttggctgtttttatttttctgtttttagataattgtttcatataattgtaatgaaactgtttgcttttaagcttcatttagattcttttgtgaaaggatgctctgtctctactgggtattttctagcagttgtgcacattgacttttctttaagttgtagaggatctgagcagatggttttctcagcatctagacaaatagcatacatggttcaaggtcactccatgcaacctgcctatgataaattgggaatccagaatttgtctcatttacaaatgtccaacaacataggtccatggaaaacagtgaagtgccaaagaaaaagatcagcctcctgggaaggaggagacccatggaaaatccccctagtttcagaggctttcatgtgagagggctgtactgacctgtggtggggtcttctgatagtgcttctcccttctacctgccgttcagatgctctgaactgatgacctccatggaaactacaattaccaggaaagcctcctgttgccgtggtcactagtgactgtgcccatgctaatctttcccaatttcctttccagttgttttctagggatttctgtctttgatagaatgtaagagaagagatgaagaggtgtccaggtgtgtgtgtgtgtgtgcttttgtgtgtgtgtgtgtgagagagagagagagagagacagagagagagaaatgttgatgatgggtagtgaggtaaattctggtgcctcaacaatgagtttctacacagaaaaccacagttattaagttgatgtctgtggagctctatgaagtctttatgtgagcttcagtgggtccgtggatcctctaatattttgtgtgcatgcatatatgcctttttaggggagagagttcattgcttctaccagattctcaaagggaaatatgaaatttctcccaagaaaatcctacctcctgtggtataatggttgcccaaaatgttggttgctggatgctttctacttccttaaggaaaagttaagacgttttgtacctactttcaggcagtcctggcatgtatgggccatggattgaacattagaattcagtttaattgatcttacatttagagaaatttttccctagcctctggcaatgatttggctgttatcctttttacttattttcttttttacctctatttttccccagttttgtatttaggaccaggagaagacagttctatgagtaaccagctagacaccatattaaaagtagtctgttcatattaaatattgatcacatgaatgattgtaataatcatacatgcttaaagctgtatgtgcattaaccaaacctgtgtaaaaatttagcgaagctctgaaaggttaaagaatttgccaaaaaagacacagctggggagtaacagagccagggttcaaatctaggtctctgattttaaactccatgttctcaacactatgctattatgccagccatagtgggtgaacaaagcccaccagttttcacactctatccatacgtctaacaagactcatcttccgaacatttttttttcctctcctggcttttaagagcaatggcttagctagaaaaaagtgaaccctagcaagtgtttgctacccagttcacaaaggtaagaatttcaggttgtctgttaggtttaggttttcatagatagtcagatcctgaccactttctcttgtgtgacctcagacacataatctggcatctctttgcttctgttcctttgtgtctaaagtggggtcattgtgaagattcgatgagtttatacagataaagcattaaaaatagtgcctggtacatagtaagcactcactaaaagatagctgtcattattagttataacttagttggaaggtcttatttcctgagggcatctggtacgtctttggataaatgtggccatgaaaatgacagtgactcgaagagggccgaataggatcagctcagatctggagctcccagtgagaccaatgtagaaggcaggtgatttctgcatttccaactgaggtacccggttgatctcactgggactggttagacagtgggtgcagcccatggagggcgaccagaagcagggtggggcgttgcctcactgaagaagcacaaggggttggggaactctctcctctagccaagggaagtcttgagggacggtgctatccagcccagatactatgcttttcccatagtcttcacaacccacagaccaggagattacctcaggtgcctataccaccagggccctgggtttcaagccctaaactgggcggctgtttgggcacacatcaagctagctgcaggaattttctttttgtaccccactggcacctggaatgccagtgagactgaaccattcactcccctggaaagggggctgaagccagggagccaagtggtcttgctcagtggatcccacccccacggagaccagcaagctaatatccactggcttgaaattcttgctgccagcacaatagtctgaagttgacctgggatgctcgagcttggtgggggaggggcatccatcattactgaggcttgagtaggcggttttccccttcacactgtaaacaaagctgctgggaagttcgaactgggcagggcccaccgcagcactgcatagctgctgtagccagactgcctctctagatttctcctctctgggcagggcatctctgaaataaaggcagcagccccagccaggggcttatagataaaactctcatctccctgggacagagcacctgggagaaggagtggctgtaggcacagctttagcagacttaaacgttccttcctgcctgctctgaagagagtagcagatctcccagcacagtgctggagctctgccaagggacagactgcctcctcaagtgtgtccctgtcccctgtgcctcccaacggggagacacctcccagcaggggttgacagacacctcacacaggagagctctggctggcgtctagcaggtgcccctctgggacaaagcttccagaggaaggagcaggcagcaatctttactgttctgcagcctctgctggtaatatccaggcaaagaaggcctggagtctaacccaaaaaactccagaagacctacagaagaggggcctgactgttagaaggaaactaacaaacagaaagcaatatcatcaacatcaacaaaaaggatgaccatgcaaaaactccatccaaaggtcaccaacagcaaaggccaaaggtagataaacccacgaagatgaggaaaaacgagtgccaaaaggtgaaaattccaaaaaccacaatgcctcttctcctccaaaggatcagaactccttgccaataagggaacaaagctggatggaaaatgaatttgacaaattgacagaagtaggcttcagaaggtgagtaataacaaattcctctgagctaaaggagcatgtcctaacccaatggaaggaagctaagaaccttgataaaaggttagaggaacggctaagtagaataaccagtgtagagaagaacataaatgacctgatggagatgaaaaacacagcacaagaactttgtgaagcatacacaagtatcaatagctgaatcaataaagcagaagaaaggatatcagagattgaagatcaacttaatgaaataaagtgtgaagacaagattagagaaaaaaacaatgagaaaaaatgaacaaatcctctaagaaatatggaactatctgaaaagaccaaacctacgattgattggtgtacctgaaagtgatggggagaatggaaccaagttggaaaacacacttcaggatattatccaggagaacttccccaaccgagcaagacaggccaacattcaaattcaggaaatacagagaacattgcaaagatactcctcaagaagagtaacataattgtcagattcaccaaggttgaaatgaaggaaaaaatgttaagggcagccagagagaaaggtcgggttacccacaaagggaagcccatcagactaacagtggatctctcagcagaaactctacaatacagaagagagtgggggttgatattcaaaatttttaaagaaaataattttcaacccagaattttatatccagccaaactaagcttcataagtgaagaagaaataaaatcctttacagacaagcacatgctgagggattttgtcaccaccagacctgccttacaagagctcctgaaggaagcactaaatatggaaaggaaaaaccagtaccagccactgcaaaaacaacccaaaatgtaaagactattgacactatgaagaaactgcataaactaatgggcaaaataaccagctagcatgataatgacaggatcaaattcacacataacaatattaatcttaaatgtaaacaggctaaatgccccaattaaaagatataaactagcaaattggataaagagtcaagacccatcattgtgctatattcaggagacccatctcatgtgcaaagacacacataggctcaaaataaagggatggagcaagatttaccaagaaaatggaaagaaaaaaaaaaaagcaggggttgtaatcccagtttctgataaaagagactttaaaccagcaaagatcaaaaaagacaaagaagggcattacataatggtaaagggatcaatgcaacaagaagagctaactatcctaaatatatatgcacccaatacaggagcacccagattcataaagcaagttcttagagacctacaaagagacttagactcctacacaataatagtgggagactttaacaccccactgtcaatattagatcaacgagacagaaaattaacaaggatattcaggacttgaactcagctctggaccaagtggacctaatagacatctacagaattctccaccccaaatcaacagaatatacattcttctcagtaccacatagcacttattctaaaatcaaccgcataattggaagtaaaacactcctcagcaaaggcaaaagaacagaaattataacaaacagtttctcagaccacagtgcaatcaaattagaattcaggattaagaaactcactcaaaaccacacaattacatggaaactgaacaatctgcttctgaatgactactgggtaaataacgaaattaaggcagaaataaataagttctttgaaaccaatgagaacaaagatacagcataccagaatctctgggacacagctaaaacagtgtttagagggaaatttatagcactaaatgcccacaagagaaagcaggaaacacctaaaattgacaccctaacatcacaattaaaagaactagagaagcaagagcaaacaaattcaaaagctagcagaagacaagaaataaccaagatcagagcagaaatgaaggagaaagagacacaaaaaaactcttcaaaaaaatcaatgaatccaggagctcatttttttgaaaagattaacaaaatagactgctagccagactaaaaaagaagaaaagagagaagaatcaaatagacacaatgaaaaacaataaaggggatatcaccagtgatcccacagaaatacgaactaccattagagaatagtataaacacctctatgcaaataaactagaaaatctagaagaaatggataaattcctggacacatacactgcccccgcaagattaaaccaggaagaatttgaatccctgaatagaccaatatgaagttctgaaattgaggcaataattaatagcctaccaaccaaaaaaaggcccaggaccagacagattcacagctgaattctaccagaggtacaaagaggagccggtaccattccttctgaaactattccaaacaatagaaaaagaaagtctcctccctaagtcattgtataaggccagcatcatcctgataccaaaacctggcagagacacaacaacgacaaaataatttcaggccaatatccctgatgaactttgatgcgaaaatcctcaataaaatactggcaaaccaaatccaacagcatatcaaaaaacttatccaccatgatcaagtcggcttcatccctgggatgcaaggctggttcaacatatgaaaatcaataaacgtaatccatcacataaacagaaccattgacaaaaaccacatgattatctcaatagatacaggaaaagcctttgataaaattcaacaccccttcatgctaaaaactctcaataaactagatattgatggaatgtatctcaaaataataagagctatttatgaaaaacccacagccaatatcatactgaatgaacaaaagctggaagcattcccttcgaaaactggcacaagacaaggatgccctctctcaccactcctattcaacatagtattggaagttctggccagggcagtgagacaagagaaagaaatgaagggtattcaaataggaagagaggaagtcaaattatctctgtttgcagatgacatgattgtatatttagaaaaccccatcgtcagcccaaaaactccttaagctgataaggaacttcagcaaagtctcaggatacaaaatcaacatgaaaaaatcacaggcattcctatacaccaatagtagacaaacagagagccaattcacgagcaaactcccattcacaattgctacgaagagaataaaatacctagaaatacaacttacaagggatgtgaaggacctcttcaaggagaactacaaaccactgctcaaggaaataagagaggacacaaacaaatggaaaaacatttcatgctcatggataggaagaatcaatatcatgaaaatggccatactgcccaaagtaatttatagattcaatgctattcccatgaagctaccattggctttcttcacagaattagaaaaactactttaaatttcatatggaaacaaaaaagagcccatatagccaagtcaatcctaagcaaaaagaacgaagctggtggcatcacattacctgacttcaaagtatactacaaggctaccgtaaccaaaacagcatggtactggtaccaaaacagatatatagaccaatgaaacagaacataggcctcagaaataacaccacacatctacaaccacctgatctttcacaaacctcacaaaaacaagcaatggggaaaggattccctatttaataaatggtgttgggaaaactggctagctgtatgcagaaaactgaaactggaccccttccttacaccttttacaaaatcaactcaagatggattaaagatttaaatgtaaaccataaaaagccctagaggaaaacctaggcaatatcattcaggacataggcatgggcaaagacttcatgactaaagcaccaaaagcaatggcaacaaaagccaaaattgacaaatgggatctaattgaactaaagagcttctgcacagcaaaagaaactattatcagagtgaccaggcaacctacagaataggagaaaagttttgcaatccatccatctgacaaagggctaatatccagagtctacaaggaacttaaacaaatttacaagaaaaaaaacaaccccatcaaaaagtgggcaaaggatatgaatggacacttctcaaaagaagacatttgtgtggccaacgagcatatgaaaaaaagctcatcatcactggtcattagagaaatgcaaatcaaaaccacaatgagataccatcttgcgccagttagaatggcgatcattaaaaagtcaggaaacaacagatgctggagaggacgtggagacataggaacgctttacactgttcgtgggagtgtaagttacttcaaccattgtggaagacagtgtggtgattcctcaaggatctagaaccagaaataccatttgacccagccatcccattactgggtatatacccaaaggattgtaaatcattctactataaagacacatgcacacatatgtttattgcagcactattcacaattgcaaaggcttggaacccacccaaatgttcatcaatgttggactggataaagaaaatgtggtacatatacaccatggaatactatgcagccataaaaaagaatgagttcatgtggggacatgggtgaagctggaacccatcattctcagcaaactaacacaggaagagaaaaccaaacaccacatgttctcactcatgagtgggaattgaacaatggtaacatatgggcacagtgaggggaacatcacacaccagggcctgttgggaggtagggggcaaggggaggaatagcattaggagaaatacctaatgtaggtgacgggatgctaggtgcagcaaaccaccatgggacatgtatacctatgtaacaaacctgcacgttctgcacatgtatcccagaacttaaagtataataataaataaataaatataaaattacagtgattcactaataatcatattctgtgtctgaaattccttttcccctcctttatctttctgcacccctacagagataggaaaaaccaaagtgttttttctccgctcaaacatcactcaacacaacacttctcacaccagatgtatgggggtttctctccacacaccaagtgatcagttctctagcagacaccaagtgggtgtaattcacttcatttctgatgctggctacctggaggaagagtcaaccccacagattaaaagctcagtcccacaagactgcctcccacttcaaatgccagtagcaagccccaggttatgacctgtacttctgatgtgctggctatggatctaggtttccaaaacctccttctcaggttttatgaatttgctggagtggctcacagaacacagggacatgctttgcttacatttacccgtttattgcaaaggatattttaattttaatttttgtttttttttacagagttgatatgatttactaacaagtattaattgtcgatcttgagacttctgaaatattttcattggctttatattttaatatgaaaattaataatttcttttttttaaattttattttattttaagttccaggatacatgtacagggtgtgcaggtttgtttcataggtaaatgtgggccatggtgtttaactgcacctatcaacccatcacctaggtattaagccttacatgcattatctgtttatcctgatgctctcccccttcctctgcccccctcccaccccttcaggccccagtgtatgttgtttccctccctgtgtctatgtgttctcattgttcagctccccacttataagtgagaacatacagtgtttggttttctgtttcctgcattagtttgctgaggataatggcttctagattcatccatgtccctgcaaagggcatgatctcattcctttttatggctgcatagtattccatggtgtatatgtaccacattttctttacaaggatattttaaaggatacaaataaggagccagatggaggaggtgctcagggcaaggcatgtgggaaggggtgtggagtttccatgccctccctgagtgtgccactctccatatacctccatacattcatcaatctggaagctcattcaagcccagtcctttggggtttgtatagaagtttcattatgtaggtatgattgattacattattggccattggtgatccacttaaccttcagccttcctcccctccctcgatgttgtaggttggggctgaaggtgccaaccctctgatcatgtcttgacttttctggtgaccagcccccattctgaagctgtctaggggtttcatatccactgacaagctatctcattaaccagcaaccagctatctcattaacatacaaaatacactcttatcactccagaattccaaggcttttaggagctgtgtgccaggaaactggaagaaaaccaaataggtatttcttagtatacatcacaatatcatatccctgcagccacagcaactttgtagataatctttaaacatcagaatggagaaagtggaagatgagcccggacagagtgcattccaaatcagtgctgtttcgtgtctctctttttcaccgtataatctgaagtttagtctcaagattctgccatctcaccactacccatttctaaatggaaatttttcagctggtcacagccaggagccacatatgaagaggaataagagacagaagacttctaacttttcattgcttggcaacagtaaatgcttacagtttttttaaaaaataaaattgatgttataactttatggaaatcagttgtaaaagggagttagcagatattttatctttgtgataagacattctactggtctgtggatatgtgaatagtagatcgttttttggaagacactaaaaaaattaaagttttgtaataagagatgtaaattaaagtcatcagtagagagaaatgggtgccctaaaatatggaatatttggagttataatgccttctaaaggaggatatattattataaccatcatttattcaataaaaactataggtacttaccatgttccaggtacatggctaatttctggggcaacaaaaatgacaaagttattgtcatccttgcccttgaagtgctggttaaaggtgacagataatcaaagaaataattgcagagcgtggcactgagtatgatgataaaagttaaaaaaaagagtgctgagagaccacagaagaggaagctatcagctcttaagatgcttggaaaaataacagatgaaaggacatgcattgaacatttattgaatgaatgaatgaatgaatgaatgaatgagtgaatggtgtcaccaaagcttatgtcatcacagtgttaaacactatatcctgaaacaatgacctggaattttgcaaacaaaagagaagattcaatgtagtagtcaactccattgcagaacactggggcctcaaggtgagagaggaagctttatgactcctacagtcccctaaaaattgagtaacatattttaatctgttacccaataacatactttaaataatgtaagctgcatgctgttatttcctagaaagatgtggtttcctggagataagttgtgtctaggtgaagcttctgcatgatagcttatttcaactatgtaacaaagtatatattttaaagacagccagtagtgaatctttcggaaagaaaaaagttatcttaaaagtagatgcattttgatttaggattttgcatgtctgctttcataaataggttttcatatctggtttcctgcattaccaaatgacattgaagtttttatagatttaatatttatcataacatacaactacatctattccctggaattatgtgtgggtgtgtgtgtgtgtgcacgcacatgtgcatatttatctgccaacatctgaattccctctatagcattgcaaatgtaaaattagtatgtcattcttagaggtgctgtttagtattacaatctgtagctaaatactaggctaattattctgtgaataagtctctttctctggtataatgtagcactcaagcacaagcgatcaataaatgttattatgttatatattttaatgttattctacaagttagtaaataaaatatctaacatagtaacattttttgttttttatttttatttttaaaatatctaacataataacattgccaactcttttcacacatgagttcatgtaacccttatgatttgccatctacaaccatattttaaagtgccaaatataaagttggtcattgtttctaaaaagtcagtgttctcacgttctatttgactcttcgtgtctaatagtgatatttaaagtaggtcatttagctgctgattttactcctgaataactccggtccccttaacactatcagatgttcctttccatcacgtgtttttctgcttccagttgaagaacccacattaaaaggagttgagtggaaaatggaatgagcaatacgccctcagtttactattccttccagatatttttaaatgaaggtacggaaagataagatggtaggtttgttgcggggcagagggaggatggaaggagagtttatcaaaagcgaaaaaataaacagatgagggatataagaatcattcccacagcctccatctccctttatgttctctgatttccaaacatctgtatttctatttttaactttataatagcaaaaatgttgtttaagaagtaaataattcctaacattttaaggataaattagtgtagtatacccagtataaggcaagggcccagatccatgaaggtatcagcattaaagaagacaaattacagaagaccttcaaaagcctttagaagcttatgtactccttaacagtttacaaattgccttatctccatttttcatctgtataaattgatcacatttcctcaatttctaacatagagcagaaccactttcatattttttatttatatgtgtgtgttatactcatacatataaactgtatttttaaggacacatttaagtgttcccttttttcacctgacactaatgttaagaatggaaaattatgatacaattcagcaaggagaggaattgcggtgcatgttattattgactacattcaggtatagttggacaaattgggtaatggaaccaaattggattatatgagattctggccttaaaactatcattctattatgtcttctgatgaaacacaattgaatttgagttgtgtaaactgaaaaaaaaataaataattgcaaaatgtaaagtgaaagatacaagagtagctacatagaatcgaaataaaactactcacgtaaataaaatatttcttacacacttaaagcacatatattaacattatataagaacacatctaaatgaatgcttatcactgagcaatatgattttcaaaatgttattcgaagacaacttggctgttcataaatcttttaattttaagctgccgatttacagtttttcctttcatcctcttgttttgaaggcttgatgtgggagtgctaattaatgttagaattcttatccaatgtacttgttgctaagcagatagaactatcagagcattttattttgaaactgcactcttttttgactgatatagcatttgaaatcgtgcttgaagaaacatttcatggcagggagccagttttctcattaagaacatattgcccatgaccaattcactggtttatttatttccacaatgcctgttgcccctgtggctcatacatgcgtcgtgttgaaaaccacatgtaaaagacatgaacactaagttgtcttatcagtatgagaatacacaatttataaaatcataaaacatggaagttaatgaaaagtttatttagaactgtatattttgccttccaggcagaagttcttactgactccttgggctgtcttagctgattgcacgttgacttctgtattcttcatatacgttttttgtctcaatttgagtttcttcagaagcagttcctgtgtcagaggtcctgtttgtttggtttattttataagttcataaaatactgatagggatctgagaaatgagaaaggggacagcaactgagagaagccttggaaatggtttaaaaccatgtctcagagttaagggacaacggaggtaggatatttatgcaccaactcttcagtcactggctgagtgtcacaaggtttgaagaagatgtgatgtccctgacacttaccagcctgccatgcaaaaggacagagtagtctttgaagtttcagagaaagcactgagccaatgagaggcgatgacctgtactagcagttggatgccagttggggcacactgaagcagtaacagctaagtgctctaggtgggccaccaaaaacatctgccatatcttctgtgggcttacatccacccaaagtgttatttttattctatcctgatctatggaagatggaaggatcatttcgtagttgtgtattcatttttttcattagtttgtacacatttatggatatcccctgctggggccactgttctaggcatggaggcagacaccagggaagaatatgacacaccaccatcattgaggtccgcacagtcagggtaatgggcagaggcagtgaagagccacggaaaatccttgaggtgcaaatgaagttgaatcatttactccatctatgggaatcatttacttcgtctactatgagtagtacaaaatcctactaccttctggagtggctttggctctttgtctggcattgagtttctttctctgtcttagcccgctggtctctgagtacccccctgaagatgcattcatatagaaaagggaggagtcagtaatatcttgtttttctattcggggtattttagtaactgcatcctgtggctgaaacattcagatgatttcaagattttgacacatgaagattccaggttcacctatgaaagaaaatagggagtctgcctgccaaaattctagttttatctaaaggatgccaactagcatatagcatgcatgcagaagatggccagtattacattttttgaaggagtccattacaaaaactataatatttagggatatgtacttattaatctagaatgagagctacagctatggtaatatgaatggaagcataataatttttccaaatagtattactgtttagagattgtttttgtttctcttccttaggttttttttttttttttttttttttttgagagaggagatagaggtggctgctgtgatggcaatgatagctatggttactgtcttattgaatgcctattattatattaacaaaaccgaagttcagagaggttaattaacttgtctaaaatcacaagcttggctgggcatggtggctcatgcctgcaatcccagcactttgggaggccgaggtgggtggatcacttgaggtcaggagttcgaaaccagcctggccaacatgatgaaaccccatttctactaaaaatacagaaaaattgctgggtgtggtggcaggcatctgtaatcccagctacttgggaagctgaagcagtagaatcacttgaaccagggaggcagaggttgtagtgagccaagatcacacaactgcaccccagcctgggtgacagagcaagactctgcctcaaaaacaacaaaaaacaaaaacaaacaaaaaacccccaaaaaatcacaaactagtcagtcagtattttgacctgagtatcttgaattctcaggtgtggctgcaagacgtattgataagaaaaaaaaaaaaaaaaggtacaacataagagaattcaagtttcattcacttttccagcaaatattctgtagaaaatccactatggcccagccacttagctaggcaatgtgagtaccaccttctaagacagagaaacaaaaccttcccctcatacagcttaccatccggtagggaggttagctaagctattaaacagatcagtacataccgggggatgagtgttgtgatgggaaattcagttgataagagagcccgaagccagaagacctcattgattttagggatcagaaaaggctttctgcaggaagtaaattttaagctgaaagttaaaagaggatgactaagctaaagtgggagtcaggggagcggaaaggagagaagtgttctaggcactgggaaggcccagaggccttattctagcattgaaaggacaatgtggctgggacattgagttcaggagggagagtggagacagaagaagccgaggagatggaagccctgtgaaagatgcagcagatatcatgatgttgttcccaacctaaaagccctgggaagcccatgaaggagattcctctggctctggtgtgtgggcagattgaagaggaatataccaaatgaaaggaagcatcctaagtaattctgatgatcatcccggagtgctgctggtgaaggtggacagagtagatttctttgagagatactgaggacttaggaagagaagacttgggagagtttgcactgaagaagggagaaagcaatagcattgtctgtgcttttgatttgaaggaaagggtaaatgttagtgaaatagcttctgaaggcctttaagaagactgcctacatagaaagcctacttctatctgccggccaaagatctggaggaacctcatcctttcattctaaaaggagtcgtggatgtagatttaaccgttctggtatctgaaggtggtgggattaggaataatttttcttcctttttttttttttttttttgttttctctgctttagttttataattaaaaaggaattttcttataaaaatacagctactgtgatatcttctgctgaacatgtggctcaacttactcacaaggtcaggaaagttgggcccaaggcataactgcttaaactcaagaaaagagaaaagacaatttcatcaccagtgtaattaagtgagcttccctacaatatcttaacttagcttctcatctaagtaatatgaatccaggtatagtgggttttggtgtttattttaatcttgtattgtcattagccagttagttacattagttacccttgggtgtattgtggaaatagatttccgttacattctttttttcccccctttttaaggatttagagtattatgcctgagtgaattgattcatagggattttacttactcattcgttgtgcgctgctgtgtttttgttctccatctggttaagctgccgtgactctctgtatagcatttgcacagtgttcacatgatgcttgggtacttaggtgtcagtttttcattatgcccggatgatgtgcgttgcgtggaaagcctccggaaccgtaaactctcatttcccaatcatgaatagttaggaaaccagagttcggcattttcattaacatagggtcttacatgccagttcagcttactacctgctaagcctcctagtctgttggaaaatgtgcattggcagttttccagtcttgctaagactcataaatagatgcctttcatatgaaatgtatttgctttggcatattgacactggaatacattattcttttagcagttgaacaaattaaaataaaaatgatgacttctttttttcagtatactaaaatgagcataattgggttaatatcttaatctggcagtcaggaattagcttgtatacccacaaccacataatttcactaagggaagtttacatgtttccttttccttgttctgttgatgaccttcctacgtgtcaataactagcagagagtttggtcagataaaggggttggaataacctggagagcttaccaaaaaaaatccttatctctgagtaccatctctgtaaaatcctggtttaattggtcttgggttcagcctgagcacctggatttttttcaaagttcccagatgatttcaatgtgcagtcaaggctgagaacactcgctctcatcatgtgtaccagagacaatactttcgtaagcaaacagcctcacctaattgtttctttctcttttgttttccctaagtctagtccacatctttgggcatggtccttgagtaggagaataagagagctattgaatggtccaagaagattcagatggcttcattttacactccagttgatcatatagaagtttagggagaacactcaagaccactgggagctactatgtaggtgaatagatttgtccaagacccactctggcacttccaagctggccctggtgtactcatgagtaaagcctgccagtgtatacttacatttccaaagacttccgtttagtaagggctgcctgatcttataggtgcctcagactggtccttctacaagtatagttgttttatttcatacttctaaatggatgtttgatattgtttaggattcaaatgtttattcagaaatccataaagtaggtatttgacatctcatagttttgaacaaaatggtaagaacaagatatatcaaaatatatcttgaaggcatgagtaccatagaccttttagaagtgcattttctagcatcttgtacaaaacaagacccttatttctgtaaaacttgatggaccttagctgggaatgtgatatcacttatccttcaatgattttttaaaagaattatacctgcatttaaagccttggcaaaatatggtaacattctagctactgaaaacccataagatattgtcccacataagatggataactttccactgaagatggataagttttagggtatctgaaccttttaaaccttgtgggtatcatttgtataatattctacttaatagtaaactctgccattcacagtgtcccctttctcatttttctagctacagttttcggcaagccatttggtgtgcttgcaatgctatcatgagctatggcttggcgttacaaggtctggagagtgaaagtgttttctgagtttctattttcaatagttattaggaaaacaattgaactttggctatttcctggtaggtttaactttcatttaagtgaggcatctgaatatttttgttgaaaatataatctttcaccatgaaactatctgagtttgagatttcagttataaaacacgctcttttcagtcattgaaaaaataacctcctgcaattttcctctgaaaaataaaaatgtgctttgatagagttttcgataattattatcatacatctgtgcatgtacccacaccattgtgttcatctcccatccatgtcattagtgaagatatggattaattccacattggatttcattgtatagaatctgggtatttatatctaaaaaaaagtgctgtcatttgattacatttaggcaaattttctcagtttataatctagaatgtgtgtttcggtcttcttctttaactggatgttctcaaagtatacttaaatggcatggccaaaccattgaagaaatacaacagtgatgactagtttctctgtgtctttccctgttcagcagttatagaggcatgattctatgattatttttgtgtaatctttgaatatgcaaaacaaattataacaaaaagctgtggactcttatgggattctaggtcgtgtatatttaattttcagcagcaaacttctccctatttgtaacttgttgatcttcttcagaaatattttcttttccatttaaaaattttaaactgagactacaatcaaacctttttcttttcttcatgtatagcaatgcttaagttatttgtatttcttataattaattttatctgcaaataacagaaatcctgaaataatagtggcttaaacaaagtagaagttaattttttatcctcatgttaaaacaaaaagtgcagacataaggagtctggagctggcagagtggctcagctgtcatcagggacctgggtttctgtatccttagcacactcaaggttgcctcatggttcaagactgctgctagattaccagccatcgcattaagaaggaagctagaaaagcgaagtgggaaaccaagagagttgtcctcttctttacaaagagtctttctgtggatcccatacatcacttctgcttaggtcttgttggtcagagctaattcacatgaccataccttgctgacgggaaggcttgggatgctagaactgtagttgggtgtaataccatcccaaatcccaaatatatttggtggctttttttgtttgtttgtttgtttgtttgttgttttttcgctaagaagaggaaatagactttgggataggaaatagcagtctttgctacctcactgttttcagattatgatattgtaagatatgctcaaaatactccaagtacaaatacttacattgcttgttgacagagtaaaataaattatataagtaaagctagttaggaacttgccatattggcagttcattttgaggatatttctaaaaatcatggactgcaggaggagaaataccaaagccaaacacataaaaatttcccacaactatatgaaaattccaaaatttatctatatggtaatcatatgtctggtgactttatttattcagaatatctctaagaaagagagagggttgtatatttgaccaattgtttttgtcaattcagagctgttgaacaattataaaattccaaagttctcagaaaatacttggctagtcatggtattgcatactgtagcttctttaaacactctgcagaattcttgggagttggtcatcagtagcagacggtaagaaaggttatgaagtctcctggttgtctgttgctaaaaaatcatcccaaaatatagtggcctgaaacagcaacaattattgatttgctcataattctacagtttggacaagattcagtggggatggcttatctctgccccatgtgccatcagatgggatagctcacctggaggggctgaaggatccacttccatggtggtttaatatacacagctatgaagtcagtgctggctgtctactgggaggtctcaattctcctcacgtgacctctccacatgactaggctgagcttttcacagaatggcagctgatttcaaagagggatcatcttggagaataagcattccaagagtacaagtcccagtgtgcaagtacttatccagttttttgttaatgtctcattagccaaatctagtcccatggcaattgggaggggctacccatggatatataaataccaggaggtgtggttctttggaggccatgaaagaaactttctgccacatttaagttctcaggcagaaaaaatagtgtttattgaggtactaccatgtgccggtcactgtccttaaacacagagctgccctgcataaaaggtcttattcgtcccattttccatttaagataaatgaggttcaaaatgttttaaatgacctgcaggaggttacaaaggtcctgtggtgaggctccatgtttcaatctacctctgaaaaactcctaagtctttgcactttgcagggcctccagctgcctttttaaccacatggtccattgtcactgctgcaggcacgtctgccctgtgtgctttcactctaagcacaataaaagacttaccacccgataagtctgttttttgaattgagaacaagagaaagagattcctgaacattctaattaaccaagtaccgctcctgtgccacagagatgcctagcagtgagagccgtaaaaggaaagtgcttggcagtgaagcaagacaagaaacctggtcctttgtgctctgccccattgcaagctttctcctagcaaacctgaccagtgacaacagtgtccaaagtcttttctagaaaggtctccatattggtacctttttcctgaagtaagggcttataacaagggcattaaaatatgctaatttctaatgctttctattaggcgtatccacatatcaaagcttttactggaacacctttgtcaaaaaaaaatataggtcatgcacatggccatgaaattccattctttatattttaagcagcatcaagattgttcttttccttcgctgtttggcagattagaattcctctttaaagtgggagaagttagttacttatcaaaccatttgattaattagctagacctgtcaggccaaacaggactagccaagtcttttaaatctcttaatatgagccaattttcacaataacttgttttattcatggccttcacattttaaattcttgctcattagtgacctggtatttgggcttgtctgaaaggagagcatccgttgtgttaaacagggctcattatggattataggttttcgaatggggatgcctatgcacaaaagatcgccctcccattttcctctgaatagttaattggaccttcaccttgtttttacaagcaaaggctaagcttcaataaggagataggcttttataatgccacagtttgggttgtactgaagagctggtgacctatcattatcaatacagatgtggaactaaagtacagcatgtgtttggttttgctagagacaataaaagtaatggctgtttttaaaaccagtaaaacactgaacttgatagaaggagaaattcattgaatatatcactctgcaatagttcaattccttgagtaataaaatacaaccaccaaacactcagaaataaacactagttaaaaaaaaaaaatgaaacacaagcctgaacccacaatacccatgcattgactcccaagaaaacagatttttacattccctaataaatacatgtattactatatccccaaggttttagcatcctcattgtatatcaggctaatgtctctaatacaaattctttttgaatttttcttagttaaaataatcttctgttttggtgtgtattttcaatttgttttaagattctgtttctgttgcttgcagtaattctttttattttcttttcctacagaatttactgtttatttccaaattactccagaccctaatagtctattttgcttttggcagaattcgtgtatctattgagttgcattctgttttgttgaatttcactcaatgcgtgtctctccaaaggcttcgttcagggacaaaacattcaactgcttctttagggcctttgggttgtgtttgtaacatgtatccacaatcagctgtcataataagccgagcatcctgattaattcactgtaccctccagtcgaagtattcacggatgtaactagttgaaatgcggatacacaagttcctactggtcttaaaagaaatgatttttctggtagttttataattttagcaattcagatttcgtacatttgaggttagaaaattcagcagacagcctaaatgcggcatcatgctaatggagtcctggaagctgctggtgttaaaatgagtaaattaaggagtcaacactgcttatttaggcacattaggataaaatagtatgagagctcggacttaacaaaaatcaattcagcacgcagagtgcacatccatcagggctttgttatgatgtcagggcgagcagcaaccctgttttattttatgaagaatgctacattagcatcatcgcgtccttggatggctgtgacatttgctgttatggaactactttgcggcagccacagggcccccagggactactccaactacattaaaaaattaggttggcatcaaatgacttattgaactctgtattgatatccttgggatttggttgtcaatctacacagtagttagtctcctttcacagcgaccgcattaagtaggaagttgtaacagttattgacgatttgagcaaattattttcctctatccagcccctacatacaacaacaatagtaataaacacagcttgagtgaaaagtatattccacatatggcatggatgctttgtttacatggtacgtggttttatttcacaataactcctaggtagatattatgtcctttctgagatttaagcattactttagtcacttaatcaaaaatcataaactgaagctcatgccattgaccccagttatataaaagaagtttgaaattttcttttgatctaggttttgcaccctgatagacttcacagataatgtaactaattagtaactgtgttttatttttgtgtacccatattctccttgccagaaaaaaaaaaaaagttgttggaacatactctttgctgtgtttcctcttggaaactattagccttcattattcagagtattggaggttagatatttaattttacaagcctaattattgactaacattttaataaacatttgacatttattaataagaattcaaaatatataaccatttaattttttacatactatctaatatctaatagtctcatatgaagtagaaaaaattacattcatgaaacactacactctattcatattatgatcacaccatcttttgttttccttcttttaaaatttttattttttgattatgaaattaatgtgcattcattggtaaagttcgggaaggcataataaagaaaataaagatgatatataccaattaaaggtaagccctgctaatagttgatattctttcagaattttttatattcattttcttctgtatatgtatacaattttcctatgtttgctttatatatattgttttgcaactagttcatgcattctaagtatatagcagaatttgtttcattaattacttgctattggaagttggttctgagctattttgaggatgaaaaacgtttctttgaccattcctgtatatacaacttctatgaaagaggcaaaaggttatgcatgctaaatattcagatgtgttaccaaaataccatccagaataacacctatgtaagaagttccctgattctcacttcacttttagggttaactgggacagtatggacattcttttcttaattcagtcattcaaagccatttgagtgcttactatgcattaggcactctgcaagacccaagagacagcagtggtaggagacagataatcctgctgcttacctggaatgtaccatgcaatgggtggagactaatctgaaataaataattgtacaaatgcctttctaatggaacttgtgctgtgaaggaatgttacgtcattgaacctgatctaggatggagagtcaggaaaagcttccctgaagaggtgacatttgacacttgaaaggggcaggtgtaatgagtttaatatatactgtgttacatcatgctaataactattaaccattgcatttttactgaggaatgctatgtatgttttggcacatcttaagtcagataattttattctgttttattgttggaccaaaaaaatggacaagttctcttttccacttctcttcccctttttgcccacaactacaattaacatgtgatggtccagaactattttttccttcttttttttttttttctatttaatgttacaaaggtaaacgtgtgccatggtagtttgctgtgcctatcaagctatcacctaggtgttaagcccagcgtgcattagctgcttttcctgatgctctccctcccaccgctccctgctcccccgccccacagtgtgttgcagaactatttttttttttttttttttgagacagagtctcactctgtcgcccaggctggagtacagtggcacaacctcccctcactgcaatcttcgcctcccgggttcatgccattctcctgcctcagcctcccaagtagctgggactacaggtgcctgccaccacgcccggctaatttttttgtatttttagcagagacggggtttcaccattttagccaggatggtctcaatctcctgacctcgtgatccacccgcctcggcctcccaaagtgctgggagaactattttttaaaggaaaatatggtctccaattcagaagagttgcacatctccaggatagggtttcatcttccaggcagtgtattcaggcagctcaacactactcattttttcacctgagccagctgaagttctagcggcagttgtctaatgatgatttttaagagtcataagcaaaaatgaggggacattggagcagtaccatatttagaatgcgaatattagtgcctccatagtctgaccttttctctctggacatattttatccatcactgtgtccacacatgccaaaatgactagtaaggaaatgaaaatatgtggcctttgaatgcaatttgtgaccaacattattttttgattaacagaatatatttttgtttcattgaatcaattattttatttagtatcagcattaattgtctacagacaaaatatctttggttctttgttaaacatttcaaaatgtgctttttattgtataaaactctacaactattatttccctagaagttcaatgcatacattgataatttattatgataaattgatgcagaatattgcatgatgtaatatgagtttcatgttgaattaagccatcacccctaaatatgaatctcaaagagctgtggctatttggtttctttatccaaagaaaaaatgattcataaccattgttgatgcaaatattactacttaagatgcaatgggtttctagtttcctctttgctgtgtaaaatgtatgcttggttgaccagaattcagtgaaacctctcattagggcactacggttcattaaggtttaaagaggcatcactgaaatttgaattggccatgctgtgattgccaagtctctctgagtggtaattgggctgtgttatgttgtgtgctttactgctgcaatggtttttagagttgttaaaaaataataataatagtgattaagctctgtgctatgtaaaactggcaagtttcttagtgatggcatctttttgtttataaattgagatttaaaaaatcatattcttacaaaaaacattcaaacaccaaatttgaatatcatactgagtttgttttttacttattggaaagagtatgttaacataattttgtttctatttcattttctcaaactggaagaaatatctggatgtgcacatagcactagaaaaatcaataagtaatctagatattgatttactgaatacccaacatgcagattgagagaaaccatattcaaaatgtgacaattcagttaaaagtgaactgaaacaagggtgcggttactaataggcagggaattactaggcagatgcatatcagagccagatccccaagggaagggcttatttcacctacgtgatagcacagtttgtactcaggcacttgagaaacaataatttaccataattgaaccagccacaaatatttattttgttaaatcagacccacaataccagcctgtctgtgctttgctggctagaaaatgtcctcatgagtcttaaatttatccttaaaatatatttaaaaaaataatcttaactggctttacctgtacctagttcaaatcgttttctctttatgcacggtgaaatctcaatgttggttactgtttctgcacatttccctcgggatggtggtttgtgagcatacctacctgtgctgctgtgttgcgagcctcactttgctcacctgggtttccccaagtgttgtgtttcaccactgggaggaactggccactgctgtcacctcaccacctaccataaggcctaatatatgacatatgtctaatatatatttgttgaataagttaattactctggattcctacctgtggcgcagtggctgacacacatatatctgcactgccttttgtgagtgactgaatgaacgtatgcatttgccatttgggaatattttcagttttatcgacgtgactgtttagaggcataatcacagacttataggaaaaaaacgtttaggaaataattctttgcagatatccttttggaatatccatgtaagatttgccttttgacagttactccccaatcctcctgcctaccttatccctcccattaaaaaaagagcaacaacagccgggtgctgtggctcagacctgtaatcccagcactttgggaggccgaggagggtggatcacctgaggtcgggagtttgagaccagcctggccaacatggcgaaaccccatctttactaaaaaatacaaacaatagccaggtgtggtggcgggcgcttgtaatcccggctactcaggaggctgaggcaggagaatcgcttgaaccgggaaggcggaggttgcagtgagctgagatcgcgccactgcactccagcctgggtgacaagagtgaaactccgtctcaaaaaaaaaaaaaaaaaaaaaaaaaaagcaacaacacaagatatctggcacacgttgtcctgccgagttgttgtgagtttgtcatcgttttcgtttgttgttgctgttgtgtaagcttcacgtttggtgattgttatgttcttggggatgcattctgactatattgggtccccttgagaccagtgttgcaaccaaaagaagcagagaagatgtagtccctaccctcccgcacctcgacttcatgcctttgcgagttttttttttttttttttttttttttgagagggagtctcgctctgtggcccaggctggagtgcagtggcacgatctcggctcactgcaagctctgcctcccgggttcacgccattctcctgcctcagcctcccgagtagctgggactgcaggtgcccgccaccatggccggctaattttttgtatttttttagttgaaacggggtttcactgtattagcctcgagttctttaactacttgatcttcactgaattgatcaggctgagaaagaaacagaacagtgtcagaagccaaccagtcaggtgaaaatattgtgttttgcaagtaaggggggttgaagaatgagagggatgggaaggagggaggtacagaggaggggagaagagcaggtgcgctaaggtatggaatggcagtttgaggaaggctgggtccacatcttctgttctgatgcaaccccctcactgctgcttcctagagggaccttcagaaagagccacatttgttttcaaggctttctggagttagacttctacctctttggggtgccccactggtctcaagggaatccaacacagtcaggatgcatccccaagagattgtaaatacatacaatttaattgttataattatctttttcctgtttgcatctcagttaaacattgtaaaaaatgttgagatgctacttctcttaatttcagttccctcacagagcagagcctgagtcaagatcttgagtgcaagcagtttacttgacttgtttatttgacttagcctgggaagtagaagtgaggtagagagtgagctaagaacaggggaaaacccagtgaaggatgtgctgtttagggggttaccactgtgggcaactgagttttggtcctgctgggaaccctctgaagaaccatgtagtaaatgtaacctcaaacctgcctatctaagtagcactgttcaatagaactttctgtaatgatggaaacattgtgtgtccacactgtcttctgccatagccacatgtagctgtttagcatctgaaatgtgactagtgtgactgaggaattacatttttagcattagttaattttagttaacgtaagtgtaaatagccatatatagctagtcactgctggattgcactgcacaggtccaaaggattggatgttcaggcgtttatcactaactctcattccatacgtggggcttatggggctgtgggtgttaactccctcatacttccaacctgccctgcaaggggctaagatagctgccatgacttaggagaaatccctgaggaagaaaaaattgagagaatcaaagtccttaagaggagacactgccttgatacaagaaaactgtccctgacagctgcagaagaaatcacaggctgagaggacacacaggaggcacaaagtacccgtgtgatgccaccttatgaggcattgaaaaagtgacagtttggtatattcatatctgtttttacgattctgaagtatcaaagttcacatcataagaaacgtaattctggtaataatcctgaagttttcagttaatttaatgcttggaaacttttaatgttttctaaatagctttttttcctctcttttaaaacttcaattatttcgattttactctaatgtaggtactaggacaaaacggtcacctcattagtatgtagtattttctgtgttttcaattattacattttgaaatgctagtggaaaatgctgtctgccttacttttttattttcatagaagtgtatttgaattggtttcaaccaccataaagactatttcaacttatttgttactaatgatgccatagcttagtaaattgcataagctgaataaaaatagtataacaaaaaatgtggcaactctagtgattcaaaatgtgaaaaatgatgaggctctattttcttaaagttagatttaaactattctatgaatatttacattttaaaaaattaaattttctgagaaaatcttgcttatccctaaagatacccatcaagctgtaaaaatgtagagtttatatagataaatgaaactacataatatattagagtgttgctatgtagatatgaaaacaaaatttactcttgctttttgcatttctatgaaataactgtttaaaggttaggaataaaggccaaaatttgcatttaaatggatatattttaagaagaaatgccaatttgtgacctttacccttgccgctagtatggttttttttttttaggattaacaatcaaacttcagaggaaacactagaaatataagcaaattgatagaaaatgtttagtttaaacagcttcccagaaaactgtttttatagcctgtagggagggctaattgggccttgtcatgaatcagtttaatcatgtaaaatatatttgatgactgcaatgatagtgaaagattgatccgtagtggtataaatcaggggtcccaatcactgcagactcagtggaaatgaatagttaaaattcgaagggacccattaagtgtatgatggcaatcacagatttaaggcttcattctatatatttatgtatgcattttaaaatcttaagaagatacttcaaaatatattagagaatttttaaatttgtaaaatctacaatgggtactacaatatatctacctgtgaaccaccacagttgctggttgaaattactttattctattatcttccaagttgtattagccattgttagatttcagtgttatcagggtaatagaaattaggtagtgattcaaagtgtgttttaaattattcctctcttttcattgactagttgcatgtctatgagaatatgtgtgtatatatatttatatgtgtgtatatatgtatatgtatagtctatacagattgactatgtataatatgtgtgtatatttatatatagactatacatatatagactctctatatatacatacatatgtatatatgtttgagtgagtgaatgattgagaaacagatagattcatcaaagctgactctcccctttatgtggtatagtagaactgaatggaacatgtttttagtttagtttttgctgatgtgtgcatgtaaagtcctctataacaacctttttttccaaaactgtgccatttccggcactgctttttcctccattgttactttttgtttattacttgcaccttggacacatgggggaaaagtcaacctccctggacaggttcaggaatcagaggatgaaggaaagaggatacatgaagacatatatgaagtaggagttctatttagaaatgaaagaacatgtgaaatatcagttaacatcggttcatatggagtccaggattctatttaatatatcagatagtcagtaaggtctaagagaggcaactgaagtaccctatttagaggaaagttggcatcatggaagtttgttagccattgcctgggctcagccattaggaaattgatattaagttgggacattcagtccttggtctactagagaaaaagacttagaaatctaggctcttaaagtctgagtgaagctaagggcaagtacagaggggatgacccaggagcacagtgcctatgggactgactctacctaattgtagttgcttgaggtcaatgtatcattgaatccacttgctcagatactggaccagagcaatttctactaccattgctctggaacagggcattgcaccattctcttagaaactggaccttaagaaactgtggccatttcaattccattttgatatttattacagatttcttagtagatgccagacagtgtgttaggtcccatcactcatattgccttagtatccattagggctaagtaccattttcttagctacactcttccgcatgtagcttatttaggaaaagtcgggcaagtgggttacagacatagtagaaaacattatgtcaaataacaacctgcccagcaatgaaagattttaccacgtcctttttgattcctatttttgctaaacaggtttaaatccttaaatggttacagaattcccccaaagagtagattatttgtaggtattagacaaaaacaatcaaacaaacaaaaaaaaccacaacaccataaaactaataaacacacacaaaaagtgaggggtccgtactcaaaaaaaattttggaaaagagtgggttaagcaagttattttacttctactgcagaggaggctttcagtttgctgttacgctgtaatacccaagagagactaatgtatgcagagtttcccaaaatcatttgatctgggaatagtttgtattgaagcatctttagtgactggtgtcctgtagcacaaattcgttaaaattccaatgctccagttttatccatcactaggaggagctaacctcagagaaactcagggaaggatgctgggaatggacctgctggttgtacttcaaaagaagcaaaggcaaaggggtccacacagaagccccaaagagaatcaaggttaatgaagggctctgcatatgatgactgtctttaaagtaggaatcctccaatctgaaatggcacagacactgaagagatagaattaaaatgtctaaaattatgaatgttatccataggttgcctatactagtcaatcaaattctggaagatggaaatgactagataaatccttccccttgctcccatcttgaggattaatttatgggtaagaggtccatagaggcttgttaataggaaatcagacttttacagctatatgctaacttttggcaatgatagacagttaaacagaatacttacctgaatgaatcagtttggcagaaacatgcacaggatttgaaaattttatgattccaaaagcatatctgaacatatgccaattgataacaaatattagatgatccaagaactatttggtgaaataatgaaggtagtttgtatagaaagcacctgtgcttatagagttcataaaagtttttcaaaatgataagaggaaataaaactcttgtaattaactagaaagatataatgtattgatctgtaaattaaagaattttaaataatgagtgttttctctcttcactcttgagcctgtttctttcctcaagaaaattttgattcctaaagactaaagtggaagtgtttattatgtatgcataataaatatctagaaaataataaatatctaaaaaaagacaaatcaacatctgacatgaactttgtctttccaaagaccatagaatgggctatgagtgaatatctttacaaagacaaacttatcattagaacatttttggttgtctaacaggcaggaaattgttaaaaaaaaatcttgttgcagtaatggagaaaaattagatgttcataggagctcccagtgaggataatcacatctgaatgcatccttgaaaataaacacaactcaacattttagtgttctattatttaaccaattggagtatgaatggatatgtaacaaagcttcaataatgtgtttcctcccagtaattgcgtttctttgtaaatgtctgtcctttgagctaactgtgtcttgaaatctcctgacttcataattctcaaaatcaggtgtctgagatggtactacaacaggctacttgagataagagtgaccatatttaatgatattgaccagtcaactaaacaaaataattattttgatcaatctttaccaactaactagcaaaatttaccttactatgacaaattctaatgttttacataggaaacaaaatactaatggctttacctatatcatgcccaaccaggaaatttaatttgattagtgttttgcatatactaaaatatttctatctggatacatgcaaggctccacagggtggggttagatttttttttttcaatgatacattccacattccccctgagggaaatgtcaactattatcaggcacagccaaaaaacaaaacaaaacaaaacaaaacaaaacaaacacatggaaacaaatgaaaagaacaaactgaaaaagtgttaagtccatactattgggcaaaaatagtagttaacatatgtaaaacaaggagaattgttcaaagcttttttttcttcttgatatgaatttgttgtaaggcaaatatcttgtttgagtcatttgtttattgtgtgtaagtgtatgtgggtgtgtaatcattttgcccatctcttttgtcaggaaccattaaattcagtgcccagaaagatgttgcaaatcagctactataaaattagaatatgctagaaacttgtaattaatagtataaaattcttttacaagaccagacgatggttctacattttatgttatattaaaaaatgagaaaacgtcatttgtgaaatttaataaggcagaacattattatgttcatattgaaagtcagactaatctgagtggattaagggtgccttgtggaatatcttgtgttagttgactaattcttgtcctcattattaatgttctgcagcaactgtaatacctacaagtaaacatcaattgaaaataacttcataaacatttcttaatcaccacagatagaatattgtttgctgtgttaatgcagattaaatagcataaatttacttttatctctttttaaaaaaataaattttgaaaagcagattagtgaatggcagagctgtcacccttgataaagctgtttcacatctttggagagcttaaacatgatacactgaagtgtgttcactgtcccttatgagcattaagtggtttgtaagataaaagagagaaaccagaagtgagaaggtttctattacaaacttagtcatatcatataaagggatggcgtagattaaatccctactcccaccctttgccacctccccttcactccccagaacttcaactgtcctttatgacacacaactgagcaggagacatagaatcacatttttcacagggatttgaaatgtctttgtggtcatggtctggcagtaatagaagccatatgctgtgggtcaggaagaaagctatctcgaaacagaagaacccatctcctggcctaatgaccttgggaacgtttagtcatttcaaggcatttatcgttgaagcagcgtaggggtcgtttgggctatgttttcctccatgtgactccaagttgtgagggggagaagtgcatattatccataaagaagacagcatcagtgataagtaagtggctaatgtcagtagcaataaaattctcttccagggcacctgttagctgatttgttgtagattgatttgcatttccctttgtgattttgaactccttttagcttcttaatactttaaaacacaagtctgatggaatgagagatcgcatgaaagaatttgatttaagctgagtactttgtggacattggaaaagcagcttttgtcttaaattacattgcctttggaataccagcatgtaagacaaagaaacatgatctttgtaatggctgttggcccatctccagttgacacacacatgcaagttatatgggctgggtcacttgaggtttcccatttcccataaaataatgtttatcatggcatggtggggcttaaaattggttcctaagtaatttttgctccagtctcttatagttgtctctgagtatgtccccagaactgacagtgatttggaggcattgaccatttaacatgatactggtggacattgatcagatggccagtatttgggtaaaacttatatttggaagaggagaactgatttttggatattaggaaaaagagagccccctccccaacttcaccaacactgctgaattccgattataggtataagcaggaattttctaaaattttagattaggttttaccagaaattctcaatattctactgctgaatctttaaactaccagacaccttttgctctccattttctcaaattggaaaggggtgatgaaaatggtaaaatgtctcttccctcttcctttgttctcagggatgtttgttactcatccttctacttgcagctagtatataaaacatcttttagagtctccatgtcttttttttttttttcttttttgagatggagtttcactcttgttgcccaggctggagtgcagtggtactatctccgctcactgcaacctctgcctcccaggttcaagcaattctcctgcctcagcctcccaagtagctgggactacaggtgcctgccaccatggctggctaatttttgtatttttactagagacggggtttcgccatgttggccaggctggtcttgagctcctggcctctagtgatctgtccatctcagactcccaaagtgctgggattacaagcgtgagccatcacgcctggccagaatctccatcttaaactggcttcctgaaagagtaaattgatcaagcttaaaataattttctgctgttctttttttccagtagggacaaggtcttgccatgttgcccaggctggtcttgggctcttggactcaagcaatcctcccacctcagcctctcaaagtgctaggattacaggcctgagcccccatgcccagtctcctggtgttcttggagggttttcctctgtaggtacttgttcatttgtgtccagagagacttgggagactataatcaatactcttatcagccagaacaacatacattaaaactaaaagaaaaagaggaaggttgagttaaactggccctaaaaatattgatgttctctcattggaaaggttgacaggttctttcaaggaaaggtcatttcaggaacataagaagtctttttcactttactctttgctcttatctgaaagctcatcacagtgttctataatattttatcatgattctgataggtttcaggatgaaaaatggaatttggcttaaagagtgcagggctagtatgaggacactgcactctgaaataagtcagagtgatttgtcttcatcagatgttccataataatacttaacttttactgtatgacgtgaaacgagtgttattatttcaaaaaatgtatttgtaaatttcaggtcaaaactaagaataactctaagagtgtaaaaaataacatattttaatgttaaatttttttattgcttacactctaaatattttcctttgaccaatatgagaaatattcccattgatatctctgtgcatttaaacaattgtgaaaatagagaactcagttatagttaaatgactgatgttctataagataactttatcacatagataaaataatgaagaaaagaaattaaataggcattcctctgagagtttctctgacaatcaaatcagaggttttgattgaaaaattccctcattaatgtagattgagtgaatgaactaattactttgtaatttgttctaatagaaactttccactgaggtgaggggcaaggggaaaccccaccgtcttcactgtcatggaaaagataaagaagtaatggatctttgaaatatttcccctaactttcaaaaccttagcttacagtgttggagactacctgagattacctttcaagtagatgttttcaggaaaaaaaaaagaatatagaaaggcagcccttgccacatacaatgtatttgaatgacactacaatgcagcttttgtaggtgatcagatagaagtgtcttgctgttctattgtatttcagcttgaatatccttcatcaaggcagttactgcaaaacaatgttgtaaatgaaagttaaaatgacattattataagtaaacttgagttttcttttattacctgtcatttataaggtggtaatgcaccacgaaaggaattgcatattttgggtaataaagaaatattctatgaccttggtattacttatactaagattggttttaagacttttattttgggtactatagagtagagaccatgtcattccccctttcctaccccatttagacattaagacattcttagtgatttttttataagtacctgtcttcatccattttctgctgctgtataacagaataccaccaactaggtaacttacaaagaaaagaggttttttgtttgtttgtttgtttgtttattcacgagtctagaggctgggaagtccaaaattaaagggctgcatctggtgagtgccttcttgctgcatcatggcatgattgaaggcatcgcatggcgagaccgaccgttctctagagagaggaaatgtggcctaactcccttcttttataactgtcccacttctgcaataataaacccactctcatgataacagccttcatccattcaggagggtgctgccccctgacctaatcacctcttagaggtcccacctctcaagatcacaatggcaattaaatttcaacatgaattttggaggggacattcaaaccatagcagtaccttttttctgaagtctccccagagcagtaatctttagtcctgaatatttcactgaaacacttacatgtagaggtattttcttaaaattgagacctgtctttattaaaaattatttatagtgatactcttttctgttctgtttacagtatatctgaggaaatataaagtgtatgctattaggctttgtaatgtcttattattaaggcagatataatagctttaaagagaacactgatggatagctttttagactcaaagcagatatttgtgtgcgattaaagtagaaaatgataccctacaattgttgagacatttttgatgttctttggctttccacactgatctttttctatctctacagttagtttggttttggattaatgtttttcattcagatataggaaatcagtagcacttgaaatgccatccatagtacactgaagtcttcagtgaaacaacagagtccaatattcaatcagaaaagaaaatgaactctaggagtcatttccaggagacatgtctgaagtcaaacttgggctttatttcctgtcttcagagggtgcactttcatagttgttttctataaggttcaaatcccagagtgtatgtgccactctctctccatttataccataaacaaaaattcaggtctttatcatttcacaccctggctgtcaatgtggctgtctctccagcttctggtctgctagctccccttctaccatccccaactcttattccctggcttaatttttataaaacaactatctgatcatctcatttcatgttcattaactttttttttttttttttttgctgcctctaggatataatgtctaggctctttgtgttatgactggggctaggaaagaaagccattatctaactgaatggcctctgaaggaaatattagagcttttctataaatttatttttctcatccttctaaatctgcatgtttgtatatattttattatatatatatactttacccatacagtagtatatgcatataattgatgaataaaaatacatatcttgggatatgctcaaaatacattttactaagagaatgcatacatgtggcagttatagattattaatgtcactttatttttctcttcttacttttccactaggtgagcaaggcaggtaaattaaatctgtcctgttgatggactgaaaactaacctcaatacattctctcaaatatgctacaggagttttgatttgttcatgaatttatttttattttcctacaaaggcaactggtaaacactgcctcgcttttgtttacctcctttctttttgacttttctttctgagaacttttgttttcttgggcatatttcaaagagctactaactttatttcttacatttggcccaaactggcttctatttgcccactcttgttaactcctttgccatgagactgtacttttaatgtatactctttgtttgtacaagttcttttcttttcagtagttgtttctctttcagccttaacttatggccctatgttctgatgcttgcaacctgccaagtactttccaagccctacacccctgtggtcatctggtacaattggtactgccattagcaccacttccaccatcaccaagctgtcctgcctccattagttcactttgcctcttatgcttcttctctcacatagatatctcagtgcatatctgagactatcctggccttccacctcatggttcactcacactgattatgagtttttcttgttctaggagctaaaaatatctctcctgccatggcctgagggtctcaacattccatattctcttcatagtaagataattttttttcccccaaaatcccagtagtctgggtggcaaagtactggttcaaaaaagttgatagtcccagcactttgggaggctgaggagggtggatcacttgaggttaggagttcgagaccagcctggctaacatgatgaaacctcatctctactaaaagtacaaaaaaaattagccaggcttggtggcagatgcctataatcccagctactcgggaggctgagacgggagaatcgcttgaacccaggagatggatgttgcggtgagccaagatggcgccactgcactccagccttggtgacagagcaagactccatctcaaaaaaataaaaaataaaaataaaaacgctgatagaagggcatctcttcataacactaactgtcccctgactacctcaacctaaatactccttcttgttttctttttcctactttagtataaactcagatactttaagacaaaaggggtacttctttctctcaaaaagaaaggcataaacatagtgtcctaggcaaactggtccttatgcttactataaatcaatccaagacaactaactatcaaaaggaacagtagaatattctttctggaattttaacagaagaagaagagccttccctgtggattttctgagtgatatatggattcaagctctttacattctggccctgtctgccttcttaaacgtatctcccttcttctttttctaatattcctgtcacattgagctattctctatttcttagacacagtctacctctctgcctttgtccatggccttaaatgccttcccagccacaatctagctgttgaaatctcatccatccttgaatatctagctcatgtaatggtaatggccatagaacagcttctactaaccacccccagcaaaagcaacctctttctctctcatgtgatgccttatgacatttatttcataatcttgtcacatcctcactttatgatttctcgtatgtaatttaaaaaattacataatatctaacctgctagtttgtaagttctttgaggacaggttctatgtcaaattcatctttgtatattcctgacagcctagttacaatgatattaatatattggagtcacagttgtatttctagagaggattatatggctgaacaaaatgtttcacaatgatatgttcttctgatggaattttttaacctaagattactgagaatttcttggtcagcaaaaagacaggagtatatcattctgacactcttttgaggcacatgtttattcaatgtccaccctctcacaagcagatatttaataattaaaaaaagaaaatctgcagcttgattatatgcttagccaagaaattcttttgcagttctaaggaaaatctccagcaaacccaattactctcccagcaatgcacttcaaaggagagcagaatgcatttcttgtacagaattcctggatatgtttgatcattagttagggcaagtagtttgacttgaggctatttactcagcaggaataaaaagtacagcattgcttcaaccaagaggagtgccccataccttccccaagcagaatttaataatttgatctgtcagaggaggtacagaggttggctatagaaatgagtcacgaccagtcagatttggctgacttgtgggccattaaaaatgttccttcccccaaacggcattttttaggaataataataacagaaacagttggcaccatgtaattgaccaagaacctgagaatttcacagcagtacttatcactgaaacagtttttgtttttttgagtctaagccaaatccacacttgagtatttttttaatttatccaggtgttctatggctaatatttatttcatctagcaagtgccacaaagtatttttgatgtagtcaaaaaaagtatttctgatgtagtttaaaaaagtatttttggtgtagtcaagaatataacatgatattattagactcctaattacaaatatttggtagagactatcagtttaagaaaaaattgcattaaaatgtcaacttttttctttttttgagacggagtctcgcactgcacactgtcacctgggctggagtgcagtgacgatctcggctcactgcaacctccacctcctgcattcaagtgattctcatgcctcagcctcctgagtagctggagttacaggcgcacgccaccatgcctggctaattttttgtatttttagtaaagatggggtttcaccatgttggtcaggctggaagttttttcgaaaactaaatatatatttcattatataaggtagactttacactttttgggaggaaaatgcacatcaccttttaattttttttttgagacggagtctccctctctcacccaggctggagtacagtggcacgatctcagctcaatgcaagctctgcctcccgggttcacgccactctcctgcctcagcctcctgagtagctgggaccacaggcgcccgccaccacgcctggctaattttttatatttttagtagagacagggttttgccgtgttagccaggatggtcttgatctcctgaccttgtgatccgcctgtctcggcctcccaaagtgctgggattacaggcgtgagccaccgcatccggccttaatatgtaatttttaagcactttaggttttaattaaattttatttcagttataaaaatgttcattaccatttggcatattcctcagctaaaataattaacaataattaaaattacccatgcttgattttcttatttcaatttttataaaagttatgccttcagtttatagaaaataaagaaacttatgtacacatcgatgctttagacaatatctatttttcaccatgaatatcactgaaagaaacaagtatcttttcatctttagacaaaagaaaaaaaagtactagtgtatcttttattattggttactttaaaaaaagagtaaaactacttctgtaacattaatttttaaaagttaattctcatattctaatgggagtgtaatgagtttttctcacagtgaactctaatgagtttaggaacgtgctgccatatttatggtagagactatgcaaattggactgatgtttatttatgcatttatttcatttgggaatctagttttcgaccttaagtttgctggagaatttgttacaggaaagaaagtgtatgaagaagtcttcttgtcccaggtgtggaattaaggtaaaattaacaaggaattgaagttatctttgatcatgatttttgattccatttttattcactttgaggaagtgttgcctgttttttttttttttttttttgatgttcagcagagcagtacaatgcaacacacagaagcataatgttgaattttcataataatgtttgtgatgcaaatgaggcacacttcaaaaagtagaatgattagcatttcttggtaagatgacagtccccccttttaaaaaaaaattgttcattagttttatcaatagattacatatccagatttcaattttgagtgcatactttttgcttataattataatgtgaatttaaatagttttagattgtgcatttaaaacaattcttctgtcactgtattatactctgaattaatgagctgtttgccacctcagagccctttgctttgaaattcagtccagtttaaagtgaactccaaccatttcaggccagcagctcacagaaggttgcaggattaatgagctccaggggctctgtggcttccttagaagcatttatcactaaattctattcttagggaatatcatccttatgcaagaagatggggagctgaatgtggaaaaatgctattcaaacaaataatttgataattgccaatgaagagtgttctttcttctcactacagatgaaatacaagagatgcagctaagaccagagcttttagtttctctaactggagtgaaattaaaattgatggatattttgataagattactaatgtaggtgaaacaatgcttccctatagcttgttctacaacactgtactcattcacttactggacttcctagggcttacttaaagaacttgtacacatccactgtcaaatatacttctgcatacatatactcttggatatcatagcctatttataaaactgtatctgtctccctagttatcctgtaggaatagctagtgttttctctccttttagatcttctcaaggcatcctctgagtttataaaacagagagtaatatgggtgagaaagttggcccttgctctttttttttctttgagtatgctgtttttatttaattctcacaatatctggagatagtaatttttaacataatgaaacagatttagagcaagtgcatgacaagtaaaaagcagggccggaatttgaatccacattcatttgactctaagcctgtactgtctgatatagcaagcacctgtagttattgaccacttgaaatgtggtgattgctgcttgttaaaatcataataatttcgatatattcatgcaaataaatatattactaaaattctacctagagaggcatttcctgggagctgacaatcccctttttaaaataatgattattaattttatgagtagattatataatcggattttcatcttgaaggcaaactgtttacctcttgggagagtttgtgtacctgaggttgtgccgtctaattagggcagcctgggccaaggatggtaaattcatggcaatcacatggatactccacatcctccggcagacatcacttatcggtcgtggcatttttctcacaggaacagcattctgtctcactgagacacagccttggaattcttctcagtactgttcattgatccaggcagcccccacctcttgactggagttggcaagtgagataaacatgttagctgactctcttctggtcagggctctttggcacagttaggtgctctgaccttttgaatagacctgcaaaatgcaagcctatcttcagctttcaattagatgttaggatatgaaaacatgggcatctttaaattgatgaaatattcagccacttcaggtctgtttcttcccagctaatcatgcttgtcatctacattttattccaccaactttattcaggttttacccctcacctcatgattgctttattgctagaatgtgaaaatatcttctatgcctaaattgatatccttgaattaaaggtgtgttgatgttgcgactctaacttcggtgtgctggggctgtcttgcagcagtagggagtgaagtctaggcctaccaagcattacgtgatgtccttcctcaagccctctctcagccaggcacagtggctcatgcctgtaatcctagcactttgggaggccgagacaggtgatcacttgaggtcaggagttcaaaaccagcctggccaacacggtgaaaccccgtctctactaaaaatacaaaaaattagccgagtgtggtggagggcgcctgtaatcccagccactcgggaggctaaggcaggagaatcgcttgaacctgggaggtggaggttgcagtgaactgagattgcgccagtgcactccaacctgggtggcagggcaagactttgtctcaaaataaatacatagataagtagtaactctcacatctaaagagcaagagcagactgtagcagataaatgtcccaataaaaataggctcctaacccttactctggcatttgtgtttcatcgtagcaaatttggatgcaagaaagctattgaaactgaatcttctcctacacctgaagagatctattacttcaatcactccaccgaaaaatctaccaaagattaagtatgtttctctattgtattcctgcaggttaggattgttacagatcacaatgacttaatgaaatctcaatacttgtggccaaaataacgtaggatggagagccatagtttaaaagtttgaaagctttgggggtcatctaggacactgaaattctgcttgcaacttgtttagctggaaaacaaaaagcatgaagataagactggaagatgaacatctcataccatcaatatatgggtgattagaagctctacaacaattctaaaacccagcctaataaagtatgaaacattctgaggaatgttcataaagatatgcaaatggactttgaaatggaaaaaatgcaaatcagttgaggtggcacaggcctaatttacccattctctctcagggaatatcagagcttcacacatttaacaggaaatgtacacatgctgacttccttcaggtgaaaaaaagattccacctgcaactagtattaaatatttgagatttgtttgccactgttgtatcacagatgcttcaactagagtgtttaattttcacacatataccatttaggagctgtttagtcctctccctaatgaaagagagatgggaaatccaggacaccccacacttactggtaggtttccaaatgttccgctcttagatgccactggtacctctaaataattcaaaatatcgaagagctgactccacacagcagaatgtgttttcttagttggaattaggtctataatcagacagagatgtcttattagtcagaatggaagacaacggactggtaaatattataatttgaaaatgttgatataaaagaagcctcaacataggaaaaggtgacatgaatgtcaatggcaattataatatataaaaaagataatagtgttttagagagtgatgaatagctgtgggaggaagagttgaggccagattttgcaacttctaattttttttttaaacctagcattgacagtacagtcctgaattgttgtgttgtgataggacataccttttgctattaaaaaataaggcctcatattattattaattttttttggccttctgcctaggaaaagaagtatgtctttggaaataaaaatacacaaagtaagttgtcattgagggaaagagttaaaaagaatcacttaccttttatgaattattttttaagactacacaggtgagttttttggttttggaaattcttgaacattttgatttcattcttcctggagagccaccgatactggaggctggacaccacataacaaattaaccgtcctctttcatttgtaacctccagggagataagatcagtttagttgctaatgaattttggtccccagcacagaacaattacaatggaatatgaggacggtttcaagagcatcaggaagattttaccaaattctatttaatctcctctcaccctgtttacaggtcagcttattaaagttgaaaattcctggtagatggtttccatggagagagaaaattatctctttagataaactattctagggttaatttgattcaaccaacatttatttagagtttcacatgtgaaacacaatactgtcttaggagctacagggatactaagatgaacgtggaaaaaaatgattgcccttaattaagttggcatgaagttcatgtacacaaagatgtacacggatctaggataaaatgtggcaagtactatcatgtaagtataaataaataaaaaattgtactcttcatacaaagtcttgtttgcccctcataacaaccctatttgaagagataattattcccatttcacagaaaacaaaacagtgtcataaagcagcacatctggtaagtaaagccaggacttgagcccacgctgtataccagccatcccacagagctttcttgatgctagggagaagccagtaataaagcatttcatagagaaggtggcatggtaatggaccttgaaagacaggtgtcatctcaaaaggtggccagaggggacatgtcagagagtcatgcatgaaagaggaaatttaagctttaaggacaggacagatgagacttccaaggggagagcagagattgggaagagcatctgaaagtgagccctctggaacactccatgagggatgggagcaggcgggaggaggaagcgcaggagccagctaaggagacagggaaagagcagtctggccgatgtgagatcatcttggacagcgaggtggccaagaaaccaaggtacaacagtgcagaaaatcaaagaggcccccacagtagtccgtttcagagagaaagatacacagagctaaaaggaccccaagagtcttcttgatctgggggtcactggtgactatagaaagaatagttttattagagtgatgataagccatagatcatgggaaaaattgcagtgggcaaaggatgaagtaaaaggggaagagggtgacatgaaagttgatcactgtttcaagaagtttagtagtggaggaaagagggaatagtggtattagttttgcacactcacaagcccaggtaggatcctcattttggagagcctctggtaacatctgataagcgagcaggccccttaggtggctctgtgacagagcttttgttctgaggatgccagcatgaggccacactttagtatcaagtcacaggacccctgcacctttgtgtgtcagcctgacctggggcataggactagagggcaatgggaaatcatacttgtccagttggaagcaaattttttgcagaaatttgctttcatggcttaacattcataatgccttaggttgggaaaccacccatgcccatttatgggccatggttaattctgttttattctgttcaacaaacttatccctaggtactctgtgtgaagccccactgtggctcggagtctacagcatgtttcaaagacgttgctgtcctcaagaaacataatctctttggggaagcaagaagcaaaagtagccctttactgtagtctgatgaatgttgccgtgtaggaatgggtgaagggcctggtcatagaaggacttacatatcacgcttggcactcagatcttactctgtagataatggggaaattctatagtgttttaataggaagcagcttcactgttttcatttattctcactgaggtgtgaacagtgtgtgtgtgtgtgtctgtgtgtgtgtgtgtgtgtgtgtgtgtataaatggggatagagaagcaagtttgtgacatataaagcaacagtctagataagaaaccttgaccttaattaggccagaggaagtgggtttggagagggcaggtgacacttgcttttgttagtgactgaattcactaacaaaaggggtgcggaagagttaggttgcataggtgcttcctgggttttttctggttgactggaaatgctttcatggcccgtcttcctgtctaaattaagatgttcatagatgttttaaaaatagggtggagtctggaggtagaagacaaagctgtataaagtcaaagtagggagaaaaaaaatgaagaaaggcaataaagagaaatagagacagccagtaattatttgctgtcacaacccattcttaggtcacctttcggtttcagttttccagcaatacttttctttttttctcctcttttcattattaaatgccttaagaaatgagtatgctgcatcgatagagttatgatggcttacatgagaagagcttctgagaagtgagttcctggaagcactgtggtggtggccaagtatttgcttataagattttatttgacatctataaggagaaatatacacaaacttttttgttttgttttgttttgttttgttttggtgctggaagtgggaaaagtaacaagaatttaatgagtaataaggaaatgtaagaggaaccattaaacataactatagttacatggaccctacttactccaagtgtattttagttagatttgggtgtattttgtgtctgttaaggcaggtgggcagtttgttcatttggctggaatcctggggcaattaggtcagcattaggggcttagtatttctgcaggccatttagttttaacctgctccatgaccccaggacactttctacctcatcattaccctgatttttgtccgtgagttcagggaggcaccaatcagagaatgtcgatagctttctagcacatccatcttcaccaggagaaagctgtggtcagataagtaggattcccctttacataaaaagaacagcctgttccatcgttagaaaaattagaaactgcggtgagaagtgcaataattagtgactactgaatgcttgttcttgaatttgctttataaaaaatgggatctgggagccttgttaattatatagctttgtaagaatagtttttctataactgtattagtatacttaatcaatgactcatagaatactggtaactaatagacctggacttaacgcctggaatgtcctactaagcatggtttggtgagctgtctactttgattctaggatagtttatgtttaattatgccacaacttgggcttatgctatgtcttgatgtaatgcaaataaaatagattatattttacactacaaagttcattaaaaaacaaaaacaaaatccttaagcttgtcactcaaaagtaaacatctgtatccaatgcaggaaagaatgcaggtttcgtggggactaaaacaacactaaggtgagctctctttaagaaaaagacaaatgggccgggcacgatggctcacgcctataatcctagcactttgggaggccgaggcgggtggatcacaaggccaggagatcgagaccatcctggctaacacggtgaaaccccatctctactaaaattacagaaaattagccgggtgtggtggtggacgcctgtagtcccagctactcgggaggctgaggcaggagaatggcgtgaacccggcagacggagcttgcagtgagccgagatcgcaccactgcactccagcctgggcgacagaatgagactccgtctcaaaaaaaaagacaaatgtacaatataaaattaagtataaagtggttatttaaattcagtctttcctgtaaggtgatggaattttcaaaaagtattaatagttgagaaaggtttttctccattttataactctcgattgataataacgtgtacatttttagaattgtggttaaacttgggaagacttctttaggcttctttcccgatgaactgcaagattttacagcatctcaaaatttctggtgcagggactaatcttaaatactttggaactggctgtcttcattaactagcttgttaccatagatttctcacatttgctaattaaaaaaatatgaccatatgaacacattgccaggaccccatccaagtccttaaaagggacctggcgggggaaggtccctgaagcttaagctccattgtttcatggtaaatttatctctgatctgacagcatcataattttccactgaatctgtccaaacagtattatactcaatagtccaacaaaacaacataacctttcatacttaatacaataagtcaattggggaagaattcagaattttagtgatcctaccaagttttttttttttttttttttttttttttttaataaggcacagctcaattcttatctcttggtttgactggcatacaatggcttattgtaagactattacgttaatatctttgtatcttttacaagctttaatttacccctgatagcatgaaacgagactaaattctcatataagaacatgaaaacatttttaaagatgttatctcttatggtatgtcttatagtccactgactagattagttgtaggcatctaaaataacaagtaatctcaacagatagtatatagttaaatagaaatatcgtatttctaagcaattaccttgtaaagagaacccttaacattttaaaatgttgttatttctaagcctaaaataaaatgcagcttgttatttaaaagatttcagaagagatataaagatcccattgcactttacatggctttgtgttaaatttatcaagatccattatattacatgaaacatacttagtttcattaaagatgcttgagcctctctcttttttatgcttcctgccccctctatgtacacaaattcagcaacctaatcatgttgcctttgatcaaattttatttgtatttttccccagtaatgctgtctggtggcagttaaatagaatttaattaaaataaatattcacatgctttaatagagattaatgatctgatttgacttagtaaaatttggcaaaaagtctagacgctgtaagatatacctatattacttgacttggataaaggtttaataaaacacagccagcattcaaaaaaagggagaaatggggaaatccagttataaaagctatctgagcatttagctagaactatgcatacacaaacacgccctattgaatttgtgtccacaataaaaattgggctgtttcttgtttttctattttattacaaccataaaatgaaagtgtgaataacaaggcaatccacttgttaagtggcaatttggattgacaagctattttcccaaatttaatttctggatctgtacttctcagcctttaatgtgaacatgaataacccaggggtggtgtgaaaatacagattcagattcagcaggttttggacaaagcccaagatactgtgttctaacaagatcccaggtagtgtccatgctgctggtgtgaggactgcaccttgagcagcaaggtcctagacagtgaagtgaagagactagatttgggatggttgccgccaccatcatcaccacaattgtatggataataatatgtaaatgaccccacctctcaaatatacagtcctttcacatatttccatcatctcattttggtcttcacaatatataatgtcacatgcgtatctcagcctgagtgccactgcttgtaaagccaattaattacataagaatattaaatttcagagtcttaacccatatagtccagcataaacaaagcatagctaggtttatctttccaaagggtattctccaaatcttgttattttctcactcaagattcatccagtggaatatctcctctgctccccaatcccataaaccgttatccctattctctctctgttctccaaggctgatcatctcactgtcctccacacagattagttttatttatgaatccaaattctgcacatgcagttgcctgaccaagaatgctcccacttatatctcctgctcttcatgaaatctggtaaactacttcctgcacacacaggcgttgaggggcctggccccttatcatctgacagacctgaacaaggtgaagacactctagagctgttggaattgttctcatgtatgctgggagatattttttagcttccttatgtgctgcattttaaaacaccctaacatttgtgcccattaactcccaagccctgtttcttttagataatgtatcaagcaaatttctatagttgaagttctgaagtgtgacaagggagccctgccttagcacacatgtccagatgttgacactacaagttataagcagccttcatttacaaaattcagacttaaaagccacgaagtgaataggtaattaatgcggaaagtggcaagatttgatttaaacagaaggagccattagacaattaaatactaatttaaaggaattctcacattaagttcaataaaattaaacattaataatgaacaattaatacctttgtggagttatttagtcaatagggaactgtgctttttttgtttgttttgttttgttttgttttgtttgagacaaagtctcactcttgtcgcccaggctggagtacagtggtgcgatctcggctctctgcaacctccgcctcccgggttcaagcgattctcctgcctcagcctcccgagtagctgggattacaggcgcctgccaccacgcatggctaatttttgtatttttagtagagactgggtttcaccatgttggccaggctggtctcatactcctgatctcaggtgatccgcctgcctccgccctccaaagtgctgggattacaggcgtgagccacagtgcctggccgaggaatgttttatataatagtcccacttgtaggatatttgttagaaagagagtcacatgatacatttttatcactcttatctgctacttagagatttggcacctatagcaaggtgataaatacgccccaagggtgcaactggaaaatgtggttaacccgatgcaggagtctgagtggaactctgaacaggatgagacaagccggcagtgacctgttgagcccttggaccccagaatttctcgggttattgtttctccgaacagccactcagaagagattctttgagttgatgcaaaaatctcaaaacttactgtgtgactttgtggtagaaaagaaaaaatgcaatttggatccagattacaaacttgattgtgaaaaacaaaaacaaaaacagatagtccttatgattttggaatgatacagttaagggtggtgtaggagatcaaataaattatcctttaacatccagactataagattttgacttctacctacccaaagcacttgggtcagtatacgttttagtgcactgatgcatccacttgcccgtgtgaatgcattaaggacaggatatcgtattcttctaagcaaaaagattgcagcatactctacgcacagcactgggtagaaatcccactattccacttcgtagcaatgcgactttaaacatgttttcaaacctgtgtgagccttagttcatctgtctgtaaaatggtgataatagtagtactcacctcaaaggttgttgtaaggattacatgagtaaagtgaaagttttgatttaggggaaaagaggcagaacatgaagtactaatttaaagaaatattcaggtaaagcctatgagattaagtagtcacgaatggttaatacttccatgcagtgccatctaatagggcttcactatgatgatgcaaaggcatgagaatgatataatggactctggggactcaaggggaaggttgggaggggggtgagcggtaaaagactacatattaggtgtagtatatcctgcttaggtgatggctgtggtgcactaaaatctcagaaattaccactaaagaacctatccgtgtaaccaaaaccacctgtaccccaaaaactattgaaattaaataaataaataaatagggttcactgccaagcaaatagaaagcattctataaatgttaattatagaaagtgttctatttaagtgttaattattataataatcatgattgctggtgtggaattaagaaaaaggcaagggctgcatctttagaaatgctttaattcatgtaaagtgcttaaaacagtgcctgtgtgcatgtgtgcttcataaatgctagtcgttgttattataagagttactatgatcatgctagtgctcatccttacctgacttctggagtacccatcatattcaatattccaaaagataaacacaatactatttgttggatatttatcttttaaggcaactattaaaccattggaatggtgattttctgagagattcttcttttttaaaccattgacaactttattctgctattgagattttttttcagagccaacatttctttcatttataattctactttggaaatgcaaatgttatccatttttccaatgcatagtttcaacttactagttagctctgtaaatatcatttatgagactgacccatgttagatctttgctatggtctgtggtttgcaataattgtcattctcagttcccttaagtactaaataggagaaaagacagtagaatgttaaatcaggacaggggtctttggaggtcactctgtccagcatcctgattttttagataaggagacatgacttgtccagtgtcacctagcagctcagaggcaaatccaggacaacattcttaaaggtcatacattgaccctctgttaaataagtgaacacataagtatatccattaatttcagattgttttaagaataaaaatcaaagttatataaggttcctgaataaatctcatagcaggagggagaccatgtgataaaaccttcaaaaaaatggaatatattgtctggttgcttcctgaattgtacaggttactatttcatttctgaatatggcctcaaataaattgaaaagtacatcccttaaatccttgtcaagtgcaaggtctgtgtcataaatgctttcaatattgagggggaacaggacaaaaatttaaggaaaagaatttatgcaaaagattgaatcaatgctttttttggataagcaaagcaatctgtgtgataattctactttcctcctcccctttgtgaagctgggtgggggtgggaggattagcaagaagggaggggcctaatttatggcgagagtgagaactcttttcaagcctgtgggcagaaaacaccgctgcacctccctcccggctggaacctgctctctgtgatctgggactcctccgggtctctgtttgcctaattgcaacttgtgcttatgccctccagttctcactggcccctttgatgcttttcagcaagtcctctgaaagcagcaggacaaaatgggaaggtaagcaatcctttcacataaaagagggcagcaaaacccaggtggaggtccctgctgagatgctcccttccaaggctgtgaccacacagcctaagcaaacactgtgactagtgccagcaaatgaaatttacagccctcttaacctgcaagccacagccagcatctcactccactctccaaaataaattcaacgtggctattttagaaaacatacttatcccaggttttccttttgggcatctaaggactgaattagatggtctccatctctaactacatccccattctggagactttaaaaaaaaaaaattgctttgtttatttatgtgttcatctcatgtttatcagttcagcagttcacagtttttattctgttatataacaaaggagcctaacaaaggatcacaataggaaaaataatttaccccacatggttacaatgaagagaatttaattaaaggaattgttacaaagtgtgggcagcattgagggaactgacacaagatgttgagccactcaaagactagcaactggtggaagccgttactacccacttaggcctacctaaatgggcaatgggaagataatgttaatggagcccagtgagctctagagcctcggaggaagggcatcctgcagagatgttgttctcagtcttgtctactcattggaatatcagggaaacatactaacagctgggttccacgtcctagagattttgacgtaatgacttttttttgtggtcatcaagacacagtcatagaaagacacagtcactgactaagagacagtggcaaagctaggaacaaacaggaaagaaataccctgaccttcctctcctactctctgatatcctgctgatgcctccaattagaagccagactatgagggagctgggggaatgcactctgcatggatcaacctcctgtagtctatgtagtggggaaaatgggtgaataaccagcacagagctcacaataaaccccacaaacagcctctgtccctcccacacacaaccccaggaattagaaggaagggcagactggcactttctcattaaggtaactcactcatgccatcttggcattgagctgggcacttttaggtggaatgacctcccgaagggctaaccccatctggcacctcttgacaacgttccttcttaatatcagtggctctcctgctgctggccaagcaggaccccaaggtccactgggatgtacatacttatggtattatgctctgcaatacttgtgggggctgtggaatgcacacttccaaagtgaaataggacattggaggttttatatataaatatatatatatatatttatatatatatttatatatatatatttatatatatttatatatatttatatatatatttatatatatataaatatatataaatatataaatatatataaatatatatttatacataaatatataaatatataatatatataaatatatattatacataaatatataaatatatataaatatatataaatatatatttatacataaatatataaatatatatatatataaatatatataaatatatatttatatattaatatatataaatatattactatgtatatttatatatatttatataaatatatataaatatatgtaaatatatatataaaaatatatattaatatataaaaatatatatataaatatatataaatatatatataaatatatataaatatatatatataaatatatataaatatatatataaatatatataaatatatatataaatatatataaatatatatatataaatatatataaatatatatataaatatatataaatatatatataaatataaatatatataaatatataaaaatatatatataaatataaatatatataaatatatatgtataaatatatatataaatataaatatatataaatatatatatataaatatatatataaatatatatatataaatatatatataaatatatataaatatatatataaatatatataaatatatatatatatatttttttttaatagagaggatgaagaccaaagcagtgagttccacctaagctggcccttgccttttgtctaacaggaaacccagtccttcctaatgggcacagaattttcagagaagagagcagaagttgagttggcatacctactgtagtgagggattttgaacaatgagctgtacattcctatatgggagccaaacttttagttaaatagtaatacaaaaatgctgatgtggatgccacggcttcctcctttcacacagaagatgggcagtgactacacatttaggttcaccttgcatgaagccacgctatagtttctaataaggtattattagtattcactagccattctccaagggttggcttcaaatgagatcagtaaagcagaagcaaatcacccacgggttctttcacagtttctttcaccctaagcctctcatttcactagacaactgtaggaagaaaaacgagatccctgaagggcagcaacttttcataaactgcacttgcagttttgccaatgcacatatctgtgggctcattgcacaggcagcgcttatatctatgggcacatttcacattgtagatttcttgtcctttctgattttctccccgatcacactgatacaggccacttccagtgcctctgtaaagctccaaggggtaaaggagggcaggggtgaggagtaaaggaacgattcttacaggtgttgtgaacacgactattttatatcaaatgcttctaattgaatagtttaacttaaaaacatgtatcacaaatacagtttgaccaactgtaacaatatcaaagcatattgaacaggaagtgaaagtctttgggtgtggatagagatttccagaaaaatatagttacataaatgtgagtttccaaattgtaaagaagaaaaaagacatatctggcttaatatatataacattaatatcatgcatagagattctattaataacatttgtcagccactattgctaagagctttacatccattttatcctcacatcaatactattaaagaggaactattattatcttcatacgatagatgaaaaaacaaaggctgtaagagtttaagaaacttgtccaaaatcatgtagctagaaagcggccaagccaggattcagaccttggttaacccacttacaaactctaaactcacttctccattgttaaacttgactagtgcattggcttacaatgaagtttgccatattcttccctcaaatctgtatttttaataagttgctaggtgatttttatggtcaggagaagtggggccatactacatgatgtaggctatttcctgagtatagataatttctttcttttcccttaggtgtccattttctaaaatgtggatgagaacactctctatgtgtcctgcaaaatttaaaaagtttccattttaaaatatgttttataaatactaaataacatgtccttttcttgctgcctaagacatgattattggtatgaaaatgctatgagaagtcctatagtaaagacatttttgtccagagaatctgacttttgtctttctccagagaaagcaacctgacttttgtcttttaccaaataatatctgtttgtgtatccttcagttgtgccctttggagagggctatttctccatgtaacttcatgcagttacaagtcctatgatagctttatatggatttataaatcagtaaatttttttatactgtaaaactttaattttaagatttcaatgtttttattcattttgaacatatagggtaataatatcttctgaagccaggcaaatctactattaaattttgctttctataaaaacatagttgttagataactaatactgtgcgaacaaatttcttttccctatagagaaatagtgagtgttgaaccgacggaccttgtctttagaataaaaagacttataaacacttgtaggccagctccatgagaatatgccagctggaggaattttagtgcttctaaagataactgagaaagcagtggctctgaaggttacctttttctgctaatggatgtttagatctaaaatcccagtttgctttaaaaaaaacagtagtatgttaagaaggtttctagacctgtgctatcagtgtcaatgtaagtcttataagttccctatgagaatgttaaatcacaagggcttagggtatataggagttaagtgatgctttcagttgatgttgaatttcatggtgactccagagtcacataatataggagcttccaagcttgacaaattgctcatatatacgtaggcagaagtggctgatcactacagtgctggtcctgggcctgtttggtttgtgtccattcttgtctttcccctactatgctgtatcacaggggaacatacctcccacaggctgcatttcccagcctcccatgtctgactgctaacagttgggtcaatggtaggcattgtcaggagattagagggcagaagaaaggagaagccagggaatttctgccttggcaacgtctctgcctccatgatgctatctcctgccagagaagcctaccaaggttccagcttactccatgtaaccctggtccctgtgctctggtgatgctacctcttctgtgtgccctttgtggtttcctgcctttggtaatccctaggttgactcactgctacttatttggcttttttttttctctcctattacctataaaccaacaccctgtgttaaattcccttaagttactcattggtttgtgttctcctggttgaaccctgattaatgaaatttccatttaaataccaaacgtttcctggagttcgttattctagtggaataacaaacaaccagctccatgaattgatggcttttcagaatttattgtctccacaatatttgtttcaaatcctcttttaataatcactattttaaaacttaattactactactattgataataataaatgtacccttaaatgtattatataccagatttggatttgcatctgtgtgtcatatgctcttagttcaactctttctttattgctcacctgaaataaagcttcttttgccagttctatttaattaaagattatcctgtgatgagaatgcaagcctaggttctgccttgatttatatggcactgctttttcttcaaacactaagtgatttgtagcaagttctcaaaaagatgtgcttgcaactttcattttctaaggaactggaaggcagccataattttctctttgaaagttccacctctgttagagtatgtatagaggtcaagttccaaaaatagcttcataatgtctgactcccctttaatgcagtttgattaatctttgtgtaggattcctggcaaatgataggcacaaaatgactatatatgaaatgaataaatgaatgaacaaataagtgaatatagcaactgtctctccatagttatgcatacaattagctattttttgactcaaaattaaccaggaaaaacttaagttatccttccacaaggtgaacttaactggatgtgtcttggtttgaaataccagcaaccagctgcatactgtaggagctatcagagcaaaactcaggtgttgacactaaagattaatgaaccacctttagttaattgatcacatccaaagtgcactcccttcagccttttgtctgtcagttggcagagggtccagcaggtagacacactccattgctcactgaaattaaaatttaggtaatttaaccttctcaatgctatagatgatgatttttttaagttgcagtggaaacaacagagcaatttctgggtgagtaggtcttcttggtgattcataatttagtagatgacatgttcaaatttattaagttggcctgagcataaaattgtccaggagaacaacagttaatctacaatgctgcagaggtatctttcaggaacaatacaatccccactactattacatattgggctttttaattttaggcttgcaggtaaagagtgagcttttcagtgtttgcttttcaatgatatacacgtgcaggagtaacaattctagtttttgaatgtgggtaggaaggcatgcctgagtgtttatccggggagtaagcaattttgtacatagaatgtaagttggataaatatgcatttgctttaggttaaggtgttaatgcaaccttgtcaagaagaataaatctgaaaagtggttaaatcaaagctatttgattttaaagaataaaagtaccatctttcaaacgatattatctttgtctaacagtaattttcccccctgcctgtaatttcagagctctgtgatgtggaagctgtcaatgttacgtaactgagagcaatctgacttctgtcattgtgtgcattcctcaaggatcgtgtttaggtggccctacttgatgcttttctaaaaagccccattctacttctaagtaaatactgagttcctggagaaacctgatgaaagaaggcataattttgatagctgctttgtaaatagtaggaataagtatgtggcattattttctttgagggagaagaaactttttatttgggtgcgattcatatgagaacatacttactgtagattttgaaccttgatactggcagtgtggattggcctgtaaattgatgcttttgtttctggctgaggaactgcaaatatgccaggtgacattctctttgaagtgtaaatgttgtttcagttgaattttttttctagtacacttggaaagtgagtttcatgcctatgaaagagtctggattctaataaacattattcctagacacaggaaagttgctataagcgatgggattttgaattctacatggattcctgtttaacaggtgacttcacaccttaaccttgaccagccttctatctacatctgccatgttgatttcttttgtatattcatttcttgttacttccagcggtaattacatttctaggatatattggtgtattttggttgtctccaagtccccttggattctgaggccaccattgtcctttctagacaaatggaatggcttaagcctccacacagtgcactttgggaggtcctggattgtacttgacatttccaaggtgtctaaaaagtctgatattgtggtgtcacctctttctccaaattcctgctcccagtttcatctttaatgaccgatggtcactttctgccctatcttgcaccatctgcctttaagacacccctaaggcttatacctcaatcacaactgatttttcctcaaagttcagtgaaggagagggcaatagagtgaagaatttgttgctgtcatccaaatataaaacaggaaacacattatattttaatataaaagcattattcctagaaacatattagccattctctgccaaaaggacattatcactgaccttatactttattaggcccccaaacccaaccatcttgagagggttccatctctctcccatatctttttcttttttctttctttctttttttttttaagagacaagttctctctttattgcccaggctggaatacagtggtgcaatcatggttcactgcagccttgaactccttggttcaagggatcctcctgcctcagccttttgagtagctgggactgcaggtgtgtgccaccacacctggctaatgtttcttattttttgtggagacagaatctcaaactctggagctcaaatgattctctcaccttggcctcccaaagtgctgggattacagacatgagccaccatgcctggcctcccatgtctcctgttccagattctagttccatactattggccactacaataagaaaatccttgttattttattaagcagatgacttgagctttcaaattctattccagcctagagtctagggcccaactttgcatactggactagaatcattaaggtgttttcccttttcccaaatgcaaatgtctttactttcacaaatggatcctcagtaccatcagaaaatttgaaattgctgtgttttcctttcaacatattacagatcacattctgatagctcctcctcaactcaataaagtaaacatcatggttacaggcagtgtgtgggtggtattggtatgtcgaaagtgggtgcagaatgagactgtatgtattgccatattgaactggagaagcaaaatatgttaaagcacctggatatctttctttgcatatctctcctgtggttcttggtcaaggactatcgttgatacaggaccagctatgtaagccggagggcacagtgcaaaattaaaatgtggggcccttgttcacaaattatcaggaactccaaaagatcacaacagagcactaaaaggtcacaacagagcaccaaaccttgagtggccctttctaagcacaggtcctgtgcaatagcacaggtcacatacccgtgaagccagtcctgtgttgatggttgttgttgagtgagattttaatacatgtatatttatagtctgagatgcatttgactgccacctttggagaaaatatgtgctagagtagaaaaaataatttgaatggcagtaacaaaagattggttgccttgagaagaacattcttttgtatccgttagagtttcatcagagaaacagaaacttctctagagtttaagttggaaggggttttatatatcaatgaagtatttctaaaactgttggaagtgttagaggatcaaagctcaaggaaagccgtcattagctttcagagaccctggaaagtgtaggaaacccacaaaatcattagtgatgtccaggcttcctgcagtgctgtgaaaggtgattttcaccaaagccgtggcgctgcctattcctgcacaggagcaatgggttgctgtcaacctctctccctctttctttatcttgcataaatcttcttgttgatgaaatttaaaatggtaaataagcatttaaggggatctgactgctacagctagatgggaaagccaaaccccttttctcaacaaggaataatttgaagaaattggattcttcattgttggtaaagtagtatctgccatttgcataaatatctaaattgtagagagcagccattattagttaaagtaaatgctacatgctataatagataaacactaaaatctcaatagcttaatacaatgagattttatgtctcgttcacctcaaatttaaagagcagctgggaagacggcagtaactgcaccatacaaccattcaggaaccagggctcatggaggctctgctattttttaagcttttattttagttcaggggtacatgtgcaagtttgtcatataggtagacttgtatcatgggagtttgctgtacagattattttgtcacccaggtattaagcctagtgcccattggtgatttttcctgatctctttctcttctcacactctaccctccgatatgccacagtgtgtgttgtttctctctttgtgtccatgtattctcatcatttagctcccacttataagtgagaatatgtggtatttattttctgttcctgtgttagtttgctaaggataatggcctccagctccatccatgtctctgcaaagaaaatggtctcatttctttatggctgcatagtattccatggtgtatatatgacacattatccagtctatcattgatgggtatctaggttgattctgtatctttgctatcatgaatagtgctacaatgaacatatgcatgcatgtgtctttatgatagaatgatttgtattcctttgggtatataaccagtaatagcactgctgagtcaaagggaatttctgtctttaagtcttcgaggaatccccactctgtcttccacagtggttgaactaatttacacttccactaacagtgtacaagtcttcctttttctcctcaacctcaccaggacctattattttttttttgactttttaataatgtccatcctgactggcatgagatgtatcttattgtggttttaatttgcatttccataatgatcagtgatgttgaggtttttttcatatgattgctggccatgtgtatgctttcttttgaaaagtgtctgttcatgtccttgcccactttttaatggggttgtttcgtttatttcttgtaaatgtatttaagttccttatagatgctggatattagacctttgtgagatgcatagttagcaaaaatgtcctcccatactgtaggttgtctgttcactttgttgatagattcctttgctgtgcagaagctctttagtttaattagatcacatttgtcaatttttgcttttgttgcaattgcttttagtgtcttcatcatgaaatctttgcccattcctatgtcctgaatggtactggtatacttgaaagagatagggggaatggaaccaacttggaaaacatatttcaatagatcaaccatgagaatttccccaacctagctaggaaggccaacaaattcaggaaatgtagagaaccccagtaagatacttcacaagaacatcatctccaaaacacataatcatcagcttctccaaggcagaaatgaaagaaaaaaatgttaaaggcagctaaagagaaaggttaggtcacctataaagggaagcccattagactaacagtggaccgctcggctgaaactcagcatacaagccagaagagattgagggccaatatttaacgttcttgaataaaagaaattccaacccaggatttcatatatggccaaactcaacttcataattgaaggagaaataagatccttttcagacaagtaaatgctaagggaattcagtgtcaccagacctaccttacaggagctcctgaaggaagcactaaatatggaaaggaaagactattattagccattacaaaaacacactgaagtacacaggccagtgacataataaaatgaccacataaacaagtctgaaaaataaccagctaacaacataatgacaggatcaaatatatacatgtgaatactaaccttgaatataagtgggctaaataccccaaatgaaaagccacagagtgtcaatctggataaagaaagaagatcatagatatgctatcttcaagagacccatctcacatgcagtgacacaaacgggttcaaaataaaaggatggagaaaaatctaccaagcaaatggaaaacagaaaaaagctggagttataatcccagtttctgacaaaatggactttaaaccaacaaagattaaaaaagaccaagaagggcattacataatggtaaagggttcaattcaggaagaagatctaactatgctaaatatatatgcacccgacacagtagcacccagattcataaagcaagttcttagagaccacagagatacttagagtcccacgcagtaatattgtgagactttagcactccactgacaatattcgacagatcactgagacaaaattaacaaagatattcagatctgaactcattactggatcaaatgaacctgatagacatctacagaactctccactctgccattttcaactcatggtttctgcagttgttgtgagcattgacactagttggcagaaagggaaagagggagagtggaggattttatggcaaatttttatgggctaaacctcagagtggcacttgtcactttttcccacattgctattgccaagttctggtcatatgaccccttctaattgcagaggaggctaggaaaattagctacgtgctcaggagggaaaaaaagggtaaacagctagacagtttctctcacatgatgtctgacagggatccaggttgcccttctaccatttcagtaatcagagagtcatcattcacgaggggaaaatggctagtggtatgaatagcttttggtattttattaaacctctttgcttctaagtttctagatctgtaaaatgagggtaagtgcatcttataggataattttgaggattttagatttgacacaagtaaaatggtttagtgtaatacctgaaaattagcaaaaaatataggaatattacccattatcattattattttcatcactaagtgacttagtttgttttcacactgtggtaaagaactgtccgagaactgggtaatttataaaggaaaggggtttaactgactcacagttcagtatggctggggaggcctcagggaacttacaatcatggctgaaggggaaggggaagcaaggtaccttctttacaaggcagcaggaaggagaatgaatgcaggaggaactaccaaacacttatgaagctatcagatctcctgagaactcactcactatcatgagaacagcataggggaaactgcccccaagattcagttacctcaacctggtctcccccttgacacatgaagaatatggagattacaattcaagatgagatttaggtgggaacacaaagcctgacaatatcacaaaaactctaagaaagggtagcatatttggaaataagttaatatatcaaatgtgctcaacgcatgcacagaatgtagtaaaagttcaatacatgtttttatcatctaaacttattgagtcttcctggtattatacttacatttattattatgactttctactcataagaacccctcagataaatttcattttcttttattaggtttctttttagaatattgtctgtctgcaactacagtcacttggatacatcactaggtttacatgtgttttaagtcgacttttgctagatgtagcttgatctttgaggctctgtgtaggcctttataaattgcccttcatttgtttattgagaattgaaatgaaaatggaatgctccagactcagatgatgggatttgaggtggaaaatctcattaatgcataaacatgtaaataaatcagttgtttctaaaaatttattcagggccgggtgcaatggctcacacctgtaatctcagcactttgggaagccgagacaggcagatcacctgaggtcaggagttcaagaccagcctggctaacataaaccctgtccctactaaaaatacaaaaattagccaggtgtggtggcgggcctctctaatcccagctactcaggaggctgatgcaggagaatcgcttgaacccaggaggcaggggttgcagtgagctgagactgcgccattgcactccagcctgggcaccaagaacaaaactctgtctcaaaataaataagtaaataaaaataaaataataaaatacaaatttattcaggatagcatattaaacattgattgatgttggtactttaacagataagaactattttaattttgtgttcaattgagtcaaccctaatttgtttagaaacttctggaattgaatgcaatctgttaaaagtaaagacgtgttaggccagataataatattgctttaagcttgcctatctctaacacttattaggagaatatatttatatctgtctttttaaagtaagtattgaaacagctttgtttaattctcttttggtaagaaagatttctttcataacatttgcataatttttaaaaaaataattgtacaaaaatcacagaaccagtaaagaaatatctgtgacttgagggtctcaggaaggcagtatcaaatggagattcatttatttatttatttatttatttatttatttattgaggtgctgtccttttttaagagtgtatttgttcctctttttgtaaactgcagacaacttgaactgatggtgaggtctggtaagaaaaaaaaaaaaaaaaattcaaagctaccaagggagaaaaggtgaatttcattggattactaaattcacaaacaaactttataggtcatcattgaacattttatttatattagaataagcaagcattgagcaagatagaaataattttgcttcaggttatcatcattgtgaactatcacaaggtataagcacagaaatgacagaagttctggcacagaacaaggaatttgcacatggtccaataacatgaacaaaaaaggttgtatttatttatttatttatttatttatttatttatttatttatttatttttgagacagagtctcactctgtttcccaggctggagtgcagtggtgcaatcttggctcactgcagcctccacctcctgggttcagatgatcctcatgcctcagccttctgagtagctgggattacaggtgtgcgccacaacccctggctaatttttgtatttttagtagagacagggtttcaccatgttgaccaggctggtctcaaactcctggcctcatatgatctgcctgccttggcctcccaaagtgctgggattgcaggcatgagccgctgcacctggccaaagtttcatatttcttgtgatgacactgaatttttagacaaaagagatatattgactttgtgtgttgatggtttcaatttagaaaagactatttgggctgggcgcagtggctcatgcctgtaatcctagcactttgggaggctgaggtgggcggatcacgaggtcaggagttcgagaccagcctagccaacatagtgaaaccccatctctactaaaaatacaaaaattagccaggcgtggtggcacgtgcctgtagttccaactacttgggaggctgtggcaggagaatagctttaacccaggaggtagaagatgcagtgagcccagactgtgccattgcactccagccttctagtctgggggacagagtgagactctgtctcaaaaaagactatttgggaatttgttcatcaaaatttatgcatccactttattttctcaaagttcctcttactggaaagcatttaagtattttgattctttttaaaaataatttcaacttttattttagatttggggggttcgttacatgggcatattgtgtgatgctgaggtttggggtacatattatcccatcacccaagtagtgagcttagtacccaataggtagtttttcagcctttactcttctttttctcccctctctagtggtcccaatgtctattatttccatctttatgtccatgtgtgcccagtgtttggctcacacttataagttggaacatgcagtattttgttttctgttcttgtgttcattcacttaggataatgacctctagttgcatccatgttgctaaaaaggatataattttattctttttcatggaggtatagtattccatgatgtatatttaccacgttttgtttattcagtcatctattgatggccacgtagatggattccatgtctttgctattgtgaatagaactatggtgaactttttggtataacaattattgtcctctggttatatatccagtattgggattgctgggtcaaattgtagttctgttttaaattatttgagaaatttttaaactgctttctacagtttagaaattgatctaatttacactcccaccaacaaagtataagcattctcttttctccacagcctcaccaacttctgttctgttttgacattttagtaatagtcattctgactggtgtgaaatggtatctcactgtggttttgatttgcatttctgtaataattagtgagggtgatctttttttcatattttttggctgctttatgtcttcttttgagaaatgtctgttcatgtcctcgtttcactttttaatagggttgttttttgcctgttcagttgtttaagttacttatagattgtggatattaagtttttgtttaatgcatactttgtgaatattttctcccattctgtaggttgtctgtttactctgttgatagcctcttttgttgtgcagaggtctttagtttaattaggtcccacttgtcaatttttgttttagtagcaattgcttttgaggacttagtcatgaattctttgccaaagccaatattcagaatggtattaccaaggttttcttctaggacttatagtttgaggtcttacacttaaatctttaatccatcttgagttactttttgtatatgatgaaaggtgggagtctagtttcattcttgtgcatatggctagccacttatcccagcaccatttattcggtagggaatcctttctcttaatggtttttgtcaactttgttgtatgtcaaatggttgtaggtgtgtggctgtgtttctgggttgtctgttttgtttcactggcctatgcatctgtttttgtaccagtaccatgctgttttggttactgtggtcttacaatatacttaaaagtcaggtaatgtgatgcctctgactttgttctttttgcttaggattgctttggctattcaggctcctttttggttttgtaagaattttagaatcagtttttctaattctgtgaaaaatgatgttgataatttgttaggaatagcagtgactgtgtttgggcagaatggccattttaaggatatatactcttccaatccatgagcatggaatgtttttccatctgtttgtgtcatctgtgattactttcagcaggcttttgtagttctccttgtagggatctttcacattttggttagctattttcctaggtattttatttttcaggtggctattttaagtaggattacattcttgatttggctctcaggttgaatattattagtgtgtagaaatgctactgatttttgtgcattgattttatatcctgaaactttgctaaagtcattgttcaattctaggagacttttggtggtgtttttagtgttttctaggtatagaatcttacatcagtgaagagagacattttgacttttttttcctatttggatgccttttatttctttctcttccctgatagctctggctaggactttcaatactatgttgaataggagtggtgagagagggcatccttgtcttgttcctcttcttaaggggaatgcttccagcttttgcccatttagtgtgacattggctgtgggtttgtcatagatggctcttgttattttggggtatgttccttcaatgcctagtttcttgaggtttttttgttttgttttgttttgttttatcgtgaagggatgttggattctattgaaagctatttttgcatctattgagaggatcatatggtttttgtttttagttctgtttgtgtggtgaatcacatttattcatttgcatatgttgtaccaccctttcctccctggaataaagcccatttgatcatggtgaattaacttttctgtatgctgctggattcagtttgctagcattttgatgaggatttttgtgtctacgttcatcagggatattggcttgtcgttttcttttctcactgtgtctttgccagaatttggtatcagagtgatgctggctccatagaaggagttagggaagagtcccttttcctcaagtttttagaatagttacactggctcttcttttgtacacaactttataaacatacctgtaagcgtaattttgcaaagatctttcattcatcaaagagaattcctttgtgaagtaaaatggtaaatagtctaagcatcttgctttcaacttgactcagagccaaatgtgtgtaagcattgagagggtttgccattttacattccttagtctgaagaagggaagaaagagaacatccttaaaccctaaaaatattacttggcctgtatggcatttgtacgcaaaggtagaatctgagaccttgcataagatttactggaaatgctacatctccatgaaagactacatcaagagtgtcaaagcatgattagttggggcacattcatatttttttgttagggagtctatgtcctctcttttatgtattgtttgacgtcagatgcctttaaagtaaaactataagaattattagtcatttgatgagaagtaataaatgttatatagagaaacattacaaaatagagatagactcaggataggggaccatagagcatacaaccatgaacacatatcatttgcttaaattagttaaaacacaaaagcaaaatatttgaaatagtcaaaagaacattttcaattctacctaataatttattggatgaattcttttatttttttaaatagtttactggccgagttgataatatgatctatcctagttattaaccagcagaattttaatttagttttcaaggttctccatggtctaaactcaacatgcccttccaggctcaaattacactcttccagttcaaaggcccatctgaaatgggctgcttctattatgttgcccaggctttcttatctctagctctttgccctgatacctttgtctttctacttggagtacctattctttccatctttaataccccaccttcattaaatgaccctttctaattacttcctgcatgcttcagccagatgtaatctcttctctctgattatcacataacactattttgtgcttctgtggttttcaccttactcatctctgttgtactgacaaatggactgtgagctccgtattttttatcttcacccttatgcattgcgtaattaaaaccttgtacacagtacaggttcagcaaacacacactgaataaattaataagtaggtgaatagttttgttgtttacattcactaacaacccattctgattcatgtttacatggacagaaaaagaatgagttgattattaactaaatttaatgtatgtcatctgtatacctaaattctttgggttaatattaaaaaagtattcttccaagttagcatgaatttgacctatcttttagagtgttcagattggttcactcatgttgacattagtcagttttgaaattcagacataaaggtatacacatatagatttgacatttgagattaacttacttttttccagttagattatggaagagataaacaatgactcagaggaaaatggagaggctatagaggtgaaatactgtaataatgtggctaaacttgcttgagagaagatgagacataagcctgctttgttagtcctttcatagagaaatgactcagcactgttagagaatatgatgaggttacattgttctttcatcacaaactgttgagttaatggtggcatatatagagtatagctctgattcataagacaattggtcattgtgcttctctctttttattttttaaagcaaattagtgctttaaaagagcatagtaatctggttcttttcatgaaaactgatgattaaaaacaaactacgaaaataattttaaatacacctgggtttccaaatggacagaggttgttgaaagtcatttttaagttccttcaaagctacaaagtctatgtgtttctcaaattatcttttgcaaatcttagtaggaattaaacttgtgcaaatccaacccctggctctttttagcctcgtgagagcagagtatgcatcgtgctttcgttttggatgagaaatatacaaactgtgtgttgactggtggaaagcagaacaatggatctcagcaaattgtatcatgcccagctctgacttgagacgcagaatcaattcattttcagtgtcatgacaggatctgagatagaagtgagtctcttgttgccatcatgagaaaagatacgtatgtccacagttttggggagagggagcatgggagctgggtgcttcactgccaacacagcctctgatcacctgatatgttacaaaatcaattttatcttctgctgcatttcatgtgacaattcaaagagcaacatttgtttttctactctttacattctcaacttccatggaggcataattgccatgagttaaagctaggaggagagtgatcactgcacactgatttggatataaaatctatggccatttgaaagggaaaccttcaagagcccacgtaataaatccccgaggaacttaagagagatgaactgtacctaattgcatctgacatggctaaaacacagggacctctctaaagagtgtgagggcaggtccccaaatcctctgctcagcactattcaaggttcagaagaattcatgcatttagcttatctacagctatgtggcaaaacacccttcagctgcagtcagcctccctctaatgaccaatgaggagaggccaaaaattaaagttgtataatcagagattttaaagacaaactgaaaagaactggtggaaccgtctaacttatgccttggaatggcatgcattattttgtatatgattttgggcctcagaacacaaacacaactccctccacaaaggggatgagtttgctgggccagagtggcctcttgttgctgggagctactgccgcccagcgtgggcagctgcaatcacagtgcccctatccctgcctgagtggtcctggagggttggagagctgcgtgactcctcaagacctttgtcactagcctgtgtaatgcctgtgcatgagtccttgaaagcaaatcccccaattagggcctacatggcctaccctgaggagggaagaggtgcaatacatgttgcttttaacaattcttcatcaggaatgagaggatgttgcaatggaaaggaaaatattaattcctgctaggcccttgtcagtgggatcttctcccattctcttcctgctggaattacagatccataggttttggagccagtcagcctgggttctttcatgcattcccttcttctggtgggcttgaccatactagatatcaaatactgtgactcaaagttctaccacctctgttgacttaaaggtcaaacctagaacaagccttggtctctaggtctaagaggcaaaataaaagctggtgaaccttcttactgacaaggcacttgacttccctgtgcctcagacttcaaatctataaaacgagactcactgttcttatctctgaggtttattgcttggaattgaatggggtaattcataaattccctagcctggcaccccacacacggcctcttcaagaagtttcggggtagctctcttgccagtcagctgagaaaaccaagcagtgagaagagggtcatatattgacttggttttcatgctgacaggctttggcatctcctcaagcttgtccatactctacagtggcattaagagagtagtgtcctgcacttgtgtttgagcactgtggaacattcctcaggagttctggctgagatgcatgtgccccaccttttcccagaaccagggccctctaagtctaagtcaataaagggaccaggggaagttcctggaaattctgatccaattcaagtccctgctacctaggtttacctcttgcctggcctgtctccccctaatttctcaggagtagacttctatttgtatagtgtttatatgggccaacatttgcatatgttcacgcatgttatcttcacagcaattctaaaaagacaattaactcttgttatgtctgtttataaaagaggaaattgaggcacagaaatgtcaagtcacatgaacaaatccctacaggaaccatctttaataagtgtcaaagtaaggagtcaagctcaggcagtcatgcccttatcccacaaattttgagattctgccatagccaggtttatgccttgcttctcacttgtgatggactttccagagcttggcccagtcactgaaacatggcaaacattgtcaatatttgatgagtaaagacatgaatgaatgatgcttttgcaactatcccattccctgtgcactcactgaatttttcttcccctttttatcatcgcagtgtttgaaaattttacttccttattttactagatatatctttgtctttacatgtgtcatctctcaaccagatgtaaaaggtacttccctgaagggaagaagcatgttttatacctgttatgtaacctccgtaagaatagctgaatactcagtttgtgacacacaaaaaccctaaaataactatctaaatagattgggaagttgggttgttgagatacagaagatttactcttcttcccaactcatcccttctctttgctccttccaataaaatgctatttggttgaatagtttaaagatggaaaaccatttaaggttaaaacagatgaataagatcattctaaagaagcagaaaggcgttcagaccgttaagttgaatagatcagagtacggcattgattctggctgtaagatttcaggtcaccaaaggaaatatgttggattgcattatctccattttttttaaaaataaagtttagatcgctccctgaagataaaattactcttggaactatattcaagaaggacttaagtatgtagaccttatgtaacagatgtaagaaacaattccaccaatgctgatattatggagacaccaacatgccctcttacataagccataaaagtggtgagaatggccacatttttgtgatggggtgtttggaattaattcatcttcatgaaacagaggccacatcatattcttggtcatgagtaatgatggtaatactgtttctctttcctttgaatcacttacctatccattgacctaacatgttttaaataccacaaaggagtaagattctctctcatgtctttgggtagagaaatatgcaacaacccatttcctaaaaagtctgtaattacatgtgggaaatgctggtaattaatagcctgaatgggtgattctaagttagattcatgaaaaaccaagagacatatctaacctttcttaagctccagggcacatgcataatttgaacattatgtctacaatgtgggtgtattttcttccttttcaatgaagacagtgattaggatgataatagaaataatacttgggtttatagagcctttagctgaagtctacctacatggtttctggctctgtggtaagcatgtcggactaatgtcagcttttgaagtgaatttttcatgcctttttccctctgggcttcccctttctctaataaaactactttaatcccattcacattccagttctgaatactagcacttgaaatgaactgtctatatctgactcacttaaaaaaaaaagtagtttaaataaaaacaaagagttgtttactttcctttcctacctggctgcatctgtcacatgcatatagtgtcccctgacatgaagctctgatattgatctggagccttattgatctccaacttaatatagggacaatgtctaccaataacttaggcacttccagagaggctcactctgtcttcttttgttcacttacaaaatgaaaagaatgtctttactagagtacctattaaagggttccagtacaccctaccacaagctcaactttggaatctgataaaatattttttaagcaagcttctggttttgttatattaatttgggattggattccctccagtggttcaaacaaaatgaaagtatgatctttaagtatgtaatatattctgtcagttctctggttagtttggatcagaattaactcctttcaggatcatcccaaaataacagtgtaaccccatagtaaagcacactctcttctttcctgtgatatcccatggagtaggaataattaggcaaccacaactgcttaaccctgtgtggtttcacacagaaaaatcatgacaatttctcttcttgttgactctttctcatttttctggttatccatagcttttaacaacaaaccaccctaaaagttattggcttaaaacaattgcaattatttatttggttcacaaatctgcagtttgggcagggctcagcagaaaaggcttgactgtgctccaggtggtgtgagctgtggtggctcaagtgggctgaagtatctattttcaagatatcttaccaacatggctggtgctggctgtttcctgggaactctactgggtctgttgtatggggtcattgattctttggatccaagataccacagctagaaactgccactctttttcagtctggtacagcatcacttctgcgatattttgttggacaaagaagtcacaaattctgcccaaatttaagaggaagggacataggacctgtaaagcaaaataaaatgttaagcccccaaccaactaaatggatccccctcacaaccaagagcattccaaagttaacctgaaacatgagttcaggccatgatgggaatggatagtcagacatgcctcattataccatcctccctttggaattgaggcacaactgaccagcgttaatattgaaacagaaacgttaaaacaatctgttctctctgaagcctggaggcttcatctgtgtaataaaaaccttggtctccacaaccctttactttaacccagacactcccttctattcattccaggtatttatcaagagcccatctaattgccagtcagaaaatctttgaatccacctatgacctgaaagcactgatcccctactgacccaacttccatttgtcctgcctttccaggacatggaacatacatcttaatgtcaaaggcatgtccttaaccttggcaaagcaaacttctaaactgattgagaactgtctcagatactttttggtttacaaaccctacctgtcattgagaggagtgtcaaaaaattgggccatgtttatactacatgctctttaattaatatctgtctgatactactaatatctgatactatagttacccaagccagaaactcagtcatcacctttgaccctttcttctctcttatctttctcttcttgacccaccctagaaatacatgtaatctttattgcatataattaataattctgtgacttaatcagatattattgtatcatatacataaataccaattacaaagtcttctaattgaccctagaatcttctgcttctcttgagtgccatcacctctactctggtacacacatcatccctcctctacctactagccagtctctctgcctccagccttacccctttttactctagtcatgatgattttatttttagttagaaagaataactgtcctctgattataatttctcaaacatcctctattgctgtaagagtaaagtgcaaatttgtttgcctggcttccaaggccctgcaggatggggtcccagcctccttcactagccacaccttgttatctcctattgaacctttggcccttagccttcagctttaccaaaatcttgatgtactccaaatctcttcctttgaaatgctctttcctgttcctcttccttcttaccatcctccattccctttgctgggataattcagtcgcattctttagatttcaagttagttttcaattgctcacttcctctgggaagaattttatgacccttcattcatttattcattcacagagtattcattgagtatctacaatgtgccaggcactgttccaggccctggagatactacagtgagcaaaataaataaaagagccttttgtcatgggatttatccttctcatggaaaagtcaggcaataaacaagaaaataggtaaattacatagtatgttagataatgataacagctgagcacaaataaatgtgaagcaggatgggcaatataaaatgttggagggtggggatgttgcagttttggcaaaatccaggtaaggccccactgggcaggtgtcataaagtcaaggcttgattgaagtgaggggtctagctatgaggctgtctgggagaatactattccagatagaggaaacagcaagtgcaaaggccctgagataggtatgggccactgtgtttaaggcgtggaagggccagagtggctggagtgaactaagaggaaagcagaagaagagaagatgaggtcagataggtgatggagccctgctcgcagaaagtcctgttggttgctgtaaggactttggctttggtcataagtaaggtgggaaggaagcattgggaaagtttgagaagaggagtgacctgctctggtttatcatttaagggatccccttcacatcccaaatcctcccacattagccccttctcccatcatttagctttttacctgtgctataacttggttctatcccttactagtatctcatttctgggaggagaggactctgtccaacttgttagtgttttattccctccatctagcccaatgtccaggaaccatagggtatcaataagtatgattgcattgaaataatgagtaaatgaaagccagctcccgtgctaatctttaactttttaattactacaacttctttatattggttgtagtaaacccaaaatacaaatgaggaaatgaagtaagaacagaaagtgacagagagagaaaatgggaagagaagaaataaaattcttggagccatcatggcagccttctttaagctaagaaacccaggttctcattccgacattggcgtctctagtggggaattttagggctgtctgtgggaccacaagatgatcatacacttctctgaaaataaatgttcatagtgaatgcttttttgatttttggcagaggatgggaggcacttccattttggcccattatgagaataacaagacaaaatagccatatcatagtatatttattacaaaaattcatgtcctacctggctgtatgtgtgcatacatgtgtgcatgtgtgtctgcaaaggcttcatactagtccacatgtatttatcagtgtggactctatgctgaactaatgctagggatggagatgtcctgccctcaatggactcaacaggggctacacaaatcaagagcggtatagtgagtaatatggtgaggaaataaatacctcttctaagaagcaaatagacttgaatatattagatagaaaaatatactaatgcctgcactgaatatgtgattagctttttttgtttttttttttttttgactgtctcactctgtaacccaggctcaagtgcagtggcatgatgtcggctcagtgcaacctctgcctctaagggtcaagtgatcctcctgcctcagcctcctgggtagctgggagtacaggcacacccagctaattcttgtattttattttttgtggagacggcgtttcaccatgttgcccaggctggtctcaaactcctgtgttcaagcaatccatccacctcagcctcccagagtgctgagattacagatgtgagccaccgtggctggccatgttgagcatttcttgaaaaatagcagaaacaattgcttccttaccaaaatggtatttttcatttttggtttaatgggtaagactggagaaggagacacttggccactatttggagtatcacaattggacttgtctcgtgatgtcacaaaatattcaaactggaagaaaagcattaaaaaaaaaaaaaaacctgtgttcagctcttttgtttaaactataaagaaaaatgtggcccaaagagactgggtgttgccaaaaattgcacataggaagaacagagagggaaaaccaggcctctgagcctgggaccagtcacatgatgacattttgttacctaagtcaaaaagagaatgacagtcttctccacaggagtactttgggattagttagtgggtggtctcattacccataagcccctgcctttattggttggttttttctcactccatctagacacgctgttatcagtcctggagcctgagtacactgtgatggcttcatgttgtcagctgcgttttctcatgccctacactgcagactgaaaaaggatgctccacagccagctttaacaccatgcaccaagcctgccacagccatcctctcttctgctccaagctgctgagagacaggaaatggaggttctgagttttgaggcttgcagggtttgtctgcactgcattcagcttgccagtccccaggagagctggcatgctgcttcagatccagaaagaaaaggagagtgccaatcagatatatacacttctgtaaatctccagttagttccagagctgtcatttgcctgtagaaattttaccacgtttacatgactgacccagacagcaagagctagtgatgcccctctgttgtaactacatggccagagggacatgcaacccaattaaataaaattaattttaagcacacatcctgatttggagaagcatttggacaataacatagtgtcagtgtgagtcacttatcctaaacagttttattgttgtgaccctgatttggacatcgctatggttgctgtgcatgataaacttgaaccatgttttgcgcttaagttttaaagaactgtaatttaaaacatgtataacaaaacaatctatgaataaatgagatctttccaaattagatatctcctttggtagcatgatgagtaattctttccagtatcataacattgagggtctctgagagtctccttattaaataataatccttcttcatagagggttttgcatgaattttgggagaaaagctatttacctacttaatcttaaacaaaaggcatcacttccctgctttctgtgtgatcactgctgcatgtgtttgcatgtgtaaactgtggtggctttacatcatcttatactatggatttttttccatatacagcagtatgaatagaaacaatttttgcagaatttcatgaattataactaaggctaaaagcatggatactgttttccatctcatgctgttatgttccttgccttattttgtttatgtaataaacatttattcagtgtatactactggccaaaggttgttgtaggcactgaggatatatcggtaaacaaaacaggagaagatctctgccctcatgaaacttatattttagcagggaggtaggggcaggtgatgcatgcaataagcaattatcataaatatttacataattaaaattacatagaatgcttgaaactaactacagctgtaaatggagaaaaaaaggagagcaaactaaaggggaagtggttaaatctaggattcaataagaaatagaggggtcaggaaagcccttattgagaagaagagattttagcaatgacttaaaagagataaaggaatgaaacaagcagatatgctggggaaagatcctatccggcataggaatcagctaaagtgaggaccgtaaggaggtaatcttcagccagggaagtcccaggagataattgtggataaatcaaatgagcagagggaagataaatgcagctagaaaaggtagctgtttagggtcagagaaagggctatgggcagattatgtagggccttggaggcagctgtaagacatctgggtttaattcgaagtgaattgggaagccagtgcagttgtttgagaaaaggaatggtgtgattcaatttaagtttctaaaagattaagctagtgaatcttttagccagagtaatctgtatggggaggatgacatggcatagcaaggaaagaaacagtagcctactgcaataatctgggagacagctggttgcctcagtcaagatggcagcttgcagtagaagtgataaaaggagtacagactttgtatatattttgaagatagaaccaacagggagaatttaagaatgactccaagggtttctgtctgagcaactggaaggatgtaatcgcttccagctgttatggaaatggaagcaggttttgttggggagaatgaagaatttaagtttgaacgtgtcaagtggaagatatataagtcaggagagagatctgggcaagagatacaacttgagagttgttggtaagtaggaggtatttcaagtcatgaggatagatgcaaactccaaaggagtgagtatagatagaaaagaggatggaggtctgagccttggtccattcccccagtaagaggtaagggatatggacaggaaccagagaaagaggctaagaagatatgaccagtgatggaggaagaaaaccaagagaagatgctatcttggtgaagaaagtactttgatgagggggagagcttcatggtgtcgaggtctgttgaaaggggctgggtgcagtggctcatgcctgtaattccagcaatttggaagaacaagataggagaatctcttgaggccagtagtttgtgaccagcctgggcaacatagtgagacccccatctctatttaaaaaatagccaggcatggtggcacattcctgtcatcccaattactcaggaggctgagataggaggattacgtgagcccagaagtttgaggttgccatgagctagggccactgcactccaggctacaaaataaggccctgtccaaaaacagaaaaaaaaaaataataaaaattaaaaaaaaaagaaagaaggaaagaaattctgttgaaaggtaaaaagctgaggactgagaatgacaaccagatttagcaacatggaggtcatgggtggattgctggcagcaatttgaatgtcatgatggaaatcaaatcctgactggacaaatagggatcttctttctctttttccttccttccttccttccttccttccttccttccttcctccctccctccctcccttcctaccttccttccttcctaccttccttttcctcctttccttcttcttcctcttccccttccttttctccttccttctttcctttttgtgccattgaactaaaaacccatacttggatattgttgacagtatgattttaatgaatccctttgggaatttttttaaactcttggaagattttcacttatttgatctgtccctaacattccaaaactggcatgaattttaattatcctgagatttcacttgggaataaaatggccaagataacagataagcactttagaaaatcattagcttattttaggccattacattatatcttcttacactgaatatgaggaaaaaagtattagtaacttattttatcatgtcttggtaattgaaagtaagtcacatattcttctcaaagtacatccagggtttacattgtctgttatgtatgcatggcttccctaacaagataataaattcttggaagataacaaccagaccttctatttttaataatatcttttgtgcccagccatgtcttgtacatagtcggtatgcaataaatatgtgttggtttcattttctatgctcattctgtctgatcctgccttcttatatacaagcctcattcagtaatgggaggatagtaatagaaaacagagggaacagtgctaatactgctagaacttgtaggctttgaagactttacaattttgttaggaagagaatagagatgtatttgagaaattcagtagcaaaaaaagaaccatatatagcaacaataaaagatgggctcatgattagtgaccaaatgaaatctgtaggtaatatatttttaaagggtcctgtgctggttggagaaacagacactgagaaaattattcttaaaatactctcctgtcctcccctctctcctcatcaataagatgaatatatgtttatagaaaaattagttaacattatattatgaaaaactttgactattcaatgattttaaacataatttccaatggatttagagtattctatcatgtgactgtatcataatctatttactctcctggattgaaggtttcgatagttgtcctttctttttcatgacataccaaactaagatgaacatcatttattgccatgtctttttgcatattcaatagttatttctttatattaaatttctaaatgtgggctggcatggtggctcacgcctataatcccagcactttgggaggccgaggcagatggatcacttgaggtcaggagttcgagaccagtctggccaacatggtgaaaccacatctctactaaaaattcaaaaaaaattagccgggcttggtggtgcacgcctgtaatcccagctactcaggaggctgagacacgagaatcacttaaacccaggaggtggaggtggcagtgacattgcactccagcctcggcaatagagtgagactccatctcaaaaaaacaaaaaatctaatgtagaattataatattaaaagattgacatacctggagaattgtttttaattgtggtgaaaacatacaatgtaacatttagcatcttaaccattttaaatggaagtttagtgatattaactatattcacgttgttatgcaatagatctctagaactttttcatatgtgaaactgaaactctgtctccattgaacaacaacttgccatttcccttccccttagctcctggtaaccacaattctttctggagtgcaatggcataatctcagctcactgcagcctctgcctcctgggctcaagtaattctcctgcctcagcctcgtgagtagctgggactacaggtgtatgccaccactccccgctaatttttgtatttttagtagagacgggattagaacatgttgccaaggctggtctggaactcttaggctcaagcaatcctcctgccttggcttcccaaagtgctgggattagagttttgagccaccacgcccagcccatgattctactttctgtttgtatgagtttgattactttagataccatttatgaggggaattatacaatagttaccttttgtgactggcttatttctcttagcataatgtcttcaaggtttagccatattatagagtgtgataggaattcttcttttttaaggctgaataatatatctctttgtatgtatataccacatattgtttatccatttatcttttgatgaacatttgggttacttccaccccttggttcttgtgaataatgctgtagtgaacatggatgtgcagatatctcttggagaccctgctatcaattcttttcattatacgcccagaagtggaattgctgggtcatatggtgattccatgtttaatttttttgaggaaatttaatactgtttttgatagtggctaacactattttacattcccaataacaatgtacatcttcactaacacttgttactttccgttttttgataatagccatcctaatgaatgtgatatgcatacacggctttaaaaaaacttgtttcttcagaatatttgcatatggagattagcatatattatttacctttaatattatatattttgtccttgcttatttgatagataaaaaataatttgtatttatttgactactagtaaaatttaatatttttaatacttggttactagccagtttatatttttcttttgtgatttgtaagttcataatctatacctcattttgtattgggttttctccacccttcttatttatttataagagctattaatataatacattatccttttatcttttatttatttatttttaagacagagcctcgctctgttgcccaggctggaatgcagtggcacaaacacagctctctatagccttgacctcctggactcaagcaatcctcttgcctcagcctcccaagtagctggtaccacaggcttgtaccaccatttctggcaaattattaaatttttatgtagagatagggactcaccatctcgcccaggctggtctcaaactcctcagctcaagcaatcctcttgccttgacttcctaaagtgctgaggttacaagcatgagccaccatgtctggctgttatttcatgtttttttacaaacattattttcatgtttcagatacatttcaactttgtttattgcaatttttgcttctataatactgatagaatcaaactgaaacttaagactattttatttctcatttacccctactttttttttgtttgttttgttttttgagatggagtctcactctgccgcccaggctggagtgcagtgacgtgatctcggctcactgcaagctctgcctcctgggttcacaccattctcctgcctcagcctcccgagtagctaggactacaggtgcccaccaccacgtccggctaatgtttttatatttttagtagagatggggtttcaccatgttagccaggatggtctcgatctcatgatccacccgcctcagcctcccaaagtgctgggattacaggcatgagccactgtgcctggcttttacctctacttttatatgaagaaaatccatgctcatgtaatagccaaatacagtcaaattcatttttctctagtgttaatatttcagtcaaattctaatgcattaggaatttgttaatattgcatttaatattatttttccccaatctttttttatttgaaaaatattataatccagtcaaatagcaaataacataacaaaatgagaatttcttaccaaggattaattcatattaacattttatcatattgatttcagatcttgtgtgtgtgtgatgtttactgataaattttgtgtccttgtacagcttttgtggatcagggacaaggggagcatgttgccgaacaaaaatatattaacatgtttgggactaatgcacactgattttcacagaaagtaactgattgattgcaatcaagtatgggagactagagggtggcaagagttttgataaaattcagttcaataaacttgtgaatttaagagcatagagattctattaacgagaatgaatagaagaagatttagacatggtgatttaaaggggatatcaagttagtgttgaagagtaaccatctcaggaaaacagtaggaattagagccagttctgagaatattctgtgtgagatctatggaaataaaaaagctaggaagggaaaagcttaaaggaatgtgtgttgggaagtgcttatagaagagagcaagcaaagtgccttcctgttgtcgtttagacttttccttaatctgcattcctgcagttaggtttactgagctctatggcctgagttattgctcttctatgtagttccagattaagggttaagaattctagtagagcaggagtatttctggaaaagatggttggggggcaagtatagggatggggagaagcggagggcttactctccacctcccaaaattttcatggaaatgacattcagtaaaagtaaatatccatataacaatggtggtggaaaggaaaatgtaggggtagatggcttttgcggatcaggaacaaagggtatcataatgctaaataaaaatatgttaacatgtattggactaaggcacactgatttccagatggtgtttacatctgaggaagaggaaatggggaaaaggtggggaggtagcctctttataagaatcttcaatgttttattaattaatatttctaaaagataactctttttgaaaagagaaaagataaaaatattatcatccattaaatgtgggtagtgattaacttattatctcaggttaggttcctttctagttgagatttttataattaaatttttagataagagtcagaaaatttaggataataaccttggatgacaaaggaagaaagttttaggatattttaaatattagtgaaattccaaataaatttaagctgagagctcactggttaccatatatgtttctctttaacacaagaaattggaaatgcgttaggtcaattcaacaagtaacatttggaaataggccgggtgctgtggctcacgcctataatcccagcactttgggaggccgaggcgggcagatcacgaggccaggagttcgagaccagcctggccaacatggtgaaaccccatttctactaaaaatacaaaaattagctgggcgtggtggtgggcgcctgtaataccagctactcaggaggctgaggcaggacaattgcttgaactttggaggcagaggttgcagtgagcagagattgcaccactgcacttcagcctgggcgacagagcgcaactctatctcaaaaaaataaataaataaaattaaaaaaaattggaaataacatatttgctattaatatcttaaaggaggtatttgtgttgaattctttgtcttagtcattatccttgcttttaaaaaaaatgttagaattcctttttctcaaaattctgaatgtgctgtgtttaacagcgtagttacagttctgaaagggtagtagatttctccccttgtctatttgtttgcagcaggtcatgaactcagaccttttctcttcagtgctttgcttctgaactacttattctgataccctcctcacctgaggaaacagagcctaagaaggttctccttatatggattcaggtagatgagtttccataaaaaaaaaaaaatgacatcaagcattgatctgcctgaataaagcaattctaccagttatatggcatttggtgcttcctgtgaattgatacaaacttcattaaagaaaatgacagatggcatatggctgcaggcaaaatgccagtccacatgatgaatcctaccatactctagtccagtataaacaatgtttttaatcaccttcaaaaaactgttgcattaatttgtctacagtaaccaggtaattataaatgtgtagctagttccttattatcttaaaaaaataaaaataaaagttagcaactaataggcatttagcttgagtttatattatagatggccaaaggagattttatggcccaaaatggacatggtgaggtctgcatgtgaacgatgttacagtagactaaccacagagcctggagttcctgcacttttcttgatttgtttggaatattactttgagaattggaaggcctggggtacgaaaaatgattataagatttttctttgtttgacaagataagcaggtctgtgtgaggcagatactttctatggactgactgcagacaggtttcagtcacagactcaggttttatggcattctctttgaaggtgggtgtctaatgtaactgaattttagggggataattacagtcttatcaaattctgagatgaacttcatcacttatttaaaaaaaatttcctgtcaattagttcttataataatatacttttctggtcaattttacatgcagaatttggtgaaataaagaaacataaatagataaaaaataaatattttaatgatgcccaaataaaatttagatgtgtaaggactaaaaatgatttttaaaatagttgtataatagaactacatcttagtttcagcacatggaatttatatagttcattttagttagtgcttcatttcaggctgctttttttcaaacaacagaaattgactttggctcatttaaatggaagaatgttttagaaagttattcactgatggggcagaaaggcagaagaaccaagcatgaatcaggttccataaagtttcaagctgctgtaacagaataccatagactaggtggcatataaaaaacaaatttatttcccaccattctggaggctgggaagtccaagaacaaggtgctgacatatttagtgtcagtgagggtgctcttcttcatagatggccgtcttctcattgtaccctcacatgcccaaagtggccaacacctctcttaagcttctttttaaaggcactaatccctttcatgagaagtctgccctcatgaaccaatcatctcccagagaccatacctcttaatagcatcatcttgggaggtaggatttcaacatatgaattttgaggggaaacaaacattcaactcatagcagataacaaggcagtaaaacaattagccaacactttataaaaatcttcaatgttttattaattaatatttttaaaagataactctttttgaaaagagaaaagataaaaatattatcatccattaaatgtgggtagtgattaacttattacctcaggttaggttcctttctagttgagatttttataattaaacaaatttctagataagagtcagaaaatttaggataataaccttggatgacaaaggaagaaagttttaggatattttaaatattagtgaaattccaaataaatttaagcttagagctcactggttaccatatatgtttctctttaacacaagaaattggaaaaaatgagttaggtcaattcaactaataacatttggaaataggccaggtgccgtggctcacgcgtataatcccagcactttgggaggccgaggcgggcagatcacgaggccaggagttcgagaccagcctggccaacatggtgaaaccccgtctctacaaaaattacaaaattatgaaaattaaaaaatttcaaaaaaatacaaaaattagctgggctatagtctgggtagggcatttggtactggtcccaactccactgggcactcttgcctgtgctggaattatcctactgccacagataatgtctcaactgtcctcacatctttgtaccattctccagagattcaacgttctaagcagaaacctttagctggctgagtttaggtgatgtaccagttctctaactgcctaatccattggcttctgaatgagaggtgaggccctccctcccaacaaataggaagtagtatcattgttggacaaccaaaggcaacgaccagatgggaactaataaagctgtatgacactaaaaattcttcattaaatcatgcctttttttctagtatttttctctttgtttttgatagccaaaaacatatgtagcaaataatgccattgtcaacatgactaactccaacacttagttatagttgttacttttcagcccatggtgttttctgctgtgacaaaggcagagttgttgttcctgaactgcacatctgcctccttttcttgtacacacttctgatattttcaagtttaggagaaagcaggcatttgccttacgtctcaactcatattttaaaatcagtgtcactttcctctgcttattttgctatgcttttttagtgaataaatatttaccgaagacttctgcattagtttgcccgggttgccataacaaagcaccacacactgagtggattaaacatcagaaatatagcgtctcacagttctgaagggtagaggcctgagatcaaggtgctgggtttgcttttttctgtgggccgtaaggaagaatttgttccatagctatcccctaccttttggtgggtttctggcaactttggcattgcttggtttgtagaagcatcactctgatcactgctttcatcctcacatgggggtctctttgtatgtgcctctgtgtccaaaatctgccttttttagaatggcatcagtcatattggactagggtttgccctaatgacctctgttaacttgattacttctgtaaagatcatatctccaaacaaggtcacattctgaagtaccggtgttggagtttcaacatatcttttttagggggaacacgattcaacccatagcagcttcttaaaaggcaacctctttaatgtgaagaatttgaaatattgactcatttctggaagaaacaaaaacaataacaacaacaaaccaaactttaagagtaaggaatatctaactgggcagtgttggttgtcaaatgagtattatacacataactaaatttcagggctcaaattgacatgatttctttgaggaaacttaaggaattactaaataacttttatcagtttgaagaggttctcttctattcctaaaaatattcctggttgaatattttcattatgaaaggctgctgtattttgtcaaatactttttctgcatctattgagatgagcatatggtttatatctttgattcttttaataatatatattacatgattacttttcatatgttgaaccaactttgaatttctggaatagctcccacttggtcatgattataattctttttaaaagctgctgggtttggtttactaggaaattggtggaagatcttttcacctatattcataggggatattagcctgtaattttcttttcttctgaaatttttgtctagttttagtatccgaataatactggcttcatagaatgagctcggaagtgtttcttcgtactctttattagaagaatgtgaggattagttgcaattcttcaaagtatttaatagtagaattcaccagtagaaaccatttaggtctgggcttttctttgcaggaaatatttttattacaagtcaatctctttgcttgttacagttttatttagactttctgtttcttcttgagtgagttcagtagtttgcgtctttctgagattttttttaaatttcttcttgcttatctaatttattggtctacaattagttatagtattcttgtaaaatcttttttgtttctgcgaggtcagtagtaatgtcccctctttaattatgattttagtaattgagccctttttttttctttgccagtcagctaaaggtttgtcaattttgttggtcctttcaaataacccatgtttggtttcattggttttctcttttgttattctattctctatttcatttgtttctgcttaagtttttattatttctcttattttgcttgctttgcatttatgttgctctttttctggtttctttcagattttctttgtggatgtgctctgaaatactagaaaattgaaaccaattctatttcccttcagcaaagcattaattattgtgaaatactaatgtaaagtcaatgtaatagcaactatttatttaaatgagtagatatactgcaagaaaacattttactgcatatatgaacataaccaaagggcatctttaaagacagaaactttaaatgccaaatgcatttttcatattttgagtttcatttcaagacatctgatggaagatagtattattctataataaaatattttaacttttacttatagtagatgcagtaaacactattgcagctttaaaaatacttattatagtacttagcattagacaaattgtttgaagttttaaaaaaatctttacaaattaaaagctatagagtgcctataatcctttaattcaaaacagttgttttcattttccaataaattggtaaaagggaacttaatgacattgtctttccactaaacatcctagctgttttcaagaaaacagaattaacaagaaacttaaaaaataatattgtaaagcagacagtattctaagtcattacagttaatacaacaacaaaaattcagtgtgaaactcttgaaacgaactttaggatatattcggttaaattatggtctactatttgtaatttcatgaatttttttccaagtattggaaatgatctaaatggctgtgtttgtgtcacaataatgttcaggttacaatatgctgtatatttaaaattacctttgcattttaaaaataactatttaaaacactgccaaaatcggcatcataattattttggaagacttaaaataaatacaccaaaaacaaaaccagaatttgcatctaattgcctggaatagtttctctagcctcatttgccagacagaggaatgagtatcttgaaaatctaaggttctttagggctataggattgtatgcctatcagcttggattgctttttgctttatttgactgtggccaaaggtggaaaaggccttcttagatattcttactaggaaatgtaatcttgaagtctatgtcaaagctttcacacaaaattggtataaaatttatacagtggaacttactctaagcagtcaataatagctatatttctgaaaagatgattttaaagccaactgcaataaatggaataactaacatttacatgtgctaaatcttctaatttattggaaatattgaagggccattaaatttaaaaatgcttttgtaaatgcaaaacattaacctctaatttaatccttgtaggaatacaattttttttaaatcaaattttcctgaagcagccatagctgaattagttgttttacttttcaaaattcgcggtgaagggttacatttaaagcagagaggagccccctttttcctcttcatttattctaagtagtacctgaaagcaaaagttggcaggccgcaggcagagaataggtcagccacattgttccttgccttgctgatgcaaaagagagaacatttcaaagtaaaacaaggattggcatcagagaaattgagttctgtgctcttttaaaataatcttcctgaggcattctttcagaaaactagcatttaccctccccataccacacgagtgaaaaagtgacctttttcagagagctcaaagtcaaattagttctgtaagtcagtctagggggaagtgagagccaatttgtggtcagggttgccaaagagccaatgtccaagaaaagaagagaggcagggtggtcaggacgtgctgagaaagactgaaaaaaatagggaccttgcagctgttgaggccatagtagtgactctagggaacatgtagtctaaaaagcctatctaaaagcaaagttcagccttgagagcaagagctgggaaggactcaaggaatgccatgaactccacatgagggaaacagatcacaatacataaatgtaagttcaaaggcagaagaagagaaagagttatgagaggtaaatggagagggtaccatgtaggaagtcacagagaagcagtaatacaaggaaagattataggtcacttttttgctcttctgtcagcaaaacccatgtagtaaaagaagtacgtcagggagaggacatctaaaggtttcttttttttctttccctttttttttttttttttttgagacatagtttcgctcttgttgcccaggctggagtgcaatggtgtgatctcggctcactgcaacctgtgtctcccggattcaagcgattcgcctgcctcagcctcccgagtagctgggattacaggtgcctgccaccatgcccagctaaatttgtattcttagtagagacggggtttcaccatattggccaagctggtctcaaacttctgatcacagatgatccatccgcctcggcctcccaaagtgctgggattataggcgtgagccactgcacccggcccaggtttcttacatgacttatttgaagaagacaggaacagacaacagatgatcatatcaaagaccaaaaacaacctaacatgacagttaaccttggctgcagaattcttattaattcctaatgagagtagactgatgataacacaattatgcctgaaattaatttgaatacataatttaatgtatttatagtttatcagcactataattttgttagttttaaatttttatttaaaaattatttagatatatcaggagtaaaaattgctgaacctgggagcacttagaattttgacaggttgcagtattcattaggatactgttagatgctgtgacaaataatccccacatttcagcagcttaatacagtaaaggcttcttaacagactagcgtaggtaactgttcccggccagtaagagtgggcagatctgctgcatgtggtcatttaggaatacaggctgatggaggctttcccactatcagtgtatgacttctgttattattctgggcactgatgttcatctcactgaaggggttaaagaatgaagaagcgtgcatgaaaggtttttttatttttcttcacattctctcgctgagaatgtaaccacagggctacagtaaactgcagggcagactagaaagtatagtccaactgagtgcccagaaagaagggaaatagagattttagtgaacactaagaagtttctgcctggtacacataatcactggactcatgggagggactgtgataccatgtctacatctaccaaagactttaaacatactgggatcttagtaggctcctgaatgggttacaaagttggttcttggatatagttagtatgaatttgtagaactagcaacagtggaatgctgttggatagtcaaattttcctaaggcatagatttattctaaattttacttgtattctaatctctggggtttatgtgactcattcacataaaaatagaaaaatcagtgtatatctgataattggcagtattcactgattttatccatataaaatatcttttatgatagaactaaagatgtgacatgtctttgacaaatcactgtgcctaattagaatattatgtttcaaatataacttaaaaatatataggtgggtacatatatgcattatgcatatatgtacattagtgtgtatacatgtctgtgtaccaatgtatataactaaaaaaatttctgtgcaggagttgaactacaacagtggagataaactcataatttgtttgctatatcatggactttggaatcatctgttttcagattttagtaatgctatttaataccgcataacccttaagcaaattactcaacctcattaagcctcagttatttcatgtatacaatatgaataacaatagctgtttatcaaactggattattataagtaataaaatgagattatgtatgtaacacacttcttacagaatctggcacatagtaaatgctcaatggcatatattatgcatattatatgtatagtaggaagcttgacgtggcctccagggcccctgtaacacacaaaccgatggtgcagatagacatgaaaatagataggaaatagctggctgctgagatttaatagcttcatttattcgttcctttgttcctagcagtaaatactgctcggcccttaatatgtacaagctctgagtgatggtgggcacaaaaattactaaagcagctttattgttgttaaagagtttgccacctgattatgagaactctagcagtcatgatacaaggtgacatttacacaagagaaataccacagagtgatatatggcttggaaataaggaaaaatatttcttggaagggagagatttgaagaaaatgttttggacatttagaattctgagtcttaaactggctcttaaatccagaatttcaagaaatggatagaggaaagagagacattcaattcagaaagaatagcatgagctgggaatcagggaaaagcacagaatatttttaggcaaactgaaaaataagcaaagggattactatgaagtcaaactgcaaagtcaagccattgatgtcatactaaagagttggacttcattctgtaaacaaggagaaggaaaggcaaggtgagaaataagagtgaggaaggcaagttctgagcagcagaatgacatctatgcccttgaacattttacttggcctttttctccattcattttcctcccctacacagcaaatggatggaactaagatcccttcctgccctcacagtctgggagaccactacatcctccagagtcactgtcattctccgtctgctggaacatcccgattctcattggtgtaacctctccaatgctatttacctaggctctacccagtactgttgtcatatcctttagactctacatttttcttctctgtgggcctgcttttcatcctctgcaataggaacatgagctgtatctcattcattcatagagaggtgtcttccaagcccagatctccagctcctgaaccactccatcagctatggtgagattctttcctggacctcttccagccttcacctcaattagctgggcatgggcagctaattcattcttgcactttctccatattattgcttctctcctaggttttttattgtggttttgtttttgttttttgttctttgacttggtacttccactgttctggaagaatgcaagcagaaatatcaaagaggaacaaataagaaagaattactggggaaaagtgatgcctttataagagtaaaacgttattcttcactataaagtataataagagggaaattttcttcttttacttgttagaattataaagatagttatatatgtacttttttcaaaaatcaagctgtgcgtgttagctcatgcctataatcctagcactttgggaggccaaggagggtgtgtcacttgaggtcaggggttcaagaccagcctggccaatatggcaaaaccccgtctctactaaaaatacaaaaattagctgggcgtagtggcgcatgcctgtaatcccagctactggggaggctgaggcaggagaatcgcttgaacccgggaggcagaggttgcaatgagctgagatcgtgccactgcactccagcctgggcaacagagtgagactcagtcaccaaaagaaaagaaaagaaaaaaaaatcagcactagcaatgacctggtttttacgtagcacttcctaatagcttgcttctctttttgtgaataggatttagcacagatatcagccagtatactaagacaattaaattttttttcagagtaaataaatatcgaatataccaaaatatcattcagtaatgcgattctgaaactaacgtcacaaattaggttcaataaaagaacaggatctttttgtctccaagtataacatgttatttctttcgtaagtcttctcaggacttaaaactgcttctttgaagtattctttaaagctttcagcctctcttgtcttgtcatggctacagtatttgttaattaatttaacaaacatttttggggtgctgaggtaaagaaatagattaacatccagactttaccattgaaaagtccacagaagaaggctaacatgtaaatacagaattgtatggaatgcagtagtgaagtaggaggtgagactcagctctggaggtggaacttggacactggaccaaattgcggactagctaaaacaggaccagagtggaagagttttccataagacacacctaccagtgtgccatgtcagcttaccattgctatggcaacacctggaagttaccactcttttgcatggcaataacctgacaacccagaagttaccacccttttcctagaaatttctgcataatctgccccttaatttgcatacaattgaaagtaggtatgaatgagtgcaggactgcctctgggctgctactcagagcacactgactatgggatggccctgctctgcaaggagcagtgcctctgctgctgctgtacattgctgcttcaataaaagttgcagtctaacatcaccagcttgcccttgaattctttcctggatgaagccaagaacgctcctgaactaagccccaatttgggggcttgcctgcactgtgtcagtaagtgatagaatagagctcagtatgtggtccaggagggagtgatcagtctgtctgtgatgtcccggggggaatcaatgagaaggcaattcacaaaattcacaaaagaggctttgaaaagtaaattagaatttgctgggtcaaaaatggagaaagtatggcccaggcataaggaatagaaagcgcaaagacaaagaaggaagttaggatattgtgcagaattaagtatggcttgtaaatgggtgtgaagtgatgggtagtgagagaagaaatgggagaattggcggggactagatgataaagggcttttcatgtccaacgaaagagtttagatattgactattgattcccatttgtttattgttcatctgtttttggttttgccttgtattcattattttggggacacttccccttttaggcatttgttgaaagaaagctcaagaccttctcccaagagaaagatgcacacataattacttttgcatacaaacacatccatgaacttggaacccaagtttcaaaccactgcaaaaagtcactatgagtcattgacaattattgagcagggaaaccacatattcaaaagtgtattgtcagccaggcacggtggctcacgcctgtaatcccagcactttgggaggccgagacaggcggatcacccgatgtcaggaattcgagaccagtctggccaacacggtgaaatcttttctctactaacaatacaaaaattagctgggcgtggtgggtgcctccaatcccagctactcaggaggttgaggcaggagaatcacttgatcccaggaggcagcggttgcagtgagctgagatcgtgccactgcactccagcctgggtgaccgagcaagactctatctcaaaaaaaataaataaataaaaagtgtattgtcggccacgcatggtggctcatgcttataatcccagcactttgggaggccgaggtgggcagatcacctgaggccaggagtttgagaccagcctggccaacgtgacaattccctgtctctattaaaaatacaaaaattagccggacttgttgtcaaacacctgtagtcccagctactcgggaggctgaggcatgagaattgctgaatcacttgaacctgggaggcggaggttgcagtgagctgagaccatgccactgcactctagcctgggtgacagagcagactctgtctgccagaaaaaaaaaaaagtgtatcttcagagtgaacccctggaggaatgtggagaatctattagaaggcatgggactcatgttagggaaaataggaatttattgcaatatttcagccaagaaatgaaggtctacgataaggtggcagcaaatacttgtttttaatttggctcctgctttgtgttgtctatctgcttattgaggagacagtactacaagagttaaatgtgtaaatggtgttattactgaagtagtgatttcagatataagtgcagcttcatgaggaaggatgaagcattcagaaggcatgatgggtttgaagtgtctatgggttagaccactgcaggtatggattagcaggtcaaaagagatgtcaaaaatgattttaaaaatattctgtttcaccatatagagatgggagatttaatagtgtgaggggatgagatcttagtggtgaaagagcgtaaattaagaagagttagaggcatcagactggaagattggtggagcttgttccctaaatcaggaatttaagccttaactctcttgttaactactgctctgtgttggtaccaggtttgtgaatgatcaagccactggcagaagattactttctaagagtgagagccttcccagggcttcgaatctggttaagtgaaagaatggagaagacggtaaattttaagaaaccatctgatggatgttattaggtcacaaagttgacattcatcaagctaataggcctatcgtttattgcaaactacctgaggtcgggtaaattattacctggattaaaaacctgatgctgacactggttaacacttgttacttacctttctgaacctaaatttctccatctgtaaaataaagtatacacacctactcaagagccaagcagagggaacgagataacctatataagccacctgtatagctgctgtgcaaagaagctgttgaataaggagttggggctggaaactctgacctacctctttaagttttgtaataaaccttccagttctaactagtcaatgaatgacccattttgattctcagacctgccactgcttctacctatctgaaaaaaacaaaacaaaacaggaatttgaaaatctgttatagaagtacattttatgtttagctatttttttttccttcctctatgatctgtaggtatggggtgaaatgattatattgtggtcactttagaacgttcactctctttgggaattaagtaattacaatttcttgaactaactgccttatcctacagcctagtacagtgacagctccaatgtagattcttgggcatgcgttgttttcttgagaacctttggaattctagccatatcttgctaatgatactcacttagcctcatcaaagtctcactgatctcttttctgtacttgagatattaaatgaaactctcttttgagaatgtttgaactggaaggggagacttcagaattcatttagtctacttcattttataggccacaaactgttcattttaagtttggtgtgctcaagacctgatcatattttcctctctattcttatatcagagttaaaagaatgttggctatgcacttcgcgcttacacattaatatagagcccagactgtagggagaattggagacttgaagtggggaaagaagattggggagcagaattacagtgtgttatatagtactgcagcccctcaagggagctgtaattaatgtgtgcaaggaaaacactgcaaggaaactaatttaaagaacatactgaaacaattttctcccagcttttcaaaacaaataaagaaaaaaagaagtcaccatcaagttttgaggaagcatgaagaattccagcagaaaggaaatttgttgagagcccgagaaggggctgctggttagaatgtaaagcctcttttaaacttaggcttcctccaccatttgtcagagctctgtggtccctgatccattcattaagcatttcacatgtatgtcactctcattatgggtcagagtttggttacaacccattgactgctctttctttgcatcttggagactcagttctttataccagttgatatcccgctagcctttcctttctgctttcctgcttatccttttttatcctaagcttgttaggtaacttcagagtttagaatgccttgtgatggtatgtcacttgatattgatgctgttaattccctagagcgaagtcttctcaactttttgtctacaacccataataagaatttcattttcaatccaacccagtacacacatacgtatgttattgaaaattaaagtttcatgaaaaaatactatgtgtgatatgctttgatacttttgcttctcttcaactctatctcatttatttaggaacaaaaaagcatcaaaactcattgaagagggccatttgattctcagttctaatcactatgagtatgcttcacacattgaggtcttcagatcatctgcaacaagtcacttgaaggtgtctggtcccaaaccctcccccagacctattgaatgagagtccgtattggcaacttctaggaatacatagtttaaccagttccttggtgtggttttaaaggttaaaaactagccccagatgttaacatcttaacattatctactcacaaaaagctatctcctttgctagttgatttttttttcttttgtatagctatcaatggctagagcaagggctctgatcactttttttcccccttctagagatagggtcttgctctgttgcccaggctagagtgcggtggcatgatcttggctcactgcagcctcggcctcttgagctcaggtgatcctcctgcctcagcctcccatgtagctggaactagagtgcatgccactatgttgaggtaacttttaaactttttttttaaagacaaggtctcactatgatgcccaggctggtctcttggctgcaagtgatccttctacctcagcttcccaaaatgctgggattgcagatgtgagccaccagacctggccagggttctgatctctgaattcccccttcttcttgctgatagagatcagctcaaaaggtactggaaaccttgaacatctagtaataccttactatatgccagatgctattctaagtgtactatatgaattaaacctcacaacaaacaatgttttgtatgtggtactattaacccattttacagatggggaaactgaggcatgacgaagtctaatttttctgaaattacattgcaagcaaatgacagcactgggattcagatctaggcattctgactctagagcccataatcttgaccaacaccctgtctaattcttcacttagcatgaaacgggagatagtgattagcccaatttgtcactgagagtcttaggtgatttcactaacctacagcgtgctacaggaagataaattagggggtcacttggtcccatctctactgcgtacccatcctcaactctagggatctgatgattactcttcctgcacttgtctgtctgtcttaagaaggagggagagtagcagctttctgccgttatctctagctttgactcattgtcacctgtgaggctaacatcactcaagcctataataaaattcaaatacttcaaatacagcaaacttaatacttagtgattattatatcatataacaaatgctcttatggatcattaaattcattatatctaaatattcaaatgattctgaccatacaaatgattctgacaagacaaagggataatttatttaaagtatatatttagagcaaaatggccttcagaagtcattactaaggaaactttgtcaagtttcctgttggggcatgccagctagtcttcaagggaattttctagtatttctcctaacacgtgccacagtaagagaccaataaagaagagttgaattctgaagaatgacttcagacagtaatcattggaggtgaattgcgactgttgaacaggcagagaaataaggaacagatatctggtcagagggttcaacatatgtgaagactaaggcatgaaggattatgtcgtcttcaagagctggaactgagagaagggaaaaaaaatcacacaatgagacaaggaaagactgagttgagttgagaagtttcttacaagcttacaaacttgggtctactcttctctgcactcagctgtgtatgaaagagacctgtcaggatctcactgtgggggctcatctatgccccaagtttaagatgcttgccccagatatactccagagttttagatggctttgggcttgcagttggctcatacacataaagtatccagaagtacttgccaggatgagtacacaaattctgtctctcttctatagccctgttcagttaggaataaagatgaaaatgagggttgtgatagctgtgtgtgtgtgcacatgcgtgtatgtgtgtatggctgtgtgagtgtgttagtgtatgcatccttgtgtgcatgcacttaaatatacttatatgtacatgatagaaagatccatgtttcagacaggagactaagatagaaaattaagtagaaattttataattttgtttctattatttacctgccatgtgtttgtctcagtgtttgaactgagaaataggcttttagttactatggatatgataatgttaaaacaaacatcatttatggattgtactttatatctcaaagttttccgatatccttatttatgtattattttaattttttcttaacctatgaaaaaagctgggtgccatggttcacacctgtaatcccaacacattggaaagccaaggcaggaggacttattgaggccaggagttcaagaccagcctgggcaacatagcaagactccgtctcaacaaaaaattaaaaaattagccaggtgtggtgacacatgcctgtagtcccagcaactcatgaggctgaggcaagaggatcatttgaccccaggagtttgaggctgtagtgtgctatgatcacatcactgcattcttgcctggatgacagagtgagaccctgtatcaaaacattttttaattaaaaaaattccaaattccatataagactatccctcagtgtgccttcccagctgccctaccccgaccctatgtcagactgtgatttgtagtatgtttcttcatatttattttgagtattaataatgtaatcttatcatattcaccctgataggacactgtagagtttgtttaatgaaccatcttgggggaagaattaaccaacaaccaagatttgaatacagcttggtcctgggcctccttgggccatagcgcaaggcagctaagtggtgctggaataatttctctttgtttggctgcagataccgcatactctaagcaatttgcagccttccttatataagaactgtttctgaaaggaaattccccaagtccagctcttctggttatttccgtttcagctctgaagcgcttactctttgtagctgaaatatggagaactattgtattttttggttccctaactcagaggaaacatgtgaggaatttgctgtaataactgatctgagttggagtgtttgattcctgacacagagtggaggacagcattgtgaggggacatttcattcaagattgttctgttaagcgggagggaggtgagctgctcacagtctatgtcaatgagaatttccctcaggatatttagtgtgtggtggtaatgcatatttaagcttacgtacaacaatgtttgcaaaatcccaaacttggaatagaactctagatcatagtggccaaagaaactgactttgcttgtaagcaagttggatcaagatctatatgagagctttggggctaagggaaataaagcattgtcccaagaaggaagactttgccttgacaaaacattctcttacaatgtgattctcctaagaaaccataaaagagcagttagggatccatccatgcattttaatatttgaagagtttcagactgactgcatgtttgacagctataggaattttatttttataagaatttatctataaaaataaaagtatatctactatctctaaatctatatatctgagttttaaaaatatagcttctctttagcttttgctagcatatgctgtcaaactccttcatgctgccagactcatccaaaaattaattcttctaatgcatgccatatttcatgttgttttggctgcttttgtacattctgaagaaaacagggaagataatggtttccttttccaatttaacatatacatgcgacagagaaatgtaaggatgttgcactcccagaggatcaaacctaaaatgacaatagattcgactgatttttttaaaaaagaatcctactttatgtaatctggacaataaggcacacatggttggattaaaaatattgtgtttttaagatctctttctaattcttactttataaccataaagaaatgaggctatgtgttgttgcaagaagtcttattgcaaacacatgcatgtgcatgtttgtgtgtgatttgtaaatttagctctagaaaggtgtaacaataaaatggaattgaatttagccatggctcttacgagcgtgagtaaagtatgcatgtggaaacctaagatgttaatgaaatcagcatagactttaatggcattctggtgtcttcaaaagatcgccaccaaataaagcttaatgtgtcaaaatggaaaccccaagtaagagaaatgtgggaagaagttcaaggaacagaaactgtttggggaagatgatttgaatgtcttccaaaaccttcgagaagcattaagctcaagctcagccctttatctttgacaaataccacactgtgtatctgcttgttatttcgtggtcctgttgctcctgtcagcttgttaaatggaactctggtttcagtcagatgaaaatgtggtaatctctgtgctttgcttgcctcggcgtccgaggagcggctgtgcccgactgtgtgaggccgcccagtgccaagggtaactactggcacctgcactgacagcaagcagtctgcagcaacagattgaaaatgttcttttcagatctttagattggaacttcagctttacttttaaaagtttcatgtccacagcacggttgacaaaataaattactaaaccaattgctttgggagcttccaagctgtgacattaaggtagctgcgagtcatcattcttgatgaaggagcagcttcagaaattgtgtgcatctgatggaggtttggcaaagtgtgtaagtctgcagacctatggtaaacaggtctcatttctaagcatttattttcagaaagggaaaaaaagagctgtccattctcaatttcggacttattttaaattactcacagggaaatgggtgccccatttaatggcattgtttattctcacagagaaatgtttgcagtgaaaatgcaaaataccatttcttttctctgctgaggctcctcatcctatggtgcccactttactctcccagcagagaatgcagaaaagcaccaaaggcagcatcatgaaacgcagagctgttaattcccaactccgtcagagttctgccctccttcccatttggggagctgaactgagccattagaactttccttttacactccctctagaatacaagtcctgacaaaattaaagggctttatacccctaaagcctcagaaattctacagggtacggtgagggtaggggtggggttgaagggatgggaaattcataggttaaaaacaaaaacttgggcgaaaaatccaggctctgccagttactatcagtgggacctcagctagttacttagacatctggccctctgcttacttgtttgtgaaatagaaatgatcatatctgcctcatgtgcttgttggaaacatataaaacaagataacttcaggagcaaagtgatttatatctgcaatgttgaaatggataaaaaataaaatagatatgtgagtgcatagatgataaatatgtcataaaacaaaggcagcaaagtgttagcaattgtaaggagagatgtgggtgtatgcatgtttgttatataattctctcaacttttctgtgcatttgaaagcatcttaatcaggaggaagcgatttagaagggcaaatcttttccatgtaagtataattcccgtattccctgcctctagttaaattccagatgtaggcacacggccatactgaacctcagcggagaatggaaaaaaatatatctttttcatggaccactgtcagcccagcaaaaatttagaaattttatttccaaggaagagagataatgggggaaaaataggcaccttgattggtcatgcaaacttaactctctgtggcacatactacatgccaaataacaaatggtgccattcctattaaggaagggaagtaatgcctgccccttttcttcctcggggtggagtgtcctgccaagtctcctgtcctttcctgggtgacccagggggcttattgcttccatccctgctcagatggttttgcatttccgtggcagcattttactccaccctccattgtgcatcctagattctctccagaacccctcccagcggaggcctgaggttagcttttgtgtgacatcgggtctctattcttccatgtatttaagctcaaaatgtttccttatggggaattttcttaaaagtcttcaatattgttaactctttgaaaccactgctgtgtgaaggcagctgattgttccattgtgggtcccataggaagaagttctatggttcctccttattgccttcttggtgggcatcccctatgaagcaatgcagggaggactccatgatagtgcaggcacttggcctttgatttccatccagggaactccctccacctgtctatgagagaactgtgttgtggaagctcaccgggaagcctatggaagaccaacacatagaatgggcagaggaagacaaacctccaaaacacaccgactacaacaaatacaggacaacaaacagcaataacattgagaataggaagctcatcatggaggagaaccaggacagacatccacgaaacccaaaagaagaaaaaaattcaagaaagactggtcaattgcatctaaagctactcagtgactaaaaaagataagggctggttgttgtcctttagttggtgatttaatgaagagccattccagggaagcagtgggggcgaaagtcaaatttcactaggatgaagatgacagacaggtaaaggagggaagagagtaactgtgtaggaattcagcagcaaaaaggagaggtttgtggtcacaagggtaatgcggtatacggaaggattttgttttgtttttgtttttgagacaggctctcgctctgttgcccaggctggagtgcaatggtgcaatcttggctcactttagcctcgaccaccccaggttcaggtgatcctcccatctcagcctcacgagtaggtggaactacaggcacacaccaccatccccagttaatttttgtattatttttgtagggatgggtttttgctatgttgcccaggctggtctcaaactcctgggttcaagcaatccacctgcctcggcctcccaaagtgctgggattacaggcatgagcaactggactagaaaaggtttttcatgatgagaaagacttgagtgtgatcaaatgctgataagaagggaccagagaagaggcagaagttaatgatccagaagagataggaagtagctgctagagagaggttgcttagaaagaaggtaaggtaccatccaggcaaccggaggagggattggccttggctagaaggattcctctcacattggataggagagtaggcatatgccatggtttgcatgtaggtcagctggcacagggtagaattgttactgctttatttagtaaatgtattcctctaaagtcatctgcaatcatatcacattagccctttttgtgacactgtgttttttttgtttttttttttttttctggagtttattagcaaatgagatttcattaccagctcctgctaaacaatgtctcctctatcccacacttacgcatttctgaaaccaaattcaagtcctaacatttattttcactgaaggtcatactattagatttagatcatgtttccaatttgtcaaaatctttttatattttaattgaactcacaacatatcactgatgtgtttcagtcttgtgttacccatacattaaacaatcagctgtatgtatgtcttcatttaaagaactgtctttagctctattttacttttatttcatcaactactctctcccccaaccccctgagactcaagggaagaagaattaaactgaatgctttgatgataactgataaagccttttgtcctaaggagtcctcccaaattggattaagaggattcatttgtgttttgcggtgtttatatttgaggaagacaaggatgtgaaaactctcactctctctgtgttcattctcacaaatagatggataccgtcacttttcaaggcttgtccatctggaatgcatcacaaacacattgctgggaaagtaaaagttccagaaagagcttcgttttctcctggaactgtgaaattgagtggcctagttctctcctccatgttgttgtaaattcacaggagtgtaatataagctacatttttaaccatttgggatagcttatgattgaataatgcttcctgccagacatgttttccctttatttatcacttacttttctctctaatttcagcaacagcaattgctgattatgaaaatgactctaattgttcaacctttcataaccacatttaactaccaaaaacaatctatctgctactttgaaaagcagttaaacaagcaagcaatttattcctgccttcttgcaagcaaccaggaacagggccgtgttctctttgttccttgtactgctttggaaccatgagtgcctctttctaacttgaatcaaaatctgcttgttcctaactgctgcctttgcaatcagtaatttgactcagtgggcttaattcaaagcaggcactcacattctttagactctttgtcagtcttccaggaaatcaagttgaacaacaaaaacaaacaaacaccggccctaaattaaaccagatagggaggaagaaacgtcaatgaatgatgaagcaaaataacaagagtcaggagaaataaatagaaaccatttcaaggctccacctgccgtggccccattagcccctcctttacctccctttcctagaggaaatcaaagcaactcctatgagcaatcattctagtcagcttccagacttccagagcctgctgaatctagctcctcccaccctgcccccagcaggtgagcacacctgggatcgctgcaggctgacattgcatcgtgatttctctgcatctcaaacagccggcagccctgcagaaacctcttccccttgctgagataaagtatatgaattaattcccttttgagttaacccgcgcctggttcctctcagtaactactggtactgggatagagaaggagttggcagctctcttagaaaaccagatagttttccttctttgtgatgtgctcaactttcttttgccccaggcttgaaaatacatgccctgtctttaactttccttgtgtgaataaccagggctcaacaaggtaatagttgggtaaaattgttacagaggcattccaaatctaaaacagagatgttccctggtaaatctgatcttatctaatgtttcctaaatgtaaataggccagagggtgttcctttctgaataccctttaaccagatacgttggaaatctattatgtattgtttattttaatttcgttaaaaatgttctcaggtttgaagtgtgatttctttgcgctctcatttaattttttcttctttttagaataaattattgaagacagaactttttcaaggtatttatagatatatctgaggtattcatgatttatataaagtgtacaggtgaagagttaccttctagtatagaccttaagcatgttatcatagctatgtgcaataaaggtgatattaagtttatttaatattgctaccatttcttctaatccttgaattttctctggaataaagctgcagtgtaatgaatgagattaataaaaatagaagggttatgtgtaactggaaagtggggaaatcactttgttcatttatggtagaatatttaattgaggttcctccacacattcacattaggaaagtcacttggtctttaggtttaaaaataataatttaacttcaaacaatccttaactcttcaaaatgtttaaggaattaagggcaaaaaaacctagatatgttccacaactttggtgacaataaacatgaaatatggaatccaatttttgaagaatatagccagtcatccctttaaaccacaaccatttttacataatgtatagaattaaaaaacactggtgaatcaactctgtgctgtgatgtgtattaccagtctattggatctgtgtattgggtgtttggggagcatatcgacattatgggcaatgcagttatttcccatgacattttaaaaatccatttctgtattacatattccaatctagtgaaaattacatctactctatttagatttggcatccaacacttgttggccatggcatgtgatgtaatttaaactgctcatgtacatttaggaggagattgatttatagccgtctttgcctgagacaagcacaatttaaactaattcttattgatccagaaaaatttaagattggttttgaaaattctcaagaatagagagttttggatacatttgagccattttgctaagcataattgtcatgtatataaaagcatgaaactgttaacacttatccttctttgccttggcgtctttgttagtcattgcatacctaaaggctaatttctgctccagatgctgtgatgtctgcccagctggcccagctgttaggatatatgctatttgcaaatggcagcataaatagcatatccagaatattttgcaggctggggctttgccattaaaggctaagatatatttagtgtcagggataattgtttggtatattgtaaccagaatggagctgacagaatgccaataggtctagcagagtgactcataaaatagtccaatgaagaaattatttactcaaacatttccatattagcatgtaatgtgcactacaaattggatttcctgtgaatgtacaatcattgtgtgcagagtttgtaaaggtgtctgatattgcaaatgtatcatttaagaagaccaaattgcatcagattctctaaccaagtctcttttagcatctaaaggagtagttcttctaattattttctgattgcaggatagccttgttggaaatgctcaacttggagttgggaagaactgggttctaaattctagcaatttctatgatgacccggtgacattaaacaaatctcccatctttcctaatcttttctatttctggtttctcagtttataatattgaagatacctgcattttaactgtttttgtgttttgtcaaagaaaggtgctttatacatagtctaggtctatttgcttttcaacttttccccaagatcttctgtctttagatgtatagttttttcctgcttttttttgtatgtatctgtttttagctacctaggtattcataaggtgattagaatgcaacggttacatggcttcttaaccacccctaatttagacaagcatttctaagtaggacttctaatattcaaggcaaagaatattctagaactcagaaagtttgcttttatattccaaattattttattgttacatctaaaaaacagtggtgtctgcccttatctgattctggatgctgctaaaatatactgctggacagaaatttgattcattaacttttttggatcttaaccttttaaaggtgcagtatgtccattgaatctacagctttaccgaagcccttgacaaggcactggtatccacaaggaaaggcgaatgttgatatacagtgactggaactgatttttatcaatgtggatggtaccagactaagaaaattatccatctgggccatgcaatctgtctttccagaaaatcactgaactacatatctaataacacagtcagtgagataatttccttttattgagtaatttcctcatttggtagggattttaaaagcctaggggcattttgagcatatggttcaggaacattattttaaaatgtgaattatcaatagaatttcaatacaatcaaagtaaaataacttacttcctaagtgttacaaatataagcaggatatttctacaaaggctgttgcttttgagtcagagttaggagctggagattaaaagcttttcttcagcattgttagagcagggtgcatcattctcaattgccagcggtcaattctctccagacacagttgatcgctcctcccacatgaaacaatttcttcacttgaattcctccaacctcgctggctgtttcttcccaatctcttttgctggttcccagttgtgtcactccccactcattactgaagagccctaaagttcagtccttgaactccttacctatcaacaatcatccttgcttatctcagctagattccgggctttgtatactgatcaattacaaatttgtatctccagcccagacttgtctgctgaatttccaacttgtacattctgctgcctactcagtatctccacttggatttctagtaaacatctaaaatgtgtcatctccaaaactgactttctaatttatcacaacacttactttcaaaaaatacatgcacaccttctgtagtttcctgcctcttaggtcacagcaactctattcttccgcagttcaagccaaaattttcggtgatctccttgactaccctgtttctcttactttctctataaagtctcttagagaaaatcttgttagtgctaccttcaaaatatcatggtgtgagttcaagcaatgtactttttcttttccttgcatacttactccagtggtctaccttgttgaaatatctaagataggtgacggcacgggcctccagggccactcttaattataggccttgtgcctcagggtttcctaggctggcggtgcgttgggggaggggggggcggcggggcggggagggggtggagggttgggaaagagaagaacctccataaaggtagaaaatgattcatcttatatttctctgcaactttttcaccagtgctcagactgaaaaaagatgatgactggtggtcattaaaaagttaattttccgtttacgagcaaacctttttgggtctttgaggtcatatatagaccacgataagcaaattatcttatagattgtatctattttcagctgttataaaagtgttttaaattagaccaaggctatttttagtttttggaaagttagcttataacaaaaatcttgctttttcataaaaaagttaagcatattaaaaaacagaaaaataataccatatggaaatagagttggctgggtgtggtggcttgtgcctgtaattccagcactttgggaggctgaggcgggtgcatcacttgaggccaagcctggccaaacattgtctctactaaaaatacagaaattagcctggcgtggtggtacacgtctgtaatcccagctactgggaaggatgaggcataagaattgcttgaacctggaaggtggaggttgctgtgagccgaaatcatgccactgcactctagcctgggtgacagagcaatactctgcctcaaaaaataaaaataaaaaataaaaaataaaaaaaaagaaagaaagtagagttaaataccacagatataggaagtctagacaatatcaaaggaataagatgatgcgattttgaactaggaaagggtagatgagagcatttatttatctaagatcttttgtatagataagcagagtaaacaatcacccttatatatgtagctctttagtctgcaccaagacactgtccaagtgggaaacagggagactcaagcaaatatcctgttggtgttgtctctttatcctactttaaaaaacactaggatctggactgtgaaatctgagagcagtctctgaagagacacagatgaaagtgaaaatgctgctctattttctatcacccaatttcttgtcacagttactatcattaaaacatattaaaaacatggaaagggctgaaagggaaggtacaaatctaataagatttgtaatataaataaccctcagtatgtttttattcccgattgccttgcctccttaggttctgatatttaaagattgggttaaatatctccttttctgtgtataaggtattggcacaatttttttttttcttattcacttctcctcatcaggcaggtggttgaaactacgtaatgcttgtcttttatggccattttcagagagaatcattttcaccaggggacgatctcctgtgttttttgttttgttttgtttttttacccttttctctcaatctcatctcaaagataaatgggagttaacaactctggttaagattatgctcattttcaaatgctttctttatactttttagccttccataatataaataatattgtggtgctattgtaataacaaatccaggaaaaagaaacaccttactgtcccagactgatcttagtttcagaaaactctgccctcagatagtggttatacataatacttatccactgcacccaatcaccagggtgctattttgtaatgagaagtccagagaattttctgaaggcatgacttaatcatcaaattaccagattttaaaaggctgttacatgtttctatctctgttcattgattctgcatgagtcatcatccttggaaaggaaaatgacatttcccccattggaaattggcagaatacatacagaaggcttaacttctaaagttctctgcatatggggctcttgagctgttatatcctctagaaaccttggtcattcagatatttgtgatttgtatagcgtagaatgtacttcaccaatcttccttctccacagagtatgacaacatctctactgcgttcatatgacctttttatgtttattgtacaacagtatttgcattcgaattggtaccttaaattataatctctaaacaagatttcttggtgcgtttcattggaacagattcaaagaaagagatacaggataggattatcaatggcctggctcgcagggacttatatagtatgttcctgacctctctggtggagtttaatggaaatggctttggagacaggaaatactgggttccagccttgtctctgtggcatacttactccatgaatttaggcaagttatttgtctcttcacatggtcattgagaaaatgaaataacaaatctgtatcagtaaggcacctgggacaggtagcctcttgatggatattacttttctttttcccaggctgtcctgttgccatcttcacacttttgcctaaatgcagagtttgtttgtttgtttgtttgttttttaatagctagggcattatttaaacatttttgttaattgagaaatatctgaagcagtttttaaaaaaatagggagcactggccaggtgcggtggctcacacctgtaatcccagcactttaggaggctgaggcaggtggatcatgaggtcaagagatcaagaccatcctggccaacatggtgaatccccgtctctactaaaaaatacaaaaaattagctgggtatggtggtgcgtgcctgtagtcccagctactcaggagactgaggcaggagaatcacttgaaccctggaggcagaggttgcagtgagccgagattgcatcactgcactccagcctggtgacagagcaagactccgtcaaaaaaaaaaaaaggaagcattatgtttgagtgctcaagcagttttagtatatgaacaagtcaaactcaatatagtcatgccagagacattagctgcatgtgtgggaatgagagtggagtgtcacaggaggctgaaatcagagccaacccagagtgttgaacatgatttcaactcttccaattgacatgatattttttccctttttgaggaggaaaaaatgctctagcttgctatatcttgtgtttgccacctgtatagtgggctgcaaaagcagggggtgtgggagccaaaggcaatggctaattagaaaagtgtatttgaaatgtcttgaatgcttcaataaataaaattaactgacactatagccttaccaaattgatgataattatattgggtttcctgtgattccagtgaatgtgggttttaactaaatacatccaccttattgtcagttcatccttgcattattgtgggagaaaaacttccagtgttcaatttcttgtattgtcagtcatacaacttaaatttttaatttcagtataatcttgccttctcctgcctatttacaacttcctgaaaacatatcgagtgtggatcccgtacgtaagtgagattgtcttcgctaagagcttcttgcaatcacaggaaaaggggaaaaaatgttgttacagctgatcattgccagaaggtgaaagttcaagaagtagagaaaaagaagattgtagcatgtaatcagagttcttggttgcatgctacagaatccattctatgtagtttaatctgggaacaatgcagccagggatgacacctcaaaaatgcccagcctcaacactagactgtcctagcagaaacactactgctgctattacccacatattgtcacttacgacattaaagtccaggggccagaaactctggcacagctcctcaagagaaccagatactctgccgccatgctttctcccaaggagccattctttcatgcagctaatagtttgtgttgcttgctttcaccttcaacattcacacatttgggttggcttggtggctccacattcattacaggctagttcctggggaacctgggaaatgtagttttagctttttgtcttctatagtatagcaatcaaagtaagctagaagggtgttggaatagatgctggttgaactgcttgttagtatctgctcctgatggaattgaactgaaagatgttacaggtgtttactcctcagtggtccatgttggaatgtcactttctgttttcagaagcttattactatatgtaaaaaacaacaacgacaaaaactattgcttttttcttctgcacttgatcaaaattctgtttaggtatccacattttaccattatatgtattcaacagtgcagaatgctggtgaccagttttacttgttaaccaaggcatggctgagtcctcagagacttttaatttgactccattcttaggatgatgtgctgcatttctgcaatggcacccactggcgtgcaaaagaaaaactggattttccaggttaagcagaaacatggacgccatactaaactctgaacagacacattcatgcatcttcttgtccaccagctgcaggaactcaggggttttactacttcatccttttatgcccaacaccccatcagctccagaggcagcttggctgcatgccaatgtcagtgtagaattattctatcctcacgggttcatatcgtttgtcaagtcaccaaacactcagaaatattgatgagtcatctacctagatgtttttgttcatttgtaagactaacttgtacagagttttgagttttcttaagattttagagatataaataaaccatcaattaaggatttagaattcactaaaaataaaagctttaaaaggttgtgatttgaaagatatgcttagtgctggaaggtgtttaagggtcaactattctgacttagaggaagataaagcaagtagtaggtaagggatttgccaaaaaattacatagctggttaatatcaatgctgagattgaaactcaagtccactgcctgctggacggggaatgtttcaaaggtgcttgataccaaagcataggtcctaagtcctcatcatcctgtatgaagcatgcacatgatgccacatggtagctgaggccatgctctgaaggatgtctacatgaaacaaccatgaaaaatcatataatatgggttacattcccaacccacatcttctcaaattcactagaaggtgtccattttgttgacaaaactgaatttgaagtatatgcaataaatgacaccaacattatttttatggctaaaagtacttgaagagcacgcttcctgtttttaatcactagcgttcctttagctgcagtcagccatatttgttgcttacattataagcatatgtttgtttggtttgctctaattctttgccctcttaagggaaaagcaagggaggtttatgaagggccttaaaatgagagaaactaattaattgctgactttttatatttatcagcaaaggaaaacatttctctactctcataacgcttctgacaccaaatgtgcggattttctacacattacaattctcataccaactaggtgtcctataatttaattcagttctggctctggagttagcacagaccccacagtttaaggaatcagtcccacagactgctccacttcagatggtgatcataagcctgggctccctatacttcttactgacaggctataaatcagaggtttctcacgattccctcaagttcaataatttgttagaatggctcacaggactcaggaagacacttgactcaccattgtcagttgattataaagcacacaactcagaaacagccaaatgaaagaacggggtatgtgggaagggccgtggggaatccacgtcctcgctgggctcgccaccctccccgcacctccatgtgttcaccaacctagcagctcttggaacccctttatttggagtttttgtgggggttccattacataggtgtgattgatgacatcattggccactggtgactggactcatctccaacccctctccccatcctggaggagggagagtggagctgaaaattccaaccttttagtcacatggttggttcctctggcaaggggctcccatcctctgagtcaccttattaacgtaaactcgggtatgcttgaaaggggcttattaagagtaacagaagatgctcttctcacccctatcactcggataattccaagagtttcagaagctcttctgtcatgaacagaaaaattctcctgtcaccccatcacttagaaatttacatgagtttgctgggcgcggtatctcacgcctgtaatcccagcactttgggaggccgacacaggcggatcatgaggtcaggagatcgagaccatcctggctaacacggtgaaaccccgtctctactaaaaatacaaaaaaattagccgggcgtggtggcgggagcctgtagtcccagctactcatgaggctgaggcaggagaatggtgtgaacccgggaggcggagcttgcagtgagccgagattgcgccactgcactccagcctgggtgagagagtgagactccgtctcaaaaaaaaaaaaagaaatgtacatgagttttgtgtcaggaaccagggcagaggccaaatgtatattggtattaagtcacaatcaatacgtactttttaaaaatgtaaatttatgtataaatgaaaataactacatttcttgctttcacaaaccttgttgtcaatgtggaatgatttctcaccagtttaaacacagttgagttcttacataaggaaaaatgggaagcagaggttaaaacatgtatattaactgtggtgttctgagtgtagactctggagttcaactatccaggtttgacttcttccatttctgagctatgaggtctcaggcaagctacttgccttctctttactttagcatttcatctataaatttagtatgtcacaggcacctaacttttagcattgttgggagattgagatggtgcatgtcaaatgcctgccatgacaccttctcagagctggtactcaataacagtattaaacattttgtctgggcacagtggctcatgcctgtaatcccagcactttgccaggctgacgccagaggatcacttcaggccaggagttcaagccagcctgggaaacatagggagagcgtgtcttaaaaaaaaaaaaaaaaaaaaaaaagtctatctcctgttcccatgttttcattcattttttaagtaatttttttttaattatggcaatttttttaagtaaaaaaaaaaaaaaacaaaagccaggcacagtggctcacatctgtagtcctagcttcccaggaggctgaggcaggaggatcacttgagcctaggaattcaaggccagcctgggcaacatagtgagaccccatccttaaaaatatatttttttaatgtatggagtacctaccaagtcccaggcactactgtaggcactgaaggcacagaattgatagatgaggtccttattctagtagaactatgaaaattttcttattcagaataaaatttaggaagcaaccagaaaacacatatagacactgtcatgccaggcccctattgattccaacagggatggctcggtaagagacccggagccagtgaatgagacatagggtttatagaagacttatatacagagcattctcggaatgggaggctggataggaaaaccactaccatttgtaaaaagcatgcatattatatagcatgttcacttagcaatcttcaccaagcaaccttcctttaacccaaaacaaaaggcccctgatccctgtatagtctgcattccaaatgataggccaggggttcagatgttcttcatagatgaggagtgaatctccagcttgaccactcctggattcttctcagggtatgcttgagttattgctgttaggtgcatctgccatacagacccatagcatgattttctctaagaagctttgtgatgcatattggtaaacgttgtaaagttttaagtggacttcaattaatttttaaaaagtaaacatacatgaataaatatcatccctcccacatagctttaaattacttctgatatgtccccgatttaaaaaaacaaagggtcagtcaggtgtggtggcttacacctggcgtgtaatccagtgctttgggaggatgaggtgggaagatcgcttgaggctatgagttcaagactagtctgggcaacataacaagacccccatctcttaaaaaaaaaaaattagctgggtgtgatgacacatgcacatgcctgtaatcccagctacttgggaggctgagctgggaggatcacttcagcccaggagttcgagactgcagtgagctatgaatgtaccactgcactctagcctgagcaacagagtgagaccctgtttcttaaaaaaaaaaaaaaaaaaaaaatccaccaagcaaaccagcaaaaagttaataatctagggctttacctacctggtacgaaataaaggaagcataatagagaaagttctcagaactggctgtgcccctggttccgggtgggcaaactccctattacttatataaccttcctcacttgcttgagagaagggagttgctgggagttcttgttagaggttttgcagaaattgcccacagctgagagtttctaatttagagtcattgttccagtgaatggaaatgagctgaaggaacagccgtgacactcactttcagctaagcaaggagacctgccctgggaacaggcggagtgaaaagcccagtcctgagcattacccagctcctttgaccttttctctccagagctacatctctctttccttcccttctcctgcatcacaaaaaaacctgttaaaagttatccatctttcttctttgagcatgagagtccatacaaacacttccatttcatgtatacccaaattccaagtgatcctgaaggaacatttaaagttgaagttttttgttttgttttgtttttctgagatagagtctcaatctgttgcctaggctggagtgcagtcacacaatctcagctcaccacaacctccgcctcacaggttcaagtgattctcctgcctcagcctcccaagtagctgggactacaggtgcgtgtgccaccatgcctggctaatttttgtatttttagtagagatgaggtttcactatgttggccaggctagtctcaaactcctgacctcctgatctgcccgcctcggcctcccaaagtgctgggattacagggatgaaccacggcgcccagcaaactcatgtaaagttgaagtttaagtggcagagagaatgctgtgctgatgaaatttggataattatataactaatttctggcaacattgtaatatgatgccagggtgtcttcttttcttttatatagacaaaatatattgttgagatttttaaataagtattaacgaaatagaaagaatagtcttcagagaaaaactcttttaacgtaaccttttttttttaaccacttccatgagaaattgtcagggttgtcaacatcatgcttcatggcttttgaaatctggactttaacacaaaatccctttatacatactggaaattattgtgctttttggataagattgaggtcttattcaaaattcttacaatcatagaaacagataacacactatcattatctgtgacaagaggataggaatgggaaggataattaaaatgctagcattgggtctttcaaattatgttctctgaatcttagcacagaaataaaatattagaattttaacctctaagatatatttttaaagtttttggctgggtgttgtggctcaggcctataatcccagcactttgggaagccaaggtgggtagatcacttgagtccaagagtttgagaccagcctgggcaacatagagagaactcagctctagaaaagataagagatgagatgggaagatcgcttgaggccaggagattgaggctgcagtgagccatgatcatgccactgcactcccacctgggtgacagagtgagaccctgactcaaaaaaataaaaaaaaaaagtaaagtttctattggagtaagtcattcagtgtctcaaacttttgttttaatgccataattcaactttaatggctctttgtagactaaaattaatatctgcagaaaatagccatttaaaataacttactatttatagaaaaataacataaggcacttgtcatttattgaaggtaatggtttactctgaaatttgtacagtgaggattggaatttttatttgtatttatttaaaacatacttattttgttctagggatgctctttataggtgataactcattcaatcatcattacctatgagaaaggtattattattatttttttactttacagttaagaaagatcaggaactcagaaaggttaaataacttgtcaagttgcacaactgataagtaggtagaaccgggacttaattccaggccatctggccctcagagttcctgcttatgcccccatgcactggtgcctcttgcagcacgtcaaagagtttaccaagacgaatgagctcagaaatttgaacatctaaccagccatctgtctgcccttctggcccttccaggatatcaatgtttcttataaaatggacataaattcctgatgagacaagatttgtatggagagccatgggactatcacccctattctagacacataataaagcaacagaagaaggccacattctcgttaagtgagagcataatgagagcagcagcatagctgctcttttttacaagcagctatgaagctgtaatcctacgcaccttcaacccgtctccccatgagatcagaccatcaattgtggtctcagcaaaaacaacacatctaaatgagaaaaaaaatcagaaaaggtttaacaggctggatatggtgggtcatgcctataatcccagcactttgggaggctgaggcgggtcgatcacttgaggttaggagttcgagaccagcctggccaacatggtgaaaccttgtctctatcaaaaatacaaaaattagctgggtgtggtggcatgtgcctgtaatcccagctactcaggaggctgaggcaggtgaattgcttgaactcaggaggtggaggttgcagtgaccaagattgtaccactgcactctagcctgggcaacagagtgagcctctgtctccaaaaaacaagataataataaaataaaataataaaagaaaaggtttaacaaagggactctctggaggaggagatttatgtagagggactgtgacctttcagttgaagacagacctccaatagagagggctgagggaataagtacccagagtgctctcttttctcttcctccactctcctgaggggactcttccttggcctactggataccagagggtgagggacaccattgatgaaatccataaagatcagcctccagccatggagcagggtgaaaaatggggatcgaactgagtggaccaaagacagatatttgacacagttttacaaatcctatatttcacacacacacacacacacacacacgcacgcacaccttccttcagaacaagtgtttctattcttccactgaaaattttaaatctttgttcattaactcaggttcttcaataccttagaaagattctaaatgtatcttgtcttttttggcacattgctcaagcctgttaaggtcttcttgaattctggttccatcattcaacacagtggtcctcaagtctagtagtagcatctcagaatatgctggaaaggtctttagagtactaatttttcaggctaccccagagacttagtgaatctcaggtaaggctcaggaatgcctatgtgtttgttgttgtatttagtttcccaggcaaccctaatgtagccagtgaaaactcaggcatctgggatcccttgatataaccacttcaacacaaggcatgtgctggacacctttttagaatttatctttgtccagaaacgcagagatcttccactgggactagatttgggagtgtagactggaatgctggaattgcctagggaacttttctgaacttcatcacctcttcctgggtggccaagcctccttctggaatcctctcactaccacagtgaactgctatcattgaagggagcacgttaaatccttccagtcttctagtgcaaaaatgttctaagactcctagatttaccagtaatcttctttacaaatgattgtttgacttttgcattaattttactatttgtattttctctgtgttgtgctaagaatattataatagactctgaaaatattttactggatttgaatcatgtccatcaaacctattcacccatccttccttcttttcttttttccataagtactaattgttctaggagccaagcacattccaggccttaggaataccataaggtacaagacagctgaggtctttgccctcttgtgcttacatttcagtgggggatgcagactttcaaaaagtaaataaaacatctgcaaaaaaaatgttaatatgagtatgtggtataaagaaaacaaatggtactgagcatggagacaattgcagggagggcctctcgaagggtaacataggagttgaaaactgaaggtcaagaaggagccagccttgcagagatctgggagaagagcatttgaggcagaaggaacaagtgaaaatgccctgagataagaaagaaactttagaattcaagtaatacagtgaggtcatttcagagtgacttgtccttattgattgtgtgctgaccagcaaagagatatttccatctgctctaggtcccataaactacctcttcaaatacctgctgaaaatgtttctatgtccccacaagcttttagccagcccatctttatatatgcctataatggattagaataaaataaatacatgaaaactgctgataaaccaaagctttactagtaaatctttgtagctctctctcctccaggagctgatccaggttatatgggatctgaagcttttacaattttaaaggtcctttccaaaaaaaaaaaatgcaaataaaatgttgcaatggccccactcatgcatgtgaagggcccagaaacttcaggctaattggctccatggtaaattcacctgtgcctggcacttgtctttagataagagactgagaatgaccaaaaatcaaaatccacaaagttgtaagtaggaggcaatgaaaaagcatgtatttctgctaatagccagagaaaccatgctcttctccatgtcagctgatgaggagagggagaggaaaacttgtttagatttaactatgcagttattatggcaatcactaagttaggagcaggagaaaataaacaaaagaaaaagaaggagcttgttattttgtaaggaagctgctaaaggaagctttaggcaagtaaaggaaggtaggttaggtaaatacattggaaacaatgtggaatggagactgctgaaagaggtagaggtagaagaaggtggtcgggaccaagccagtgtgggaggtcaggagagtgtggaggttgttttggtggatgcagaggagtaggactctgacatggaaaggtggaggtaggggtggaggtagcgtaggccgagatgggaaggtctgggagtgtgagtggaggcagttggtgaaggcagtagaagaggtggtagggggtgagtgtgcaggcagaggaggaaaggtagtggtggtggtggttgtagggcagagtttggttccatttgggcctgtggagatccattcttcttgccttgtgtgaaaggttttttttcataattacttctgagtctcaaaaaatattcttgtgaataatggagaatcagtcatcttttacattatcaaaacaaagacttatcttatcacaaaatgctcagactgtggtccagtttgggtccagtattttgacatttgctttccaggcaataataatgaggtatatttatttttttgaggtaacatgtgataatgtaatacattcatgtaatttgtaaagaacaaatcagtgtaattgggatatatatatgtatatataatcttaaatatttgtctttttaatgctagaaacattcaaattattcttttaactattttgaaatatacaatagattattgtaaattatggtcaccctgttgatctatgaaacacaaggtcttatttcttctatgaaactgtatatttgtacccattaatcaggctctattcatcctcccacccccttacccttcctagcctctagtaaccaccaatctactctatctttatgcagtccactttttaggtcccatgtacgattgatgtgatatttgtctttctgtgcttggcttatttcacttaacacaataaccaccagttccatccatgttgctgcagataacaagtttttttttttttttttttcattcttttttattggatgactcatgttcaattgcatacatataccatattttctttatccagtcattcattgatggatactttggttgattccatattttggctcttgtgaatactgctgcaatgaacgtgggagtgcagatacctctttattttattgatttcctttcttttggatatatacccagtattggaattactgaatcacatagtggttctattgttagttttttcaggaacctccatattactttccagagtggctgtaccgatttacatttctgccaacaatgtataagggtttccctttctttagatccttgtcagcatctattatccttgtctttttgataacagccattttaactggggtgagaggatatctcattgtggttttgatttttatttctctgatgattagtcatattgaacatttgaaaagtgctcgattgtgaccttgaataaaacctaaaccaggctgggcacagtggctcacacctgtaattccagcattttgggaggccgagatgggccaatcacttgaggccaggagttcaagaccagcctggccaatatggtaaaacctcagctctactaaaaaaacaaaaattagccaggcttgatggcaggtgcctgtaatcccagctactaaggaggctggggcgggaggatcacctgagcccaagaggcggagtttgcagtgagccaagatcatgccactgcactccagcgtgggtgactgtctcaaaacaaaacaaaacaaaacaaaacctaaaccaaacagaatttgtggtcagggagagagatttcttctggaaaatattcttccttccatgatttgtaacaaatcaaatggccatttatgtgtcttcttttgagaagtgtctattcagatatttttttcattgttaaatcagattttttttttttttttttttttactattgagttgtttgagcttcttacatactctggttatcaatcccttgtcaaagggatactctgcacatatttctcccatgctatggactccaacttctctttggggttgtttcctttgctgtgcagaatctttagcttgacgtaatctcatttaccaagttttgcttttgctgcctctgcttttgaaatcttatgcaaaaagtctttgctttggcctggagcatctccccaaagttttcttctagtacttttatagtttcaggtcttatatttaagtctgtaatccatttgatttgatttttatatatggtgagagatagggatctagtttcatttttctacaaatggttacccaattttcctagcaccttcattgaagagactcctttcctcattgtatgttcttggtggctttgtcaaaaatgagttggctataaatgtgcagattcatatctgggctttctattctgttccattgtactatgtgtctctttttgtcccagcatcatgctgatttggttactatagctctgcagtatattttaaagttgggtagtgtgatgcttccagcattgttctttttgctcaggattactttggctatttggggtgttttgtggttccatatcaattttaggattgctttttctatatctgtgaaaatgccatggtattttgatagggattgcattgaatctgtaaaattgctttggataatattatcattttagctatattaattcttccaatccatgagcattaattatttttatatttaattctttcccttttttggtgttctctacaatttctttcatcagtgttttatagttttctttgtatagatctttcacttctttgattaaattgattcctaagtattttatattctttgtagctattatagatgggattacattcatgaattttttcagattattcactgctggtatatataaatgctgataatttttatgtgttgattttttatcctacaactttacggaatttgtttatcagttctaacagttttttggtagaatcttaaggttttcctaagtacaagatcatgtcgtctgtatataggaaatcctaaatcaaaaacctaaacctgaacaaggctaatttgacttttttctttccagtttggagcctgggcaacatatggaaaccctcatctctgcaaaaaaaaaaaaaaaaaaaaaaaaaaaattaaaaagttagctgggtgtggtggcacatgcctgtagtcccaactagtccagaagctaagttgggaggaacacctgagcccaggaggtgaaggctgcagcgagaggtgatcgcaccactgcactactgcctgagcaacagagtgacaccctgtctcaaaaacaaaacaaaacaatcatacacgcaaacacaaaccaatctggatgtcttttatttctttatcttgcccaagtgctttggccatgacttctagtattattttgaataaaagtagtaaaagtgagcatccttgtcttgttctagatcttagaggaaaggcattcaatttttccatgttcagtacaatggtagctgtgggttttgtcatatagcctttattattttgaggtatgttccttctgtatgcagtttttggagcattttatcataaaaggatgttgaattttctaaaatgctttttcagcatgtatcaaaatgatcatttttttcccttggtgctgttaatgtgatatatcatgtttattgatttttgtgtgttgaaccatacctgcatccctgggatgaattccacctgatcttggtgaattatcttttcaatgtgttgtaaaatttggtttgcttgtattctgttgagaatttttgtatctatgttaatcagtgacattggcctgtagttttctttgtttgttgtgtctttgcctggttttggtatcaagttaatgctatccttgtagaaggagtttggatatattccctcttctttaatttttttgaagaatttgagtagaattagtgttagttctttacatgtttgttagaattcagctgtgaagccatcagatcctgggcttttctttgataggagatttttattacagcttcagtctcattactcattattagtttgttgaggttttttatttcttcatagttcaattttagtagattgtatgtgtctagggatttatccatttcttctaggttttccaatttgttggggtatagtttgtagtaatccataataattctgtagtctcagttgctatgtctcctttttcctttatgattttatttattgggtcttctctctttttttcttagtacagagcagagtttcctggggaggggttggtagtcctgcctcacctctttttctctggctgccctctggggtatttcttcctccaggcactactgatgcttcctgtggcttgaaacagggacaggtctcctgctagggaacccaatatggtaaggaagttggttgtcctccttgatctcacttttcccagtgtagaaactgtgaattagtggaaaatttctgcacacttgatgccaggcagatggtgggaagaggtgtcacagatatgtaagtccaattctcttactgtcatcttggagttttttcacttctctgtagccctggaaactgtctcctcatattttagttctagggtattgctggtaaaaaactaggtgctatatatttggttttgtttttctattgggggaaatgaagccaccttgtttctaagccgcattttagaaccagatgtcaaagaactttttagttagcatcaagattctgaatttctttctctctctcttttttttttcttttttgtttgtcagggtctcactgtatcactcaggctggaatgtagtggtgcgaccatggctcactgcagcctcgactgcctgggtttcagcaatccttccatctcagcctccttagtatttgggaccactgacgtgtgccaccatgcccggctattttttttttttttctttttagtatttttgctacaggtggggtttcgccgtgttgttcaggctggtctcaaacacctgaactcaagcaaccaacctgcctcagcatcccgaagtgctgggattacaggtgcatgcccctgcacccagccaacattctgatcttctgtagacactctaacaatgtgttgctttttcttgcttttaaaacctgccaggtggtcacttattatctatcattaaatatctgatatcaatcattttgtgcttttaaaatatgttcctcatatatattaaatgtcatatatgaattaaagttacttttcttaaaagtcaacttgttaggacatatatgtaattctgaaatagaataataattgctgccctccttctcctcctccttcttttcttcctgttctttctccttatcctcctttttttttctccttctccttcttcttctcctcttcctcctttctcctcctcctcttcctcctttctcctcctcctttttcttcttcagatatttgggtgtgctccacggtgtatcaccttaataaaacctaaaccaaacagaatttgcggtcagcaagaaatttcttttagaaaatattctttctttcaggatacgtaacaaatcaagtggctgcaaagccattgtgtgggtcagcattggtgacagcttcatgaatgttaacgttgaatgtcacatgtcagctgaaaatcatcataagcccctgaacatgatttttaaaaggcttatggtatgctcaggcatgacttcggactgaatgtcacgtcttagatttatgcatatgagcctaaaagcctaaatttttaaaaagagcagaaaactattttatgtgtttgtttctgaatactcaagtgccttgctttatctttccactgtgccttctatcctgactactttaactgataaaataatttgcaaagacggacagccatttccttgccagggtacattccagtgtgggagatttctaaatgctaattaattccaacctcaactattttacctgctgtttcaaaggctggcagcttgtattcatcacctgaatgacagctgtttctaacctcttttccctgaaaagaaataagaaattaaataaaccttttgcatgctaatcactgatattctgaactgacagttgaaaagtgttcaagtgtgagtcaaaggcagacttgaattgaaagactttgtctgcaccaactagttgttgaattttgaccagatatttgcgaagtgtagagagacagggttgcaggcaactgatgagacagtgttatcataagtgagagaataattagaagagactttaagtatgttaaatgtctacatttaagcaagttgagcaacataccttttttatttaagttttatagtacagatttttttttttcattttttacctagtgaattttcttccaggtcaatggacagatagaaaaagcaaggctttttaattttttaaaattttgtttacatgctatttttactttaaagtttattaagtctaattaattgtctcataataatggttgatatattgcttcccaaccagagctatcctttgtcaagatgtattttatttctactgtagttttaatttctgctttttacaataatggttggagttaagagcatttgactgattccccctaaacaaagtaaattttatgttaggaccatcttcttatatagtaaacatgcacagacagttttggaaaggattatttaatcttcatggaggattaacatttaaataccaatagtagattatgcttcttgatttgtttaaaggtatctaccactgaatgttttctcctgcatgttcctgactttctataagaccccagatagtatcgttcagtcagaagttgtagatctctcagagttcatgtatttcattaattcaagttgctttgatgatgcctacttttgttacaagaggatatgtttctttttattgttgtcttaaggttatcaccattcagtaattttactatcatatggtaaaatctgaccttccggtgctcttccctatgaattttaacagtcgtatacatttctgtaattagtcactatcacaatcagaatatagaacagttttatcattccccaaaacacttttgtgctatccctttatttacacctgctctccttacccctaactcctgagaaggtatttttgtgatgttaaaatataaagaagaatgagaaagtggaagaggaagaagaagaaggagcaggaagaagaaaggaagggagaggagggctggggaaggcaaggagagtgaagaaaggaaaactgggcgtgcaacccagtgaaatgttcattgaattcttatcaaagattgtatgtgttacctgggacagtatcttcaacacattgcattctcctttcttcatgtaagaagatgaaattgttcaaatgctttctgcagtcattctctaaattggaaattgtatactgtgccttgaaagtggaattatccccaatgataacttttctcatccggtactgtcagtactaggcttgtctgctgtcaatttgacatcatcccatctctgggatgcaatgaaaaggagaaaccaagaagcacataccccagagtcctcttttcttaatagttctgattccagattcccagtgaagggaatgcgtacaggatctgggaggcagaagagaagtggagtctgttgcagctgaatgtgtgggcagatgtgggattcctggtggcttgagaaccactcacttcactgctgcagacagtaatcactggtgggatctttccagggaatttccaggacaccttgcccataagccactgagaaccaccagtctggtgttgctctaggatgaggtttctgggtctgccttctcacccttctgcctgcccgtcccacaacttccaccatgacttttctgtcctttatccactctggctcacctatcatttgtggaaacgccaattcctgcattcaacttgctatttctggtgtctcttcaagtgacttggttttcctgcacaaatccagcctactaaaccatgatttaaagaaaagtttagtatttgtggccagcgtttaaaaattggaagatttctctttgaagtcctaatggctacttttcttttctttctttcttttttttttcttttttttggagactgagtctcgctctactgcccaggctggagtgcagtgggcctgatcttggctcactgcaacctctgcctcccaggttcaagcgattctcctgcctcagcctcccaagtagctgggatttaatagagctgggttttcatcatatttgccaggctggtcctgaactcctgacctcaaataatctgcccgtcttggcctcccaaagtgctgctgggatttcaggtatgagccaccatgcctggccaacttttcctttgagaaatcaagtcaggaaacactggaccagcattctggactgaagacaggggcgtcaaggttacaagtggctgtcaccttagtaagggtgtgattgtccacttcaccagccagcccacttcattgtatcatcttcttggaccttgcagcctttacatttgggtaccttccttgctaaataacatcaccttagtcttatttattaaaggattaccaattgcaaagctgttttctaggaactcctgggtatatggagatgtgtaagaagaaccgaatgcttttaaagagcttgggggaatgaactgcgggagacaaaagcaagcatgtgactgtcctgtgatagcaaagtacttgcatggaatgatcccttaaaggagggtgagaaaataaaatgagaaaataaacttagtagctcactatttgggtatttttgtatactcacatagagttttatggtggcctcacttgttattgatactctaattattgttgatgaaatttatctgcattttagtaagaatttcatataatgcaggctgtgtgaagtggcttatgcctgtaatcctagcactttgggaggccgaggtgggtggatcacctgaggtcaagagttcgacaccagcctggccaacatggtgaaaccctgtctctactaaaattagccgggcatattggcgagtgcctgtaatcccagctactggggaggctgaggcacgagaactgcttgagcccaggaggtggaggttgcagcgagccaagattgtgccattgcactccagcctgggtgacaagaacaaaactctgtctcaaaaaaaaaaaaattgtataaactggaaactcagtgaatgttgtggaataaatgcaaattaatctttttccaagtaagcaaattctcaaagtatgtttctttagaatattttttgttgatcactatctatctagttctatcacatatctgtatctaaataccaataatatatggattttaaagaagatgatatatatcagaaaaaattacacttaaaatttttccaatatgttgtatttaaataaaatacaaggggcattatcaggttaattaattgcagataaaagtaaatatagatatatatgagcctttttctttcttttttttacttttactctgcttggtgttgcataaatatgatagcatataatttttgatgcaggattttttcactttatgttgagatgttttgtatgctgaaataaaaatatgagaataagcaataattattgtaaggtcagcatctgttgattttcttttcctccaggtaaaaatagacattagtttatcagtttagagaaaagaacacaggtgcttcctagtggcaggcacctagcacactccaagtaggaattcatagatatgcctttttaaagtttatttcttttaattcactttcattccacgtgatttattttttgtggagggaagaagtagattcaattttgtattctcccccaatggctgatgaaagtatggacaatgtgtattttgctatgcatgtgaggtgtatgtgtgcatgtacaacacatacacatatatattttggtggagacacaaaggacatttatttgggcaactccaaacctgtttaagtttgatcccttccagatggccggatacctggctgtcggatccttggctcagcccatttcttatctcccaaatatccctttgtgcttctctgagaatacggcatatcttagagctggatgagtttcctgttaggacagctcacagattcgccgagcaagctggggacagtcaaagttgtcttacagaaaaggctcacatcttttaacaaatgtacgtctttgaaaagtgcattttgctctataacaatgtttctggctttgttatagaggcagaacagcaaagtgaagtgattcagaacattgggaagaccagcatgattccatttctgactccggcattggccacaggcccttgtgtatgctctgcaaactagctgagcctcagtttaccttccatacacgggggcaccagcagtacctacctcacaagggtgttgtaaagaataaatgtgataattcaagtaaaggctttagcaagatgattggttcataataagtggtaaacacatggtaactaatagtaataatattggtgctaaggcatttgtgctaagacagtggggctcaaatttgagtgtgcatcagagtcacctagagggcttattaaaacacagatggcctaccccccaccctgcagagttctgactcaggaaatctggattttgcatttctagcaagctcccagggaatgctaatgctgctggccctaaaactgcagaatgaccactgacctaaggcattcagactccagactatttcttggggcaggtgaggactgcagtttggtcatggatcagagtgaaggatcagatgtgggattacatccttcaaccttgggcaatgcttctacagccacgatcctggtagctcaatgctggcccagtgtttatcaagtacaacaaaaataggaagtcctgtatttgcttacatctaccattcaacaactcacaaaaactttctatcttgtttttcacatccttaactttcaaggagcagctccctcgcctgctccagagcaagtatttcccctccaaggcatcagaggactgtcatcagctgcctcaattctgccttcctttggcacagagcaagtatcacatcctctgtgcccccaccagctgattgcagctcctttgaggagtggagattttatttcactctggctccttttcaggagagaatcctcttccctggattttgtcagaggagggttttgggtaagctaagcaggccatgcacaaatacttgatgggagtggggaatggctgtgaaccaaatattttcatttcttcacacttaactgaaacagctgccttcaccttggtgactcatattctaatcaaatccttaactagctgtggaccctcatcaaataccatttgcttattttggctttaacagtgggtggcatctatcacttactgattgtgacagaccactgctgagttcttcacctgcaacatttccttttatctttcctaggagtctatggcctgagaagtgaggtggcaaagatgctcatacagcaactctaactgtttccagccgttctaatgccaacacagacccatctgtcttctggtcttttgctggtgccctctgtctaccaaacctgtggtactgcaagctctaaaataggcctccctgggccaagagcagggtaaagaattacagagaatcagtggtggggcagaaacagggtaggtggcagacagaagacaatgagtaacgtacctaaggaaaattttaggagacaaaggctatgtcaagtgcctagcctaatacaggactttcgctaagtaacaaaactagggtttgaagcctggatcatctgaatcaaattataatcatgccaatggagcatccctgccttttaggagcctgcaaaacaggttgacattatcacaaagcaaattgtgtgtataatcagtattgtccttacacgtatatgagtagatagaactattcaggtggggaagtgttctctcctccattctgagatattctgaaatgaaaggttaatagtcagttatttttggaaaatatgtacacttttcacttcgatatccactcagcaataagtacaaccatcagaattatgctttagcgatttggcttttctctgcccccagccatacatttaaccaagaccaaaatgttcactttagtttcagaaagattttttttctttgtagaacaaaaatgcaagtgacctaaaaagggaattgacttttaaaaataatcttcgtatatctaagtttgaaatgtttaactctaaagttcagcataggaatgatacattatcatttagtgtaagaaattcatctttaaaataagtgtgttattttagcaattgcaaagctttatctttctgaagaacaaattctccccttcagaggcagggttttagtattaaattgcctataaatgttcaaatgtgacttgcaggtcaaaaatcacagtttaagtggatttgatggattttcagacatagtttataatgtgatttcaggtcactacttgttccaattgaaacatcaagctaacagttaataaaaagtaatgcagacgcttgtccaatctgattgcctggtgaattaggctccttttggaaaatattctcatactcatggaagcaaacatgaactggctcattgacgcattcatggttttctttccatatgtttgagtgcctgctatgtgacaagcattgtgcttcaaagatgtttatattttaattttgcactttggcacaagactgatataatgggcatcattgttgagagtgtctgtcatttgaccagcacttaatgtatcttatctctaagctgtacatcaaccctattatatttttattattatttccacttcatctttgtttaactgaagctcaaagaaaccaaaaaacttgatgaacatcaccgagttagtctgtggtcaagttgtgatttcagctcaagtgcatgtcagggcaaatacaatattttttttagactatgtgtgcacttattgtcccttcttgaccatctctagggttgtctatgctgtcacctcagctgatcacttggcagtaagagacatactggctgctagtgttttaacttctgaaaaatctaattcttgaaaacgtggggccaggttgaagagacagggtctgattaaggcagatggcttctaggatgtgtgccatactggctgagttatatcattctaggctactagaatggttcatcctggggttttcagactcatgctgtcttgcagacactggttgttcattagggaccacattatacatctcaggttcaagagagatgactcttccacagatctcttctattgtgggacgtggaagtcttgcctgggtctaagggaatgaccaaattagaatagcaggattgagaagaaacaattaaatctatggtgtcatgggacttggcaggacgtaaacataggaattctagaatattttatcaaagtaagaataacctctgtaaggacaaggacctggtctcaccaatgaaccggcaagaactagagacataggcaagcccacattaggtattattttgttttgttaggtttgttgcttcagagggagattcaagcttggtgcacagaaacttcagggaaataatatcctagtttcaagcttattcctggactgcatcttggacttcagggtctccattgaagagaatacatgaaactttgggagagtaggcctctgacattcttagagttatttcctgggcctctgagatgttgcagggcttgttttagggagaatgttttagtgaaaagacttgaggtcaggatgacctgctgtgacaatcttcaaacttaggagtcgttaaaaggcttctttgttgcttggttggttgaggacttactggcctatgggatctggctttttatgcaaaatcactagggaattgcaaatttagaattagaagggggagatacttcaagtgtatcttctttcagtactgagcttaatatgtagagaaccaaggcagcccactcactaccaacaaacatcagatttctctcttgcctcagtcagtcagttgggaatgagtcttgaggaaatggattgggggattgagggttagagccatggtttactgcagtggtgtgtagtgttcatgaataggccagccctgaatgtatggtttctgtttagaagtttgtgagtaggtatcagatccccatacataacactagtgaagctgaggaacaaaaaatccagttcttacagaactggggtatcaagtaggtaactggccatggatgtaaatgcaggaagctggttatgagtaagccaagtacacagcaagacttgtgttttactcaagcatggtgactagatcccatctcaagcacctcctttgatcaatgagtaatggcttctcagagcactctattgagaagtattctgaggctccgtatcagctaagtgagaaaggatgctgtgcttgattaataatgtctgtcatagtcatgaagtaagagaggagtggtggcacctgtaccacatatttgttatccctattaagctttggaggcactgctgtaggactccgagggcatcactggccccagagactggacaaaatgaacccagataatgtgaataaagtaacccagcaacccacttctccgttgcagctgtttcaaactattcctgtatttttcaagctcatgaaactctgacaatcctccatgcttaaaagataacccctttggctttcctgaaaggaaggaagccatgtgtcatgagttaccctgtgtccctgcctccatcactcagtgtctcttatcttcccccatctttcctcccgtgtttttccatgacagaggataaagtgtcctccctccccttcagggcagcttctccattttttttttttttttccagagcttattactcatcacttaaaatagctgttgtggggaaataaggtttgcttggaaatgcattcctgatcccaagaggcctctcccataccatcctgccctcccctgtgactgtaacttaccagtgggcatgattttcacaaattactatttttctttgtttcaagttaattttgctctgtcatcaagctatcagattacagctctaattctaactaattgtgcatggaatttgcatgattttgtaaaatacagacaaaggaaagtggaaattcggcttcctggttcccaccccttgctgagcatgtctcacataggcctgatgctgtttaattacatgagttggagttcatggtcaagtgtaaagaatgtgggtataatgttgccatctaatagttcaaaggaaatacagcttagatctgttattaaaattgtgttctgatgtatttgaagtgttaacatctatgctgagaacgaggtcttgaatattatattttcagtttatatttgaagttgagattttggattgtgtttacgttttctgaacttgctttcttccttagttgaccttatgcagggaacaacttattaatatttaagtactaatcccagtactgccttccatcaaaagcaacccacatatctcattagcaactcacattagtattgattaaaaaattttcttgcttacttttataatctttatttagctgagttgtacagtatttgtgatatttctatcatcatatatcatcagtggaaatatatttttttcatattttatatgtatacatgcattagtttttatactgtaagttgctcacctgaaagtggtttttaaaaatcataagtattcacaaagagggaagtaaaaggttcaatatctaaaatcatcctttttaaaggaacatgacattctcctaaaacaatagaaagtatactcattgcatatttctttaagacagggaaaaggaaacagttctgttttttaaagatgtggagagagacagggagcaagaaagaacagagccaaaaactacttctatttttaagaaaagagggagaaattgaatatgctttttacaaggagaagacacagtatacagtggtatgtgtcagactttcagtaaaagcaagcttctttactcatatctaataaataatagaccagaaaaaaaagggcctggtcatcttattttataatgaaatgataaaatgcagataaactgaacctctgagtcaaaaatgtattgggttcaaaggccatttttaggatagctttgacctttccataaagtgtgaaaggttcctgtctcccataaagttgtgaccttaaagagcaagatgtattcattgtgtttttaattttttatttatttatttatgtttgagacaggagtctctctctgtcgcccaggttggagtgcagtggtgtgatctcggctcactgcaaactccgcctcctgggttcacgccattctcctgtctcagcctaccgagtagctgggactacaggcgcctgccaccacgcccagctaattttttgtatttttggtagagatggggtttcacgtgttagccaggatggtctcgatctcctgacctcatggtccgcccacctcggcctcccaaagttcagggattacaggcgtaagccaccgtgcccggcctcattgtttaaaaaagttataaaagaaatagagagtgctctgacccatcagatgtgtagttgtggtgtctgtcacacagaattctgtcaagaaaatagctagcgagtcttgaacataaggcattctgaggccaacatccccttttgatttctaaaggacttattgttacttctggttttacaaattgcaaattagggtcttaaaaattttagtatttgatgttagttcactgaactctcttgtcagccaattcataaggagaatttactgcctaccatgtatctgacaatgaaatggagaaccggtagaaacagcccttagtctcagtgttgagatgagtgagtgttcatttagaatgcatttcaccagtacttcttcagtttgattgttaacccatttggtttctaagtcttaggagatatgcaaatgctgaagtcctcaatgttctaatgcggtaaatagatttttttttctttgttgttatgtgagacaccttaagtatagattggtgttaaaacaagtttataataatgctattgatgtgtaaaaacaagctttctaaatgaaaatcaatacctgggacagcttataaactattcttcataatccctttgggtggaattcacagagtggttgtttctttttggtttaaatgctaaatctggccatctttggttatcaaatggaatttgatgatccaaaatgtatttaccacatttgttggatctacttatgaatctttggaaaaactaattgtagtaaaatgggaaaaggctgggacttgtcatctgggtgaacctgaacacggtaaaacctccctgtagaaaacctaatatttgtaatctgtaaaatggaattgaaattatatatatatttaaatatataaattatatataattattattatataattaatattatataattatatataatataaattataaataaattataaatatataaatgtataaattataaattatatataataattatatagttattatatataatttatataaatacaaatatataatatatataatttaggtaaatatacatataatatatttatatttatataaaattataaataaattataaatatataaatgtataaatatataaattataaattataaatatataaataaattttatataacataaattataaatatataaatatataaataaattttatataatataaattataaatatattatatataatttatattatatgtaattaaatatattatataattatttaattatatattatatataatttatattttatataattaaatatattatatatttaattatataagtatattatatataatttatattttatataattaaatatattaaatatattatatatttatatttatattatatattatatatttatattatatataatttatattatatataattaaatatattaaatatttaatgtattaaatatattaaatataatttatattatatataacttatatattataatttataaattatattatatgtactttatataatttatataatataatatataatttatataatatatcatttacataatataatttatataatatataatttttattatatataatttatataatataatataatttttattatatatagtttatataatataatataatttttattatatataatttatataacatatactatataatttttattatatatatgctgtatataactatagttataatttccatcagttttgcccttctcttcttctccatgtttaatgttccatggtctacacacctcattgccctccacacaagttagtgttatcgtatattgcgatatgtctgccatcaagtgtgtattcatgatatatccaaggtagaaggcatgtttttctttttccaggcctgtgtggccaagaagcatttctgaatcatgtgaattcattctgcaacctcatctaccagtgttcacccttcccccactactgccctgaaatttcaccattttaagtttattgctttttgtcttgtagtttctaactctgcgaccagcgctcccccacccccagccctgcaactgcaatgcattatgatttcttttaaatttgtttcaatgcctgagcttggggccccaaaactatagactggactcttacagagctgaaggagagagggggaagcgaaggagttcatctgggataaataaaagaaaggaatgtcagggaaggagaaggacccacaatcactatctcacagatttacgtggatgttttacaatgagattaaccatatttagaatcctagacattttatttttgcaatcagtttttctgaaaagaaagaattcttactgtttagctgaaatacagcttttagctgttttttttttttgtaattcagtaacttatgtgatgtttttattgatttccattatctctcattgtttttaacctagtactaaatggaaaacctaggctagcatttatttgtacaacttagtgcatggtttaaggaaaaaggggaaaaaagccttgtttacttgccctataacctagtgcttacctctgaggtttatttaacatggcaggtggtgacgaactgcagcttatgacatctcttgcaatgtaattcaccactcaatgacgaatgcttctgacaaatggaaacctggtattattctaaaacagaaaaaagatcaatatcatttggatatgggatagtaaaaatggcttctctaaacacgtgaaataaattagccctttaaggtgagaccatattataagtggcaaagataaaatagagtggaatttttgttttccttagaatttttttcttgtcagttgtcagagtaaattaatactcttagaagcagtcctattaccatgccaccctgtgctgttgtttttttagtagtttgcattgttagtgctaattaaaaaactatcttggaagttaattgggggtgatactagttagttgtgactgaggacataaccatgttaattatcgattgtaggtcagacaaagggctaggcttttctacctcttgaatcttaactaaggtcatgagtaagttgtttttaaatcataaaattttagtgttagacaattgctagaggacaagcgtaacttcacatttaattagggggcagttggagatgttagtggtgtgttgttgggcagttgccacacgcttctgatgatgtagtaaatcagcagtgaaattaggtgagactcactacatgaatacacgtttatgtaacagtttttctcagacttcggtcacatgccaccttcaagatatttcctgcctgcaccattacttatttgatattttcctctaagctaattacagtgttactttatttgtacttatctttgacaataagcaataatactcataaattcagagactgattttttaaaattatacattaaaaacacattatcaatgattttttttagtatatgtgctgctgaagtgagcacacaatttttttttaatttagcttttttaatgtaaaaaagaacttggaccacttttaaatacctcacattttaggatacatttatatgatctatatatatgccattcattttcataatttcttagttttttttgtagttttagaaacattgattttccccacatttgtggaaattggaactgtgtttatgtatatgtaatactgaaaaggagacgaaaagaaaacacgtttcacagagttacttcttggtctgttctggaattataatagcgagtactaataagaacaggcacactttgggacattgtatggaagaggcttctagtggcaaagtgatgagaggcagagctgggagcaggaccagttcaccagccacagcccattccagagagtcatagatggcaaaatagcagctctaatcgattggtaatggctgatggctgtttctgttgagaactctgaggcttagtctgggctcagcagggaggagtgcagtgctgatagtgatgtctgacccaggctggaaataggcaggaatagcgagaatgccagggatttgccatgtctctactgtgggacagaaccagtgtgtagcacttctctgggtatcgttttacatagaaataaatgtattttaaattgttttgtttttggagcattggatttgtcatctacttaatatctccatccttgttattttttactttggtgtgtaattttattgtactatgcatctaatatcaatcatcataaaagttttatttttcaattacttttttataatagaagttatattggctcatcctttgcttttctctgaccatattctattaggttggtgcaaaaataattgcggtttttgccaacctaataatatccactcttgtctagtgctatttgcaaggcttatccagcctcaaactgaattccacaaagtggttttggactaactagacctctctggagtctcttgttgaagttgaagttgaattcactcacttatatttgtctgtttctaatgtgtatgtattaccttctgtatttccacactcacatcagtcagaatgcaaaggatgcaacaaatttatgtggtattaatcagtatttttctataaatgacatcagaaatgtaagcggatggtttataaataactaggactatcttttaagagtgggagcttcttgacattggctcaggacaatttccagaaaggtccagattttcaaacatacaaataagaatgtttcctttccgttcagatttcttcttcttgtcctgcttccagagatagatgagaagacaaagggttgaactggcagattctactctagtttaaatgggggcaccaagatttgcatttttaaaacaagtcctggcactcccatccaggcttattcctgtccaagggccaaggttgttttctttggcactgcattcacccttagagcttctggaagatccgctgattagcccggttctactcttgcatgttccccatgtccagattctatccctcaggtaccccaaatcagtatgtaacctattcctaatcagaaatctcaagctttgccctgtaggccatttctcctgatttttccatgctcattctaaacagcagtagttctcacatttaagcatgcatcagagtcacctatagggcttgttaaaacacagataactgggccccacccttagatttcagatcaggtaggcttggggtggggcttgaaaatttgcatttctaacacactcccaggttgttgatgctgctagtctggggaccatacctaagaacactgcaaaatgtttcttttcttcatttcaagccccaccaaactgagactgattatgtaggtgttggcctagttgccctctaaatgatctttatttatctaaatagctgcttgcaacatgtaaaaattcaaaaggtgaaaagtatataagaattttcagcagggattcttctggtgcccctgaattctttttgttgttgttgttggtttgtttgtttgtttgagacggagtttcgctcttgttgcccaggctggagtgcagtagcgcaatctcggctcactgcaacctccacctctagggttcaagagattctcctgcctcagcctcctgagtagctaggattacaggcatgtgccaccatgcctggccaattttgtatttttagtagagacgggtttcgccatgttggtcaggcttgtcttgaactcttgacctcaggtgatccacccacctcagccccacaaagtgctgggattacaggcatgagccgccgcacccaactgtccctgaattcttcccaccattcctgccagctcctctttcccatccagtcctctgtcccactacctttatttcttctttttccctccctccccaaatacaagcaaaccaaccaacaaaaacccagaacacacataggctggaacacaaggggataacatgccttgaattgcaatgccataaagatgtacaactctagggacgggatggcgtccacacagaagcaatgtgaacaatgccccctggagttgtacaacgtggggccttgttgagcagtactgtttcgcaacacatagtagcaagaatcctctttgtaagccctattccatctgcctggttggttttggcaggatggctgactaacccactagtgggaatccacagctaggatagaccctccagctctttggctggcttctaaaaggccacgactttagaaaacccatctgtaatacctgatttaccacaagaggtagccttaggcctagatcagtctagacacttgtcagcagccccaccttcagtgagaaggactcagaaaacactgtctcattggtttactcatggggaatcttcctggtcccacccaaggaaatgcctcctgtacaaattctcttcccaaagagactaacagcaagagaatcccagaaggggtcaaaactcaaggggtcatattcctgattccttatattcctgattcagtttaaatcaacccctcaatttacacatcaatctgtctaatccctctacagccctttggctcttctccacacccttggctgggaaactttcttcttccctcctcagccagttcacacccttcattattcagcacatgttgaaatgagcatcatcggagctaccactccctggatgcttcgtcatatcactgggagagaaggtggagaatgttcccccagcagaaagctcccacaccatcctgtgtgcagacttcccagggggaggtctgtgctgtatatcttgttttgaaatgtaatgacttagtattttccactgaattcccttgcctggtcagcttccacagcatatctgtgctatagacaataatgaaaagagggttttcgtatgttttttcttttattatatggaggattaatatgctgcaatgcatctaccatattgtgtgcctttttcacaaacatttttattagaaagatcaattctcagcctagatccaactatgatacttttaaaatcctgtcattatctcccctctgctaacgaattcaggggaagaacaggtttctggtttctcattatttctaggggtagaattccacatcaaatatagaaaagcatcttatacatggaacttttttttttcctttggaaggggggcttcttctgtgacactatccacacacttttttagtgacttctttttcatcaattaattcagattgtctgaagactagaaattggggctttggcaagggtgaacagcgattaaaatatatatctccgctcacatttctgcccacatggttctttttctgagagagtggttaggaacagtgctagtcttgctaaaactgctgagtttcatttcacactaataacacctggcatctttatgtgctaaggataaattaagcactcagtgaacacagggtagacatgggttttgctatgatgtagcttattctgcactcattatatagagagagaaatctgtgttgtgaaaatgtgtgtgtaggcatgtatgcaacattgcaaaaaatattaatagctctggccattttgctgattttagataaaggtagcactatcatatattccgattagttattaatagaaatactgagaatattagaggtgaaatggcccttaaaaatcatgtagtccaaaaatctcattttacagactgaagaaattgagaaccagggtgattattttcaggaattatagaatatattctgtgaatttaggcagaatcaaaatagaactcaaagatttaatacccattccagggcactttctaccataccacgctgttcctcaaataataaataaattattcaaatacacgaacattatgtcatttttacagaattctaagttgtgtgttttttgggttgttgttttgttttgtttttgagacagggttttgctctgccaccaaggctggagtgcagtggcgcaatcacagctcactgcagcctagacctcctgggctcaaacgatatcgcccacggcccctcaactccccatcccacttcggcctcccaaagtgcaaggattacaggtgtgagtcactgcgccagcctaagttaggtgtttaaatgattctaagacacacattctttcacattttgaaaatattttattttgaatttttagacttacagaaaagttgcaaaaataattcaaagagtttaaaaaatatacacctctctcatcccactccttctaatggtaatatcttagaaaaccatatgacaattatcaagaacaagaaattaacaattatacaatatcaataactaaacttcagaccttatttgaattttgccagtttttctactaacctttttgtttgtttgtttttgagacggagtctcactctcgctcagactggagtgcagtggtaccatctgggctcactgcaacctctgcttcccagtttcaagcaatcctcccacgttggcctcccgagtagccaggactacaggcgtgtgccaccacacccagctagtgacctttttgttgttgttgttctaggatctcacattacatttatttgttcttaatctcttccagcctataactggttctcagtcttttcttagcttttgtgacttggcacttttgaagagtactcctcagttatttctgtacaatgtccctcaatttgacatttttttctagagagagaatctcacgctgtcacccaggctggagtacattggctcaatcatagctcactgcatccttgacctcctgggctcaagtgatcctcccatctcagcctctcaagtacacacacatatatatagtatttatatatatatatagtatttatatatagttatgtttgttttgtttctgagacagaattttgctctctctctctctctttctctctctctctctttctctctgtctctatatatatgtgtatgaaaagttacgctataacaagtgtggaaataccaagcaaataaaagtctgtaaaaagaatacctcctcttcctcttttcttcctcctcctcttcttccttttcttcattacttcttccttcttatctttcttattctcttcttttttttctttttattctaacctttctttcttcttttccttttcctcctctccctcctcaccaatgctctttctctcgtctgtccactttcctctctccatatttcacctactaaaatagtatttatttggtccacattcccgtaaaattgctgttgtttggggaaaaaaaactctaaggaaactcagaaagctgtgttacccaaatcatttacaatttgagttggttggagaatatgccatggagaaagcctgttcggagatgattagcatgccagtccaatgtcttttcctacttaaatttttaagatagtttaggactccgataactattatgtcttagctagtggttattcagaaataaaataaaaaaactgtaccatactttttttcaccaagtagaattagctcagagcacagtgcattgggtgtctgggcttctggtaggtgaggctgggatgtgcaggtagagattattgagtaccgtagtagtacagcagcatccaagtttaaatttgagggtgggtgtcagcttagaaaatctgagtgcttgcaagggctgagaatttctccagcctttcctgcagctgtcagaagtgccctgttttgcccttccctcacacctcctcccaataattctattactcaggggaaggagacctgggagggtgaaatgactcattattctattagacaatgggacgcttgggttttgactaaggctgctcagactgccagagtcccgacctccatggcaatccagaggcacaggaaatctgagatttaaagttgtgaactcagtattgacatgaaaaatgccacttgtgttgtgctgaaacaggtatgctgattatgtaacagcttccaacacattccctgccggtggtgggttttgattgacattttatgagccttattactcttgaaaacaatactgaaaatgccatgacaagctcaggatggaaatatgaacacacgatcctcttcctgctgaactagaaaatagcttttcgaaattcttggaagaaagtggaaagttcttcatgtagattcataatgatcaatctctttttgtttcttgggaggagaaggatcctcaaatcttatagcaatttagcatggtctagtccccagaacttttctttgggcttcttacaacttacaaataaatgttgacttctaaagtagagagggaaatgcataggatatcaatggcttgataaatatttacagcaataaattacagttttttgcattcatagtaattccttggtagagggagtttattgtttaaacaatatagagatggaaatgcagcagaaattcagatttttttctgtgtttttttttcttctctgtataaggtgattttttttcttctctgtataacaaattttcaaagtagaatggaggttcaagaatgtcaatgaaatataaatggtatggtgcatttgctttcattgaattgttggctctccttaagtatattaggatagcaaactctctgaattaggatttcaacctcttcgatttccttctgattttgtgtaactaaaatatataaatgagactgcacacaggccgggcgcggtggctcacgcctgtaatcccagcactttgggaggccgaggagggcagatcacgaggtcaggagatcgagaccatcctggctaacacggtgaaaccccgtctctactaaaaatacaaaaaaattagccgggcgtggtggcgggcacctgtagtcctagctactcaggaggctgaggcagaagaatggcgtgaatctgggaggtggagcttgcagtgagccgagatcgcgccactgcacttcagcctgggcgacagagcaagactccatctcaaaaaaataaaaaaaataaaaaaaaaataaagagagactgcacgcacactagcatccctggattccaaatacctatctgctttgttataaaattaatagtaataatagcagcaacaatggaaatagtagctagatttattgagttcatattgtttttaacttgtgaacccaagcagtcccatagccactgtgctatactttagtgttatttttaaaaatcacgctcaactaaaaatgggaagcccaggcagctggtttggtgtcacttctctgctaagatgaatgccctctgcaccctcaagtggtgaagcaggtataggcggaatacatacagaatgaaaaactgtatttgtgaaacactttgaaggaaaggtgttgtgaaaattgtgttttgttaagtattgagggatatggaattagaaataatagtacagttgagacagaaagatcatttttctgaagcacatgtttagtgtcggcaaaggttaagctgtttttgatgaacctgttttcatgtgaaaattactataaatggtcagcagatacttgcttttaaggagcctacttctgattggtcagccagataagcgtgtatgtggtgattgttaagaagcagctggtgtcagtttaaaagaatgatgttctatcctcttccgtcttgaccagtctgagaacagtaacatcaatatttgaagttatatattcaatattcattacaatattctgaaactagttgttcatggaaatatatcggtaacttaacacaattccaaatgccattttttatagttatacttttttgctgtttcttaaaatgatattactagatccatattctaattgtttccaacctagggacggctaaaagttatttttttttctttttttttttttttttttttttttgagacggagtctctctcagtcccccaggctggagtgtagtggcccgatctcggctcactgcaagctccgcctcccgggttcacgccattctcctgactcagcctccctagtaactggggctataggcgcccgccactatgcccagctaattttttttttttttgtatttttagtagagacgcggtttcactgtgttagccaggatggtctcgatctcctgacctcgtgatccacccgtctcggccttccaaagtgctgggattacgggcgtgagccaccgcacctggccttaatatatatttttataacttcatcatagaggtgataaattttatccagtataaaacagtgcattttaaaaatctcattttgcttcaacaacatacagtaactggaagcatggctactgctatcttatttaaacaagtataaataaccaaaatctacagagcaaattatggtgcagttgaaaaatatgactacttttcagtggggtatgtttatatgaatattcaaggagatgacaaatatttacatttttcattcctcattattaagaacttgagaaaactaacgagtatttattactcctgaagtgaaagataatgagacaaaatcctgaagacatttctcttttggataactgtggttttaaactccataagcaataaagccactgtcaatggaattattttagatgttatcttttgacgatggattatgttttttcttgtctttttaatattaatttacatttagttatgtcatatagtaaagcatgctaatcttaagcatatgtacttgtgtaaccacctccgatgaagatatggaacatgcctataatcccagcactttgggaggctgaggcagggggagcgtttgagcccaggagtttgacaccagcctggacagcatagtgagactccatttctacgaagaataaaaaagtcattaaagcatggtggtgcatgcctgtagacccagctactcaggaggctgaggtgagaggattgcttgaggccaggttgtcaagggtgcagtgagctgtgattgtgtcactgcactccagcctgggcaacagagcaagaacctgtcttcagatgcttcttcatcacccttctcatttcatcctctcttcccgtacaaagcagccattcttctgagctctgtcatcatccattagttttgcctgttcttgaacttcatgtaaatagattcatactatatgttctcttttgcatctagactcttgctcaacaagacattttgaagtaatctatgttgttgcatatacaaacaattcattttttacactaccatgtagtatgccattgtatgtacaggcatttttttatcactgttgtgccaatgggtatttgaatttttcctattcataatttaacaattatgtataaagctgctatgaacattcttgaagctgtcttttcatgagcaattacattcacatttctctgaaatatatacaggaattgaattgtttaaacaaataatttatggtatgtgtgtaatagtggatatgtattgatgggtgtgtactgatatttcaatgtggttttaatttgcatttccttgaaaagaatgacattgaatactttttcatgttcttatcagccatttgaatctttttttgtaaatgcttcaagtctttgctgattttaaaatcaatttctttctaaatgatttttgttagttttgtttgtttgtttgttttgagacggagtctctctctgacacccaggctggagtgcaatggtgccatctctgctcactgcaacctccacctccctggatcaagcaattcacctgcctcagcctcctgagtagctgggattacaggtatttttagtagagacggggtctcaccatgttggccagactggtctcgaattcctgaactcaggcaatccgcccgcctcggcctcccaaagtgctaagattacaggcgtgagccaccgtgcctggccggtagttttgtttgtttgtttgtttttgttttttttgaatgctttggatttgagtccatcatcagatatagactgtgaatattatttctcagtctgtgtcttgccacttcactctcttagtgtcaacttttgatgaacagaaactctacaaattagacttaaatgtaattttttaaatgattaatgattgtttcctgtttaagtaaacttgcctattccatttcttattttcttatttatccaattctcttccatgctagtgcttttgagttctatgtgagaagtctgccaatttacttcatattttcttaagcaaaatattttgaacaaaacttagctttcctaatgactcagggtcctcatttttaatagtaattactactgtccaataaattttatataacctacccgatagtgttgttaccaggataaggaagatatgtatgaaaattcttgatacatgcaggctgttgtcctttttgttctactctaatacttcttattcttattaagggtataggacagttattaatatttttatgctcagtggttttcgacaactctaaattttaagttattatatcaaattctgggctggacaggtaaggtgtttgccatacatgattgcaattgtgaggtttctttgtgtataaagtctttaaatttatatggtaggtcaaaaaacatattagctgataataatacttactttcaaatatcacttaaaatttctcttcaaaagcatttttttaaatctctttttaacaccttgacccaatgaagtaaaataaacaagatgatactcccgttaaatgtgtgtacaatcattcagctgctgtggcagaatatacaacagttctcagccctgtgtggtcctttctcaatttgtcactcaattgattgtactcatacatgtgttagaccaacatcctcaataccgtttgttggttagcatcatctggggagactgtaaaagcataagaatattcagctaccaacccagggggttctttaaattagtgggactggggtggtgtccaggcatcagttgtaaaaaaaaagaaaaaaaatattttattgtgcaacctggacgtgattctcctgttggcttggggcagggttatgcaaacttcagcatgcattagaatcacctgaagggcttgttcaagcacagactggggggctccacccccagagtttctgattcagtaagtctggatggacccaagaatttgcaatactggaaagttttcagatgatgctgatgctgctggctggggaccacagttcgataacctctggattagatagccatcaccatccctaccacaagtaaaacttgctggtcattctcatctgttgctgtctcccatctgcctcttctagccctggggttcaagttctgtttgtttgttttgttttgttttcacgcacaatactaagctatttattttctcacttgctcagagagagctttaggattgactatgtattactttacctcttttcaaaagaactaagtatctccaatatgaactgtgagatgacttttgatagtaggtatttcatctcaaagagtgcaagtatgtcaaaagaggggaatttgagaataaaacttagaagcaaatagagatcaccttagaactactcattcagccagaaaatcaggtcacaaaattatagcacctatctccagtttatatatatatatatataaatctgtacaggaatagaaaaaaacctggacccaaacatcagagtgttggtaatggtagtatccaggtatttggggttatcaatgatctggtggccttttgttatctatatcttacgattattttttccataggaaaaactgaataaaagtaaagcaatttaaaagctatataaatgcttttacacacacacacacacacacacacacacacacacacacacatatataagcatttattcagcacagatttgatgaaactcctctacctatgaccatgccaagcataacagggtctcagaacacagaagcttacagacctgttgagcagataggaacccccagtttatattttcatgaaatctagtaaaatgttgagtctctttgtagtcgtaagaaaaatatataaagacattaatgatcattgactgtgggagacaatttcttaggatgtaagtgcctttgattttttttcctaaagaaaagttgaaaggacttggcctggtaaaagctgcttttaacttgaatctacaccttttatttttgaagtcttaaagagttttattcatttatattagattcagctggataaggatcagtttctttcactttgggtcatgggccctccaagaatgaaatgatactttattcactggaagcatagaattgctttaaacataaatgaattatggctctgttaataaccattaatgttcacatctccaaaaggtagcaagaccctatttataaactaaattcactggttggttgacatatgatccttgtcctcttccatcatcgtcatcatcatcattgtaatatatagttgtattagtccattctcacgctgctatgaaaaaataccttaaatttataaagaaaagaggtttaattaactcacagttccacatggccgaggaagcctcaggaaacttacaatcatagcagaaggcacctcttcacagggcagcaggagagagaaagagagccaagcaaagggggaaaagccccttatacaaccatcacccccatgattcaattgccttctaccaggtccctcccatgacacctggggattatgggaactacagttcaagatgagatttgggtgggaacacagtcaaactatatcaatagtatatatcgttattagattctaaagtcagcctataaaataaatcaaaattcatgttaagtcaaaattaacctcgtttaagtgttttttcaagctactttaaaaaaggaaaacaatcttgaaatttccttaagaggctttttattgcagacctacatttatcaatgagatcaacagagccattttttcctccagtgttgaagggatgtatttcttcagttcaccagaaaaagtgattggtttgtattcatattcatgttgtatgaaaactatgaataatgtctttatttttaatgcaatttatttatttgattaaattttttaaaaaatttatttagtcattcattgatttaagagagtatctcactcactctgttacccaggatggagtgctatggtacagtcatggctcactgcatccttaacctcttgggctcaaacgatcctcctgcctcagcctcttcagtagctggaacgacaggtgcacaccagtgaggtctcactatgttgtccaggctagtcttgaactcctatgctcaagcaatcctcccacctcagcctcccaaagcactaggattacaggcatgagccaccatgctcagcaaaaaaacagtgtctttaaacactctgaatcactcttagctatgatacttacactatgaaaggaacatgggaactgaatacaggcatccctttgtatcagtgagggattgcttccaggatgctcaagtcccttttataaaatgacgtagtatttgcatataacttacgcacattctcctgtagactttcaatcagtcagtatactccagattacttcaaatacctaacaaagtgtaaatactatacaaatagttgttgtactgtttagagaataatgacaagaacagatagtccatacatgttcagtacagacagaaccatgcatgttttttttctgaatatttttgatgggtaaccgtcaccttaagaggtgagtagttgcatgggtaaccatcaaaaatattggttgaatccatggatatgaaatccatggatatggagggctgattgtatgatggaaatggtttatccagacctctcagcccattcaaagagaggaatagcagattccatttgacattagtaggtaaagggaggggggggactctgaattacttattctctctaactctttttccttctgttctaagtatctattgatagttattaaatcaccgcagaatccaggggcttaaaataatgtatcattatatcttacattcctgtgggttgactgggttcactggggcaggtctcacttggggtccctcatgcaattgtagtttgtaggctgctggggcttgagtcatctgaagactcaacctggctggacatccaagatggtattttcacatagggcccaaagattggttggatcaggtgtgacatttacatagcgcatggggaagctggccaccccaccctaatcttataaaaataggttctttgcttggccggcggcatgttgcttgcttcttactacacaagttgatggcaaagagaagggaaaatggagccgccatgttggacatgcctagacccaggtagccttttcctattggcacaactgccggcattcacccgggcaagcttctagcttgcttgtctatgtctgcagctcagttttacgggctgctttttgttagaaaagaaaatgatttgggggcttcttttcattaaaaggaaaaccttaccaagtactcctctaccctcactatctgcctaaataatttcttcttaactcctatatcactggttttgcctgctgtaaacatgccaaggggcaggaagcagaaaatgccaggccattaggggctgtaggtagaactgccatagtgctctttctactcaattctattggtgtaagtagtcacagagcctgcccagactgaagagagtggagaaaggcttctcttgatgtgggaggggcaaggtcacattgcattaaaacatgtgggctgggagatattgctgtagccatctttggaaaatacaatcgattataccctcccttcctctttctcactctctttctctcatctcctctcttttctcaccttcctaagcatagggttgggtctgtctgtgtgatgtaaattcatgggtgactcagcagcactacaacactttctagtatatttagccctttacatatattttacatgctacataagtctttatttacattatactgaaggtctaatgcccagaaacaagtggaattcttttgtttaatggtttgatatgtcctataagggatctgaggtgactcagtaattatgatttcaaaataattaagaatattttgttgaaataatctctgagattctacttcaattccagggtatacagcagagcactttggattcatttaggaggagtgcttacaatttccatcttactctctgcacatgaagagaattctggaagcatagatgcttcactactttgagtgaatttagcttgacacagctgattagggaagacatcaccaatggttgtcattcatctgtgctttgctaagtggcgtgtcatctaaaacttaaacagccagaaactcgctgttatcctttcattcactgagacaagttgatatagaagctactggaataattaagtgatacttttacactatttgcagttaggaaaagttttatatacatttctttatttgtttctacatcctagcaagctgttattttcatcctcattatacagttgaagaaatgaggctgagaaatttatcataaatcatacagttaattaagggcatgtgatttggtcaaccatctgaagttccattatgccacactgacacagaaaacaaatattcttaggattagctagagtgcctaagaggtgagtagttgcttttttttttttttttttttttttgaggtagagtctcactctgtcacccagtctgaagtgcagtggtgcgatcttggttcactgcaacctgggttcaagtgattctcctacatcagcaccctgagtagctgggactgcaggagcgtgcctccacacctggctaatttttgtatttttagtatagacgagatttcaccatgttggccaggctggtctcaaactctcaacttgaagtgatctgcccacctcagcctcccaaagtggtgggattacaggcatgagccaccgcacctggccaagtatttgctttttatggagtggcagaggaagggtttgctttcatatctttttgcttagacaatgaccacttgattatgaaaattctgctggaagtgaaatcagggaaaggtttcagagagagattatttgggaacagtgtgaactaactcagtcttcacttactatgaaggaaggacagaaaagtcatttttccatttaataaatacttaatgtgtcccctctgtatggaagatagggctaggtactcttggagtaacatatataaaaagcacagctctgcagaacctcaaggaacttaagtttagtagaagtcaaagacatttttactattaaaatagaatagaaagtgtcagttactaccttatgaaaggtaaagtgaagtaagatgacatagaataatgtttccaaaaagaaagaacattcactttggctactggaaaattatggaagcctgcctgggatgaaagtattggtgttggaaggtggaaaatatagggaagaaattggacctggaagagtttggaaattgctgcatcactataggcaatatgaaataacagattgaactaatgcaatagccagttggaaagggtcaagtgaaagctgaagtaaggaatacgtggaagtagattctgtggcacttgccagttgattggatgtagcggatagcggagtaggggattgtctcagggacccgaccacctcttaaaggcccacctctcaatactgccactgtggggattaaatttcaacatgagctttggagggcaccgatgttcaaactatagcaggaatggaaaaagtttgaatatgggtcaccataaagttggtggtgctgtcatgaatgtcaggaaatgacaatgggtggagtatgtcacggcagaaaatgtatgacatacccagaattggatattcaagaagtgtctatttacaaaggagccatttcagaaggttttaggatgggggcaccacaaaggatagtgcagtatcctagtgcagtatctgggccttagtggctgattttatacttttgctatacgtgaattgacaagggaaataaataattacctggcctagaaagggagggtcatgtagtgacagccacattgcaggaagtgacctctagtgaagtaaaatggaccacctcaggcaacctttcagtaaaggagcaaagggaatacataccttgactttattattctctcctactgcagtttgcactgcaagtccaagggcaagagagtcctgttgacgtagtctgtataatcagcttcttggggcactgagcaaggtgggcaagcagatatggatatgtggatgccatgcagactgtgtgaactctagaactgagcctgggttgggtctagcagagctgtttgcacaaaggcacacacacaatgacagacaagctagacccttggataatggatttatttagatcagagttactttaccttggcactattgacattgtgggttagataattctttgttattggaggttgtcctatacattgtaggatgcttatttaggggcatccttggcctctacacactagatgccagtagcatgcacctccaacccctgacaaattttggtaatgaaaaatgtctctaggcatcgcaaatatccaccggggtgaggggcagggtgccaaagcaaaatcacccttagttgagaaccactgattagaggctggacaaaggaaggtgagccagagaaaaggaggccaagaaccagcaggctgagaggaggaacagacacttggggagtgtgacagtggttgacgtggttgcagcccacagtgcgtatccatagaaattcttaatagggactgggcctgtgaagtggagaggcagaaaggagtagatcagacggcagcaggctggggcgggcaggtgggaaagcagggcagccagcatgggcctagtttggcagcagagggaaggcgcagggaagcagggtaccttcgacaggtgggtttaagatttgcttgaggacagagagatttgaacatattggtcagatgaggggaggaaagcagtgaaaggggaggttggagatgggtagtgaaatccaccacctgcagagtgcatgtgatggccttgttctggggctttccatgtgttacagcattcgactctcacgacctctctaggaggttgtcagggtgggtgcccttatgatccccattagcaggtgaggtaattgaggcccccagtgtttactcactcatacctagtccacacagctagtagtggccaagttgtatttgaacctgagctgaagcggagtgagaacattccagtgagcaaaagaaggatgcgtgcaaacccttagaaataaggagggaaggtgaaagtaagcgaagttatggacgtatttgatgtttgacaggaggtggattacagttcccggctttcaacggaattaacaggctcaggaaggtaggcgttaacaccctctgcagaagtagtcttggcagaggccagcatagaggatattccccaagaggtggctccgacttcaaaatgtcaagagcatggttgttcccgttgtctgtgccccagtgcttctctgatcctttcaaaggattgttgtgcagttgtttttctcatttttgtgtataaatgttttctcttactcttgtaacaaattaccacagatttcatgctttaaaacaatgctaatttgccattctggaggttagtagtctaaagtcagtttccttgggctaaaggtgaggtgttggtggtgctggtttcttctgaagtctctgagggaacatttgtttctctgccttttctggcttctggtggctgcctctattccttagtatgtggacccttcttctatcttcaaagcacatcactccagcctctgcccccatccttgtcatcacattgctgtctcctctatgacttcctgggtcccttgtacaaggaccatgtgataacactgggcccacctgtgtaatcactgtcatctcagggtccccactgcaaggtctttagcttaacccaatctgcagtgtccctttcgcatataaggtgacattcacagagtctggggaacaggatgtggacatacttgggggctatttttagcctacctcggttggtttctatgtaatattctagatggatggaaagatggtttagcctagaggtgaaggacatgacctctgttgcttagaatcaaatcatcacttcccaactctgtggcttgagtcagtcatttacccttgctgtggtcccatttcctcgtgtgtaaaatggggatagtagcattcacctgtgttatttgggggattaagtcaaggcatgcacagtgtggcaaatacaatgcggggctcttactgagtattcagtcagtacagtcaattattattcctgcaattattttatataaacattttcttcaaagtattttaactagaagagtgctgcccatctgattagttaatagattaagctgtttctctaaaatcaatgatcacgtgatcgaaagatgtcacttcttggctgatagaagaaaatgcaaaaacagggtttgtgtcactatggttccccaaatcatagatgattaccttcaagttagcatgaagtcagaactgacattattgtcaggaaaaaatctgctttgttttcctcttaagaaaaaattgtaatcataataaccttccctgcccagggcaaagcaaacaactaaactttcagcaaatcttcaccagactcagcacatcagatcaagctctttttaacaccttgatttttttttttttttttttttaaatcactgtagcacccaacttagcttcttctttttatgctgttttcttctggcctctgagatgtcatgacctttttaggttcatgttagtaggtaatatttaagtacaagagttctgaaatttaaaaaataaaagaaaaagatacacacacacacacacacacacacacacacacacacacaattagggtttagggtgacctgaagattatcctggacaagctgaatgtgacttgggtaagtcacatatcctctctgcctcagtttcctcagctggaaattggtggtgatgatacccacattatagggtgttatgagagtcaaaagagataaccgttgtacaagtgtgtgcctgtgcctggcacactgtgaacaacaatgaacaagaatggcgatgatgatggcagcagtgaggatcatagtgggagtaaaagggaagatgaggaaggaccatcagaaaacgaaactgggaagcctaatgtggggagaaaaagacaaaacatgaggaaattattcttcttatggcttggtgtatggataatggctatctatgtattctgttgaatttttttttctaatagcacaaatgtaatgatattttagaaaacaaacaccattcaaaaatcctttgttttatttggaacaaactttcaaaactcatttctgcctaggttcatattgaagcttcagattcttccttaatatgtgcttggaagtaaacatgatatggagctgtaatccatgtgattaattcagtgaaaacaattaagctgaaactagaacctagaacccggtggtcttgacttttttcctcatgctgccatcattttaaataacataagatcaactgtttaagtgagaagctaatttacctgccagcatatttagctttgttgagattcttccatatcctacagataaaaaatgagattaaaccatgtatatgtatctattcagtactaaattattctgtatgaaaagacaagtactgtgaaacttctattaaagtggccacaagtatccctaacatagaagtagtccccctctccgcgccccgccccccccactttttttaagttggctaatttaatgagatatttacattgttatcagtaaccactaaggagttacaaaccattacttctacaggcaatggccagtgtaattaaaccttttaaccttgctagttttcccagtttgccattatcagtcattggtcacagtacatattttttcattattagccacaaactagctatgtgaccttaaaaggttatttaaagtctccagactttatttcccaacccccccaccccaccccatgaaaggaagaaggaggagacaatgatccctgtggtccatttcatctccaaaacccaagaccatggttctgcaacagtttaacaatctggttaacatttgaaagtaaatgaaaacgagagaaaacattgcagctctgccagcaattttctctctctctagttggataaaaactatccaagttgtccctgtttgcaaaggagggtattattatatatatatataatatattatataatatataaaatatatatattatataatatattatatataatatatatcataatatatatcataatatatataatcatatatatatatatttaagagacagggcctttgctctgtcacctaggctgaagtacagtggtgttatcatagctcactgcaacctcggactcctgggctcaagtgatccttcggcatcagcctcctgagtagctaggactacatgtacacaccaccatacccagctaattttttttttttttaattttttgtagagacagggtctcactgtgtttctcaggctagtctcaaattcctagcctcaaaagatcctcctacctcggccttctaaagtattgggatgacagatgtgagtgcctgagcccagctgtgatttatattttaatgaacaaaagattagaataaaatttgtaaaatttttatttctaactatttttcatggcttgacataaaataaatgtgcatttgggcaaatactgcatttcagtgaggcatgtacttccattgtgtgttgaaatgtaagttggcataaaagaaccaacaaaaaagtcattacagttttattatttgttgacagcaagagagaaagaaatattctctcaagatgaacaataatgtcctgttaactgacttaaaaagagcaaagtttaaattgcttattcagagaactctaccttctaatactttgagcttcctggaaaaagaaatgggttcttgataagttatgtgaattgtgcttcgacataaatgtcaatgtttgatcacaagttttttttaccaaatgccaatctgcgaggtcagctagttcaatgagtcattttgcttaataaggaaatttaagtagttgtttctatcctttgttgtcacgttggaaatgcttcaaagagaagctacttgttctgataaaatagaataatatgaactttggaactagacaaaactgaattgagttttgcctttgtcactaaattaactgtgtggtgttgatatgtccttaaaacccttgaagcttttacttcccaatctataaaatagggatgataataccttcttggtagaatgggttttgagatgacttatctactatgtttgttatcccctgccacttggtaataataatggctagcatttattgagtgtttaccatgtttcaggaaacttgtaagcactttgtaagtattaccatatttaattctcatgacaatcttgctgtcatttgaatatttgtcctcctaaaaacttattttgaaatttcatcctgaaggtggaagtattgagagatggggccttaaaaaggttaatgggtcatgagaactctatctcatgaatgaatcaatccattcttgaattaatggattaatgaattactaggttagtagattaatgagttatctcaggagtgacactggtgacttgaaagagagacctgagctagcaagctcagccccctccccacatgatgccttgtcccaccttggaactctgcagaaactccacaccagcaagacggccctcaccagatgcaacccctcaaccttctcagactctgtaactgtaagaaataaattccttgtctttgtaaatttctcagtttcaggtattccattacaaacaacagaaaacagactaagacacgccctacaggtggatataatcattattctcattttgtaaatgaagaaacagaaacaatgacaacttatgtaattggccaagtgaaatactactaatcattaaggccagcatttaagctctcatggtgttttgctctagtgaccctatttgtgacactacattattctttaccttggtggatactcagtaactggttgccatttttattgaccatggtagtataaagcatcaagtttagcacctagctaggaatccaggtgttttcttggttctctcacttacccaggataatcaggtcttcagcaaatcatgtctattgtacctcctaatccctcttcttctaattcactttttccttgctgcctttaatctaagccaccattctttctctcttccaggctagggcagaagcctcccagtaggcccctccttagctccttgagttcttctcctctctcatccagagtgcagccagaaggatcctttacaaaaagaagtgtgtgtgtgtgtgtgtgtgtgtgtgtgtgcatgtgtgtatgtgtgtgtgtgtgtcccacctaacttaagagtttgggggaatgcccccatttcttatagcttttaggaaaaaaacaaggatccccatcatcgcgttcaaggtcctacactgaggtgacatagctagtatattcagctaactctgaaaggtcctttattcacttccttagcaatattaaacaaacccttggacacattaaatccctgttcccagcttttgcaaatgccatccccactgcctggaatgttcttcctcttttccattcacctgggtaagtttcacttttccttcattttagcttaaacctcactcctttggaaaagccttactgtaattccaatcatacgtgtgtgtgtatatatgtatatgtatatatatatatatatatatgtgtgtgtgtgtctgtgtgtgtgtcggtgtgtgcatgttatatgatttggccgtgtccccactcaaatctcattttaaattcccacctgttgtgggagagacccagtgggaggtaattgaatcatgggggcagatctttcctgtgttgttcttgtgatagtgaataagtcttgcgagatctggtggctttaaaaatggaattttccctgcacaagctgtcttctcttgtctgccaccatatgagatgtgcctttcaccttccaccatgattgtgaggcctccccagccacatggaactgtaaatccaataaacctctttcttttgtaaattgcccaatctcggttatgtctttatcagcagtgtgaaaatggactaatgcagtaaactggtaccagtagagtagggtgttgctgaaaagatacctgaaaatttggaagtgactttgtaactgggttacaggcagaggttggaacagtttagagagctcataagaagacagggaaatgtgggaaagttttgaacttcctagagacttgttgaatgactttgacaaaaatgctgatagtgatatgaacaataaggtccaggctgtggtggtctcaaatagagaggaggaacttgttgggaactggagcaaaggtgactcttgttatgttttaggaaagagactggcagtattttgtccctgccctagagatctgtgggactttgaacttgagagagatgatttagggtatctggtggaagaaatttctaagcagcaaaacattcaagaggtgacttgggtactcttaaatgcattcagtttcagaagggaaatggaacataaaatttggaaaatttgcagcctaacagtgcagtagaagagaaaattccattttctgaggagaaattcaagctggctgcagaaatttgcataagtaatgaggagctgaatgttaatcaccaagacaatggggaaaatgtctccagggcatgtcagagacctttgtggcagtccctcccatcacaggcctggaggcacaggaggaaaaaatggtttaatgggccacaccaagggtcaccatgctgtgtgcagcctagggacttggtgccctacatcccagccactccagctgtggctgaaaggggccaacgcagagcttgggccatggcctcagagggtgcaaacctcaagccttggcagcttccacatggtgttgagccttgtgagtgcacagaagtcaagaactgaggtttgggaacctccaactagatttcagaagatgtatagaaatgtctggatgctcaggcagaagtttgctttaggggtggggtcctcacagagaacctctcctagggcagtgcattgggcagtgtggggtgggagcccccacacagagtccctactggagtactgcctagtggagctgtgagaagaggatcactatcctccagaccccagaatggtagatccactgacagcttgtaccatgtgcctggaaaatctgcagacactcaatgccagcctgtgaaggcagccgggagggaggctgtaccctgcaaagccacaggggtggagctaccccagactatgggaacccacctctagcatcagtgttacctggatgtgacatatggagtcaaaggagatcattttggagttttaagatttgactgccctgctggatttcagacttgcatgggccctgtaacccctttgttttggccaatttctcccatttggatcagccatatttacctaatgcctgtacccccattgtatctaggaaataactaacttgcttttgattttacaggctcataggcagaagggacttgccttgtctcagttgagactttggactgtggacttttgggttaatgcggaaatgagttaagactttgggggagtgtagggaaggcatgattggttttgaaatgtgaggacatgagaattgggaagggccaggggcagagtgatatggtttgtctctgtgtccccacccaaatctcatcttaaatttccatatgttgtgggagggacctggtgggaggtaattgaatcatgggggcgggtctttcctatgctgttctcgtgatagggaataagtcttaggagatctgatggctttaaaaatgggagtttccctgcacaagctctcttctcttgtctgtcaccgtgtgagatgtgcctttcaccttccaccatgattgtgaggcctccccaccaacatggaactgtaagttcaataaacccctttcttttgtaaattgcccagtctcgggtatgtctttatcaagtgttaaagtggactaatacagcatgctaatatgtgtgtgtgtgcatgcctacacttgtgtgttttaaataaataaaggtcctccaataatggtaagtagtaatgatactggtaatatgaatggtagtctgtcagtagtaatgaagcctttgttcgggaaatatgacttttgaaatgtagaattcatgtcagtcattggaatagactagtacctttgacgtgcagaagccaatctgattgctaaggtgaagctcatagcctagacttggttcagggggactccctcctgctattaaggttagaaccagggtagaagttggctgctgcttcaaagggctggaaactctgaatacctacttaagtacaatagcccactcctctgataagctgtgattggtttgcttttttctccctccagcacatgattttgattttactcctttcagctttagagctgccttaaagattaatttaatctaatttcatattggttataattctggagtttgtaggtaggagagtacaatgaggtttttaagatggcccctgggatgttcttgggcggagaactagtagtagcaggattagtgacaaaaggcaataggtttttgtttgtttgttggttggttaattttttttctgtttgtttactaaaatgcagatttcaccaaagcaagaatatccggaatagtcaggatgtgcttagtcagttacctctgtgggcggatgctccccttgctcttttttcctttccttttattggtaacttgtaatcagctgctactttagtttaatgagaaaaataacagtttacattacatctagattaaagaaactgctagacgaacaggggtgggcaagttgtcaatggcatctaataaatagtagtaagtaattagcacaggtctgatggatttgaaggaaagtaaaaaactagggaagaggaattgtggattggggaaacatagctgtaatttgagaataacacatcaagaaaataagaatgaagcactgaagtcagagatctgtggggactgtgttggggagagggttgggggcatctcgtctgaggaacaaatagagtagaggaacatctcatgctgggtttgtactctgctcaccctgctccactccacctctcaggcttttggttttatcagattgtgtctataacaaagccagataaaagtgacaaagaagtgcagttcaaggttctgctgtccttcccttgtctctgggagttagcaagtcacctttaaatgagaaaacagtgtgaccttacgtacttcacacggccattctgagacaaagttggagaagtgtcatgcatcactgcactcttctaaggggtggaaggaatcaagcatattccagacctaggagggatttcttaggaattcacactgatgtaatttcaaaactcccaagacagccaccacttgtctggcattagctaacctatgacacttcactcaattgcattttgagctcctgacttagttcattcagtaacgtttttgccccaggatgccaaagcaaacactggtcctgaactttgcctcttgaactacattcttcaccatgatgcccttccaaattccctatagatgttttcactactggtgtgtacaggaaggaagttcactttgactaataaccaactctgttatttctagtggagtgatcatttgtctcttctgtccattggcctccctttgattcaagcagtggggtgtgtagaggaagctctgcatccacttgacaagccttttaggtcccaacagcagtggactccttatcagggctactcataaaaggctaaccttccaaaggaaacttgtcagggctcagctgttggcaagatggattaacaagtgcttccagctaatggagtagacattggtgacttaatgagggtagtttgaaatcttagctgtattctcttattctttttttttttttttttgaggatgataaatgagtttagttctttcttagctaagaaatgccaatgatttatttttattattcttatttttattttttattttttagagatatggggccagggtcgggggcagggaaggaagggaagtctcactaggttggccagaatggtctcaaactcctggcctcaaacaatcttttcacctggtccttccaaagtgctgggattacaggtgtgagccaccttgccctgcagaaataccaattattaaaaactcagaggttgtagtgcaacatatttgggagtggtcacaccccatggcctttgattttagtctgaagattgaaaataacctttggattttaccttgacaaggaagttgttcctcagtggacacagacatcatagttggcatagaaacagctgttgggttattcctgggccattgaagacatggcacctggcccagtctgaatggttgttctctcctggttgcttgtttaaataaaggttaagcaaaaattcttttttggttttgatttcaggaagaaataagggagtgactgcaatgttatctgaaaatgagcatttcctgtttcctcaggcatttctttatgacccccattaaagttaatgaataaccaagtgtctgacacagttgagcgtaatatgcctcacctaaggttcccggtggctgcacatttttgtgggaaatgaccttcagttcctgcagatccattattaggcaatctcttagttatagactttatcttcccaaaacattcaaatcacatattagccaaatcacttagataccgtcctaagtgctggaactctttaagtcttgttagcagaaaaggctaaagtttaggtaaataagcagatctgttccacaaatgattcctcaccttaggtatttatgaaaaagctctgataaacttttgaaagcagaaaaagacgttaaaaaatcttactgtgagcctgaaaacataaacataaatcagctaaaagataatttgccttaataggtagtgggcgatgggggaggagagtgatcagggctcaccctggcaaaattgtctctgccggatgtttcaggttcgccttctctccccgtcacctcctcagaatcttaggagaccacataggatcaatccttgttcaaaggcaaaggcaaaaaaagtatgactgcaaatatgtgaagtacgatttggcacggagttcattttgggaccctaagtcctctaggcggtacagctatatattgcaatggactgagtgtttgacacacttgcccagaactcctgcatacaaatgaggagtggcatccttaacctcaggcagttaaatgttccattcccctgaaactaccattttccaaagagctttggaattgtcttagggcctatttaaatgccataggaaaaaagttaatttcatttctttttatggtcccatgtcatttttaacccctagtagtagcagtatttctagctgttaaaagtaagtatttttgagtcacaaatctaacaattgatttgtggcaatttgtttaacctcctagagccacagcttacttatttctggaatggtatgatagtaaaatctaccttatggggcctctctgaggattatggataaagcggttaacacaattccaggcaactagtaagcattcaaaatgtgttactattattactgggattgttgccgccgttgttattaaacaacttgttcacataccttttttcactcgacttggctcagaattctaccagactgttcagaaaaatcaagtgtgtgtttaatgtacagtattttaaagtcacaaatccagaggcttttaagaataagttacaaggtctgaagtgatttttgaaagtacactgagcggagtagatcctgttgaatatattccaggctctaaaatgactatttctaaaggagatgatgctgtggaatatgttataaaggaacaaaaaattactttactctgtagacacatttcatagtttttgtgcaattttctagtttcaacagcttgtccaatatgtattgaatatatattctatgaatgatatgtgctagattctccttgggatgccatgttatagaggtcttcagaacgctttcattaagattcattcatatgtcaggacttaagatatatatatatataagaaatctcatgaacagaagtttcagaaatcagttcattgcttgcctgaattcaaggagaaagaagtcttcagagtgaagctctggatctaggagagaattttctcctcagcctgttttcaggaagtggcttctgtgtcctctgtgcttggaaattggacgattttggttaatgtggaagatcttaatgaatactttctaagagtaaggctatatacaggtcaggcacggtggctcatgcctgtaatcccagcactttgggaggtcgaggcgggcagatcacctgaggtcaggagttcgagatgagcctgggcaacatggcgaaatcccgtctctacaaaaaatacaaaaactagcagggcgaggtggcgtacacctataatttcaactactcgggaggttgaggcagaagaattgcttttacctgggaggcagaggctacagtgagtagagattgtgccactgtactccagccagagaatgagactctgtcaaaaaaaaaaaaaaaaaaaggctttataaatatcaatatcaagtccatccctccttgccctgtgtttatggggaacagtagcaacatggccaaagtcttgcccaaggcgaggtttaaattttgcagaggcatttgactctcttacagattgtcttcaagaaacaggaaggaagggtttcttcagaaactcctggaggaatctatgtttttaagtgacattgatgcttcatatgtttgcctctgaagatataacttgttttattggagactgaaactacctatttgctatatctgagaggttactcatcagtacccacatctggcattcgcactgaccattctttgtacaagagcttggttttaaaggccataaatctgatatctacactagattgaaaactatctaataaagctccttctcaagcataatttactacggtgggatgctgatgaaacagaaggatttacatatgagttttatttttaaaaatttatttgtaacatcaatgtccggaatttctgcagacatttaaaattattgtttaatatttaaattatttattctaaaaatatactttcacatggggtatataaataataaagacttagattaaaagaagaaacacaggtaagattatgtttataaaaataaaaacaatgtttatgtaagtaattaattaaaaagtattctgtgaatacaaagcagtatcaagatgtgtgtgtttgaattatatggttttttttaaaaagtatgttaccatatagcgacatatagaattttagcttttttggaaacaatcccaattatttcatatattacttttctggatgaagggatggtatggaataatggaataatcagtggatattcctgataatgttttaaaaatagagaaatatcctgggtgaagaaaacttcctttggtgttgatttggatctgattaatgattttgataccagtgggctagggaagatccccaaatgccagtgaaaccttggcctcagctgctgtccaggctcttgacaccgtcctgagaatgaattcaaggatgagttggaaaatagtggaagtacacagatttattacaaagcaaaaagtacgcattcaagaaagggcagtgcaggcagattcaagaaaagggagtggaggcagactcaagagagagtcaggtgcaagggggttgggactgctacctttatgggattctgtaaccaaggggtagaagattcatgaagattcctggaacaaggtggagatttcttggaactctggtaccacccatttttgcactaaatatggatgtttctagaactgtcatagcgctggtgggtgtgtaatttaagatgttaatgagcatataataaggtcctaggtgaaatctaggtcaaatccagtgctatgttgggtccggtccgttttaggtcggtcatagcttggtccacacccagattttttcaggatcttatctacccctagcttctgcagctatttcaaccgtttctttttgctagtcatgtgaaactgctgcctggaattttctatgttcctacaatcaccctgtattattcctatgtcaattttaaaaggaattatttgtctctggggatcttcatgagctgtggtttctctggggatcttgatgagctgtggttacatagctctaaaatggtcctgaggatgggtcagtttttacaagtagccggcagcttaaatggggtaggcagttacactggtcatttcactgaatacatcagctggcctggcatttcacttgaggtcaccaattctgagccccagagaggagccagctgttcacatttccaaaacccctatgtcaacgaatgggttttggaaatgtgatcagcctcatatttaatatcgggagatacacaatagataaaaaatgttgcctttggaaggatgtgacttgaataatgctgcaaaaggtggaacacaatttgagtgagttaagaagcccagggtagttattttggaagttgcagatttgctagcctgctatgttgagatatctctgaagacaggggctcaactccaccaggacctgaggtctttgcttaaataaccccacataaggcccttgtttcttccaaggaccaagagaactgagagctctgtttcctttttttttttctttttcttttttttttttttttgagatggagtctcgctctgccgcccaggctggagtgcaatggcgcgatctcgactcactgaaacctctgcctctcaggttgaagcaattctcctgcctcagcctcccaagtagcagggactacaggcactcaccaccactcccggataatttttgtatttttagtagaggcggggtttcaccatattggccaggctggtcttgaactactgaccttgtgatctgcccacctcggcctcccaaagtgctgggattacaggtgtgagccaccacgcccggctgagaactatgtttcttaaacttaatctgcaacatgactttaatattctaaatctctaattagtagccttgggctgggggaaggccccctgaaagttattgataagaaaagttatgatatattactcacatgcattatttttgctccaggaagataaagatcaagaaggggcagaattctgtgtctttctgtgagactgtctctttttcaacatttatttagtttccatgtgaaactccttacactgttgtaaactagtttcttgccctgtacacagcttgctgggcctgctgctgttcttgatggcctagtaggaaaggaaatggcttgagacactttccacctttcctaatccttcttaagccttgaatgatgtcagtgcaaacaccaagtgaaaaaaaaaatctcacgttgccccatttcccaactgtttgaccactgcctgttcatggacagtgaacccactcataccataacaactttgcatcattttttttttaaagaattgactacacatcaaacacaaatgcctaggtcttgggtagattccaacaaaacattacagtgagaaaaataagaaaaaatatgttacagtgagcaaagccctcagcctctgcactgaatatccttagcccttcattttcatcagattttcttgaatcacagacctaaggaatttattttctctactttgcaaaggagctaactgaggctgtaaaagacaatgctcccaatgactctgacttcaagagacaagactatgataaggaccaagttactttatttccagccttcaatttgatttattgtttttatttatgcactgcctacttcaaaaagtgatttgagggagactacagatcaaattccctttcaaaatagatctcacttctttgggggaagatgaaagggtaagggtgaagcaaggtgacacattttagttgacaatctctagacttgggctgtcatagactagagttggattcagttatctaatttgcaccgccttaattaatgctccaggtctacaggtacatagtgtgaatttaaaagtttgaaatattcagatcaaaatggttataactgtaaccattcacctatcatccatccatccaactctccatccatccatccatccatccaaaagacatttattgatctcctactcagtattaagcacttgtcatattgagtgggtggtgggaggagaggatagagtcaggtgttaacgcatatatgtacacataactacaaattatagtaagagctgtgttaaatatggcaaccattttttaagtctagaatttatttgaggctatgcagtagagaaaataactcatttatttctgggtaagtagtttaaggatcacttttccaaagtgaagtcttttcttaaaaatagaaatttctcatctacaacattcatcatagaaagaatgcagcattgcatcagaactgatgttcttgctcataaaataaacaaaacacaatggtgtctctatctgtagaatgtaggtgttgtaacacatctgcctagaagctagttaaaatgcatgttgttcttatatttcaattagaagtaagcagacttgattgtctaacacaaaaactcagttgctttgatgtatttgtttttgcatatggttcaaattatcatcaaaactgtattatcagtgataatatactaatgcagtaggttgacattaggggctgactagctgactgttgccatatataattaatccaaagtaatgtgatatggcctttaagatgtaaaagaatttacacaaattattttctcccattatttccagagattagatgttatggaaaagacttttaaaagatgacatgatttaatagccttttcctaagtagactataatacctgtaatgcagaagaatttagaacttttagacatgcatctagtttacacatttaaaagctaaatgtatatcgtatattgtgaagttcctttctttgaaatttttttaaaaatcagatttgaaaagcctttttgcctatgatgttttagagataatactgctggaaagcaagaacctgacataaaagtccataacgatagctttctaggctctaatcctgtgattccactagaaatatcttttgggtgggcatgacattaaccatcctgtcttacaaatacaatagaatatttaatgatcttccattgtattctggaaaatagactgcattctctttctctatctgcctccctctttctcccttctcttgtcctttctggtactttgccagaaaccgcctgtttctttcctggagtccagtaattgaaggtaattttttggaagatggtttcaattatctaaagccagtggaatgtttaactgccccttgctattcgtgaacttgtttacagtgggatttcagatgaattcagattacatgcaaccagatgttatctgctatggttacttttttttttttttggtgaaggaaaattgtatgagggaggggtctttgatatcatatttagatcaactgccctcaaattcttggaagtgtgcccctgggataaagttttggggtaaacttttgatcccaaccaatgaacatccaaatatgagaatatacattctctgtgtaataaatttaagatcttcccattttctgtgtgtctttatatgatactaatccaaaaaaattgcctcacaaaaatattttgtcatccatctaagttagagataaaacaattataaactgaaagctcattctattcttactctgcctaaacatcacagatttactgtcatgctgcccagataatagaaaataaatgttgtgatatttaacaagaaaaaaaatctgaagtaataaaagtcacctgtgaaacaacaactaaatgctctagtctgtagacagttgaagactaatttccttaactgacagctgaagtgaaggcttagtaagatgtattatttgtaaaggttgaactttaaaatctgaaagagaagttgaatacacaaatcttagcttagaaaacagatagatataatcaatctttatgaaataattatttgccttatttaggaatccagcatacacttaagagattttttttaaagttggtttgcaatgtaattaaaatatgatttaattttcaaagtttaattgcacacaaacttttagaaaaatgaaactatctcttgttgaatcttcaagaaggcatcaggcatgattttgctcccctataggttggagaagacatccaagagttttaggattaagagaatacaaatgcctttacatacacagacatgcctacatgcatgcatatgtgtgtacacatacatgtacaggatagatatgtacatacatacatataatattttttcttagcacttagttatatagcacttgccatattacctgaatgtagtttacacttcattgaataaaaaaaaagaacaaataaaacaattcaagattttctgcaagcagaaaagggatgcccaacaggagctgtgggcttcaagggatgtaaccactatcaaaatcacgctctggaaggaaagagtgtgttaggaaggaaaaacgttcttgatctctcttcccaccacctgttctcccggggcctcttgttgcactcacctaacaggaaggcagatggcacgggagcaggttgaagagtaggggatcaacctccccagtcaaaaagcagagcagagctgactggagaggttcacttgaagctaggagtttgaaaccagcctgggcaacaaagtgagatcccatccccaccaaaaaatatataataaataaaaaggaaatagaaaaaaagcagagtagagaaatacgaaaatgaatatggaggaacagagaaacaccagcacaccaatatctctcactgatctatgtactactgttcttatgatttgaacttcatgcaaaaatgccactgtttcaattatttttctactagtgtagattatagtctttccagtcaatgaatgtagtaattactaatccacataatgttccattatgacttagatttggttgatctggctgtgcatggtggctcatgcctgtaattccagcactttgggaggccaaggaaggaggattacttgagcccaggagtttgagagaagcctaggcaacacagtgagactttgtctctaaaaaaagaaaaaaaagtaacaacaaatttagttgtttttttcaaatgagaattttaattatgaaccaaatatataatggaaatacaaaactacatcataatatttacctgatttattttaatatatactatatatatggccttttagtaaccaactgtgtacacaaaatgcatttgataatgcagtgtcaagttgcagaatcattttagagataagatatggaatattaaatatcatttttgtgttttacctattgtgtgttttattttacttgaaaataaaacttgtagagagatgggattagttacttggtaaattataagaagaaatacagtttcctcaaataattttacatatgaaaaattagacgtaagatgaatacttaattgacaaaagaagtaagtctaaatagccatatgggtcaggtgcggtggctcacacctgtaatccccacactttgggaggctgaggcaggaagattgcttgcaccaaggagttcaagcccagcctaggcagcgaagtgagaccctgcctctaccaaaaaaaataaaataaaattaataaataattaataaaatgaaacaatcatatgtaatgctcattaaatttcaaggggctaaatttatatgcacataatacatgaaaaattcatatacagtgtcatacgctgtcagtggaattaagctaaatattgacaaaacgttaaattaaaaataccaaaatggtaagaaattcagaaatgacttaaatacctatggatttaaaaataccataatggacattataaagtattttgaaaatgaatgataaaaatattacgtatcgaaacctatgggatgcagttaaagatgtactcagagggaaatgtatgccttaaatgcatgtataagaaactagagaaggctgaaaatccatgatctaaactttcagttgaagaagctagaaaaaactacagcgaaagtaaaacaaaggtaataaaggtaagataaaaatttctgcgctggaaaacaaacacataatagagaaattcaatactgctgatctttagattcagtgcaataaagattccaacaactgtgtttgtgtgtgtgtgtgtctgtgtaaggtaccaaggaattttaaaagtaatatggaaaatgaaggggccaagaattgtgaagacagcttgaagttgcacacatctgatagacttgtactactaaatatcaacatctattataagtagggggtctcacgggccagtgtgctctgcacatggctgctagccttggctgtgtggcttttcacatcaagggaatgggaacttccggaggtcagccaactctgcaaataaccagtactcagatccactgaagcctacctccaggaatctgttacatctgagaccaggaaggagctgtgaacattaacgttgataaagaaaagcccattgaagagtcttccagagaggggaggcagagcgagatggctgaatagaaccctccagcaatcatcttcctcctctacccttgcaggaacacaaaactgaacaaatatcaacccaagaaagcaccttcatgagaaccgaaaattaggtgagtgatcacagtacttggttttaacatcatatcaagggaagagacactgaaaagggtaggaaagacagccaacaccaccccttcctcatcccccagcagcagtgggctgcttggcgcagagagataatttgtgcttgggaaaaggagagtgcagtgattgtaggactttacattgcaactcagtgctgccctgtcacagcagaaagcaacacagggcagaattcagccagtgcccatggagggagcgtttagatcagccctggccaaaggggaaccgtccacaccagcaggcgggtttgagctagctccaccactactggctgaagtgctccattgtagtccttgtggcctagactgcctttcagataaatttgaaataaatttgcctttcaaaaaaatttgaaaggcaatctaggctacaaggactacaattcctgggcaagccctggtgctgtgctgagctcacagccagtggacttgggtgcacatgacctagtgagacacaagctgaggcagccaaaggaatgcttgtgtcactcatcctccaacctcaggcagtgcagctcacagcactgggaaagactcctttcccttgtggaaaggagaaggaaaaggagtggggagaataaagaggactttgttttacaacgtggataccagctcagtaccacagtaaaataaagcaccaggcagagtcctgaggcccccattctgggccctagctcccagatgacacttctagatctaccctgggccagaagggaacccactgccttgaaggggaagtatctagtcttggcaagattcattacctgttgaccaaagagtccttgggccttaataaacatcagtggtagccaggtagtactctccacaggcctcgggtgagacccagttctgtgctggcttcaggtgtgactcactgcattcccagctatggtggctgagagagattccttctgcttaaggaaaggagagggaaggttaagaaggactttgtcttgcaacttgggtaccagctcagccacagtaaaataaagcatgatgtagattcctaaagttcccaaattcatgcccttgcttcttgacagcatttctagacccacctgggtcagaagggaacctgccaccctgaagggaaagacagaagcctggctggattcaccacttgctaactaaggagcccttgggccttgaatcagcagtagccaggcaatagtcaccatgggccctgggcaagtcccagtactgtgctggcctcgggtctcacccagcatagtcccagtgacggcagctataggggtatttgtgtcatcctccatcccaattccaggcagttcagcatggagagagagactccatttatttggcagagagtaaggggagagaacaagagactgctggtaatctagggaattcttctggctgttacccaagactaccaagatggcacctctatgagtcatcaaaaatcatagcatcactaggcttggaatgcctcctaatgcagttacagctgcagtgaccaaagattagatcacaacattcatttccctttgaatgcttggaaagccttctcagaaaggtcgggtacaaataagcccaaactgcagaggttacaataaatacctaactatttaatattcagtgctcagacattgacaaacagacacaagcaccatggtcatccaggaaaacataacctcaccatatgcactaaataaggcaccagtgaccaatactggagtgacagtgatatgtgacctttcagatggagaattcaaaatagctgttttgaagaagctcagtgaaattcaagctaacacagagaaggaattcagaatcatatcagataaatttaacaatgaaatggacataatttttgaaaatcaagtagaaattctggagtggaaaaattcaaccaatataccaaagaattcaccagagtctctcaacagcagaactgatcaagcaaaagaaagaattagtgaacttgaagacagggtatttgaaaatacacagtcacaggagacaaaaggaaaaaagaataaaaaagaatgaagcacacctataggatcgagaaaatagtttcaaatgggaaaatctaagagttattggccttaaagaaaaggtagagagtaagattggggtagaaagtttatttaaagggataataacagagaactttccatgcctagagaaagatatcaacgtgcaagtacaagaaggttatagaacgccaagcaactttaacccaaagaagactacatcaaggcatttaatagtcaaactcccaaaggtcaaggttaaagaaagggttctaaaagcagcaggagaaaagaaacaactaacatacaatggagctccaatatgtctggcagcagacttctcaatggcagccttacaggccaggagagagtggcatggcatatttaaagtgctgaaggcaaaaagcttttatcctagaatagtaagtatctccagtgaaaatatccttcaaacatgaaggagaaataaagactttcccaaacaaacaaaagctgagggatttcatcaacagcagacctgtcctacaagaaatgctaagggaactcttcagcctgagataaaaggacattaataagcaataggaaatcatctgaaggcacaaaactcattgggagtagtaagtacacagacaaatgcagaatagtataacactcattgtggtgtgtaatggtgtgtaaactactcatcttcagtaggaagactcaaagctgaacctatcaaaagtaataacaagaacaacttttcaagacactgacagtataatatgtgaacatataggccaggtgccatgactcacacctgtaatcccagcactttgggaggctgatgtaggatgatggcttcagcgtaggagtttgagactagccagactctgtgtctacaaaaaaataaagaaattagccaggcatggtggcccatgcctgtggtcccagctactcaggagactgaggtgaaaggatcgcttgagcccaggaagttgaggctgcagtgagccactgctccccaacctgggtggcagaccaagactctatctcaaaaaaagaaagaggaaaagatatacatagaaacaacaaaaagttaaaaagcaggagaatgaagttaaaatgtagagtttttattagttttctttttgcctttttgtttttgcaatcagtgttaagttgtcatcaatctaaaataatggcttatttgcaagcctcatggtaacctcagattaaatgttaaaacacaaaatagcaatgcaaaggcatgaacaaaattttgtatgcaatatgggtaggtttcaaaagtataatcttgaatgatgaaaagttgcagaataatgcattcagtatgatacaatttaaagatataaaagcaatactgtatattgttcagggctatatatctgtacaaactttaagcaattggctgaagggatgcatactaaattcatcattgcagttactcttggaaagtggaatttgactgggaaccaagaggacttaattttatctgtaatggtttctttcagatgaaaaaataaaaggcttaaagccttgaagggcaaatatcaactgaattcatgatgatgattgggatagaagaatacttttctacattaaattttttttattttcctcagaaagcaaaacaaaacacaaacaaacaaataaaatctattatgaatgattgggactgggtataaatgaggtgtttggaattctggtgatgttctataacttcatcaagaggtagaaacggccgggcgcggtggctcacgcctgtagtcccagcactttgggaggccgaggcgggtggatcatgaggtcaggagatcgagaccatcctggctaacacggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaagaggtagaaacatggaaatgttcattttgtgaaagttcatccagccatacaaggtaggattggtccactttgttgtatgtgtgttatccttaggtggaaatttctggagcaaatatggcaaaataagaaaatttgacgtagtctgacataaaacttgacatacacagattattctttatgcttttctaaaagcttgtgatattttaataacttcaaaagagatggttcattaataaaaatattttgattttggctgtattttgattgcaaatctgtgtactgcaaaacaatctcattacttgctttttctgtaccataccatgattttcacttcatcacaccttagcaaaagctgttggggaatgagaagacatgaatggtctggtaaatgctgttgattatgaaatcctctgtacctatgatctcaagaataatggtggggttctggacggagaaggttagaatgatagcaggtaggaagtctcaacagtaatagaaaatggctgtttgggaaatgcaaggacccagaaccctcctagtactgcagctgtcggtgagtaaatgttcatttgataagctaccagatcacctctcaaagtgattttgtccaagggcagtccactcaacactcaattacgcagggactgagtatacaggacttcaattttctccttccttttgagaaccactatccaaaggataaaagaaaagtagcacagcactctgctctgtcatgattattgtttacctttggctaagaggtgtcatctctccagctttcctctaaaactttagggtctaatggtcaaatcccaggaccaaactccaggtgtttaactgttgcatttaaaatgtatttataacatattattattattattttgtcattggtttgcaagtacgctgcaatatgctatgtccattttccgtttgactaaatcaatttgaaaacaaaagtttaaaaatctaaactgtgggttttctagggggatttatgttttaaggagtgataatgaggtctagaacatgttatcttattttttgtttttttttaatttttatttctgtaggttttttgggaactggtgctatttggttacatgagtaagttctttagtggtgattggtgagattttggtgcacccatcacccaagcagtatacactcaacacaatttgtagtgttttatccctcactccctctcatcctttcccccaagtccccactgtccattgtatcattcttatgcctttgcatcctcatagcttagcgcgtgtgcatgcccacacacacacacacacacacacacacatatacacacacacactacaattcctttatccactagttgattgattggcattcgggctggtttcatatttttgcaattgtgaattgtgctgctataaacatgcatgcacaactatctttttcatataatgacttcttgtcctctgggtaaatacccagtagtgggattactggatcaaatggtagatctacttttagttctttaaggaatctctgtactgtttgccgtagtggttgtaatagtttacattcccaccagcagtgtagacatgttcctttttcaccatatccacacaaacatctagtatttttttgttttttttggctatggccattcttttaggagtagggtggtatcacattgtggctttgatttgcatttccctgatcattcatgatgttgagcatttttcatatcttttttggccatttgtatcttcttttgagaattgtctattcatgtccttagcccacttttcgatgggattgtttgtttttttcttgtagaacatgttcccttattgattggttttcacattcttatgatcaatgacgatatcattatcaccaagaatttgcttaatacttggtgcctacccagcctgatattaaacacagggtggggaaaaagttagttttaatgtaggtgcagactcaaattcctatggggaccggtgaggtaacctaaatgagcaaaatggtcagggtgtaagaaaaaagccaagaaaccgccatgataaatggaactgtatttgcctcagtgccctgaagacaattgggagtagtgttaaaccggaaacttctgaatcagacacgctccactctacttccagctgattgtagccatacaggaatttgggcccactattgtcaaatcttgatttttcaagagaaacatggaatatctctcttttaaaaaatatgaaatttttccattttggaaccaatccaattagaaagtaacaaacacacattttacagcatgtgtctgtacagtgtgtgttacttcctaattggattaattttgttactttctaatttgattggttttgctaacagtaattttctattactgttgagagttcttacttgccatcaatctaaacctctctgtccagaacccaccattattattgagatcataggtacagaggatttcataattaacagcatttatcagaccattcatgtcttccatatgggccaaacaaaatgcttctaagggctgtttttggcataatcctatgaacctcagctttccaatgtagtcaggggaaataagacacacaatttatgtaaaaaggatatgaaacaacagtaagtgctgcatgcattcctctttttattcattcaaacaatagcatttattaagggccttctagcttccttgccctgtgtgagttactagggttacaaaaatgaacaaaattattttgtattgtcaagcagcccggtctgggaaaagaaacatatcattagatttgttattaaacagatcataagagtctaataataattgggacaattagtatggtagaatttcaaagtatagagacttttgaaactgtctttgcataaattatatcattgagaaaaattatatccaacagtaagctgagctaacccactccctatcttgcctttcccttaattattcctgggcttttgggccaagctaactttggaagacatttgggctatagtttaaatgataataggccttgcccccaaactcaaacacttttataaagctaatgtaaggctacaggctggagagaggagggaagcctgaggcctgctaaggtatagacataaatgattgtcagccactattccagaggttataaaacatgcaacttccccagttactcctgtaataacttcactattgtagaacctaagattggccttttgagatatcttttcaggtttttttgcatgtctgacacctgtggttccatctggacctgccaatctgacccctgtggccccacccagaaggtgttcagcatgtagatggacagctttgacctcctgcgagttcatctccaccccaacaaatcagcagcaagcacccattacctggccaacaccaccccttccctcaaactgccttaaaaaaggcctaaccggggagctttggacaagaatggtttgagtactaactctctcccatgtggtgtggctgtcctcatgtctattaaactctttcaactaccatgccaaggtctttctttatgcagcaggcagttacacttcgctgacatttttcttaaggtcatgggaaataattagcttctctttaaattgtataaatatatcccctctatctggactacactttagtcaggttgacagaagcagaaacaagtcataaaagtaccttacagtcaacttctaaaggaagtactgtcatagaagtgtgagatttcctaggagctgttgttattaaccaatagttttaacacccttttaaagcatatcatcaattatactaagtacacagggctatttattttaaatgggtgtactaccagatagctatctatttatcaatatgcacacaaacacatacattcatttacatagtattttatttcttttgccactaaagacattcttactttagctacaagttaaataacagcaacggccacttttttttttctcacctgcaaactgtggtgcagatggaaagaaggcacttaagtgaataagctgtttttaattctagaactctttggttgtgataaaaatggaaactatgtgctctagaaaagctgagtaaattcaaactgtttactgttaaatgcaacttatttgtcaatttaggcagtaaaggtctgaacactcaaattctgtgaatgtccttataagcattcactttgatgtgtaaaactttgtagacttgaaggagggagtgtttgatttccatatacttccaaatattcccttcaggcagtttcctccaaagttggaatattgtggcgagtaaggaggaagttaaggattgctctctgaaagttattttgtctttctaggtggaacaacaatgtattcattagtgataacaatctagatatgaatgatgtaatgaagtatcggttgaactaatgagatgggaagctacaataacctattgactattttgctaaataatatcgccaccttcaaacataaaaacaattgttgaaaaagcttctgtcaaaaataaacccttcaatattttatgacaggtattattgacagaatagaagagactggaatttcctatcactgtggttggctttaaagaatacaacttttaacacatttttcatctctgtaataatacagtaatgattaaattccccttaaaaagcccaaggcatctatttgtttcatggaaacttccaagtgtcctctgtacagacttgttcaagtgggagttcataagtgcaagaacagtaaacttcagcttatctaacatggccaaggaatggtatgttctacttaatcaaatattcttgttgttggagagctgtttcacataccacgcattttaattttcaaagagtaacctttggttagcattaaagctgcactcacatagcctatagtttgctttgatgcagtaatagaagctcatctcctttatcccccacaaggtagttcttctatctttaggtgctttccaggatttggccagaatttacccatggacccctcctattgtagttctcaaattgcgaattctgagattcactgagagtcatccaagctctcagtggatctcagaatttttgctctgcctcaaaccagcctaccaaacgtttattctttatgtgtgactggttggctgcttgtggaaccagtttgagcttcagtcttttagttgataactgtgtaaacatactaactatccttgaataatagttgattgaaagagccgattttgcctcttatgatttaattaaaataaaggatttggaatcatataatgatataaacttttgtaatatataaggactctacctgacatatcgtctctagcctaaatgctttattataaacacaatagttgcattcttgagtgactgttgtattctgtgcactatactaggtgctttacagaagttatctccaggactcattaaaaagacacaaagaatgcattttatatatatatatgtgtgtgtgtgtgtgtgtgtgtgtgtgtgtgtgtgtgtgtacgttggaatattatgcaaccttaaaaagagggaaatcctggaggatattatgctaagtgaaataagccagacaaagaaaaatagatccatgacctcactttaatgtggaattttaaaaagctgaattcatagaaacagacaatagaaaggtggttatggggttggggcaggggaacggggagatgttggtcaaagggtacaaacttgtaattataaaatgagtaggttctggagacctaatttatagcatggtgactatagttaatacattatatacttaaaatttgctaagcgagtataacaagtattcccaccacaaaaaaaggtaactatctgaggtgatgcatatgttaattagcttgattgtggtaatcatttcacaatgtatatgtatatcaaaacttcgtgctgtataccttgcatatatatattttttatttatcagttatatctacaagctgaaaaaaatacacacaaataaacaaagcaaaacaaaactgtaagataaatttaatagaagctttggaaattactgccctatgagatcatcagcagaggagcgggtcttccattcttcctgtacaatgtctgctgttgggtcactgcacactgctctcgggctggctgcctactctttagaaagtctgggtacttcactcccaccaactgagaagtgtgcttattaagatccagtttgctctcaaacctgtttatgtcaactgacattgaataatttcaacataaggtgaacaaaaagagtgtttttttaaaaatgaacataaagtctaaggctttgcaaaattttgataaaagccaattgctttaaaaaaaatactgtcaaagtaggtttgggtgagacccctgtagaggactgggggaaaccataaaaacccaggagaggccgggcgcagtggctcacttctgtaatcccagcactttgggaggctgaggcaggcggatcacaaggtcaggagatcaagaccatcctggctaacatggtgaaacctcgtctctactaaaaatacaaaaaattagctgagcatggtggcgggtgcctgtagtcccagctactggggaggctgaggcaggagaatggcgtgaacctgggagttggaggttgcggtgagccgagattgcaccactgcactccagcctgggcgacagagtgagactccatctcaaaaacaaaaacaaacaaaaaaaaaacacaaaaaagcccaggagaattctcacactgccctgtcatacattatatactctcttgttcaattttagagataatggaaattgtaataatgcatcatgagtgaggttagtacaagaatgagaacttggaactctaactggtggactatgtcactcagggttcaggtgcaggaaacagaaaccactttaggtattttaagttaaagggatttaatataggcaattaggtcctcaggatataggatttttaaaaagggcaggaggatgagactcttttctggcctgccaggaatgactcccggaacaaatactctggaactgggccaccagggttgctgccacctctttgtgatcatgacagtggaaaatcagggggcgtctacctccaacaccacatgtgccttttaacactctcagggacattgcttcaggaaaccccaataactctggggccaggcttgcccatccaaaacagccaagagtttctgtcctccattcatcttccttgtgcaggccaggggaaccctgatttgcattcagaatcctaactccaaagaaatgtaggatctggagggttttgctgttcatcctctgtagtacaggaaagcacagtagaagaggtgtgggattgaagctgagtatcaaactccctatcaaattcccctagaaaagaactggctttctttctatgaaaataagttggtgaattaacgtgctattagttctttattaaaataaaacttttgatatgtagcctattttactgaccaattataagattatttaaaatcttatagaattattaaaatgggcaggcttagtggctcacatctgtaatcccagcactttaggaggccaaggcaggaggattgctggaacccaggagtttgggaccagcttaggcaacatagggagactctgtcttatagatgctgtctccaaataaggtcacattctgagctactgaaggttaggacttccacataccttgtatttatttttattattatttttgtaacatagagtgttgcagataaggcatttcagcaggtatgttttgagcacagactgtgtgcaacactttgtgtgggatgttcatcggggagaataaggaagaggaaagcaaagatgacctgatcatggtgcaggttcttgagaaacttaaagtctactgagaaagatggatgcacacgcagataactgtattactaagcagaaataatttaagtatgaaaggctctttggcgctgagaaggactgttccccccttacataagagggagaatcaacacaaaccacagacatgtagtttacgtagtaaaatgcatgtacttaaagtggatggtatggcatgactggagccactttatctgttcatttattgcttaaaataaactatgtttattatcaccttattaaagaagtacctattacttttaaaaaggtacttcttttaaaagacgtacctattactttgcatcatggttggatggatttttttccttttctctttccttttctgtgggtttagtggaggaggagttgggaagcttgagtaaaacccttattctgccagaaaatgtagcagttatatgtaattggctgtctttactcagagaaacaggagaacctgtgaggttcagcatggtggactttgattaaacaatgattatatatgaggcagttggatcctgctccaaatgctggttgcacaacttcagacaaaaggaggtactacaggaaaaagccagcaaatgtaccccattattgcatcctggtctatttatgatgggtgtccacccaggtctctggggacagcctaggtcacactgatcttgggtctccaaacactccaccaagagtagttttaaaatatgccccttaagttgattcctccccaaagaagcctaaaacatataggattcttggcaaactctgtcatcatgacattatataagatttataaagccctcctaaagattgctgtgggattatggaagcttcttgggtgccttctggcccctctaatcaacttttcacactgttgaggagataggggaagcaaactcatcatcactccaggtgtgtatcttctcacacttgatcttctgaactcagaggacagagatctgattataagaattattctttattacccaaaatttctataaagagcatgttttgtttatctgagcaaaactatatcatgagactaattatccctcttgggtttttgttgtaattaagctacacttttccccctgatttttagaaatttagcttttgaaatagaagataaactaaagaaaactccttcccagctaatttttttccataatttttttcagtctttgaaacacagaggtctctccccacctccctatttttttttttttttttttaccactgaatacattgtttcggcttagttatggattgttttctgaaaatttatctcctgccttccaactaaatttcaacatagaagcaagtgcttttattctctcttctttcccagatatataaagtgtctagttcttgtgttattggcaagattatgtttcctttgttttcttaacctcagcttcataaaaaaagctcacttcatgcttctgctccaagattggagagctcaaacatttataactccaaaaacaacatgttgccctacagaaatttaccacttgaatttgagcagtgttgaggggtatgccatgatgataggcagcaatggcaaaagcaaaggtaaaaagaagaaaaagagttttttgaaatgtgagctttgaattatttgtcggactaaataaatagcattaccctatcttccctaccttatgcagaacctcattttagaaaatcagcaccagccaaaagtgtaatgcaccatgccgccacttaggtagttacacattatttgaagatattccttaaaatgcctgctaagccacttttatctcttctgctatagcagaggcacagagcagtagaaagcacctaaatagcttcatgttattctttacttgaagaaggaattatagtcccaagatcactatagccgtggtaggcactcctaaaacaaatgtacagttcaggtcatttaattttatggttatagataaatgcagcgagatgagaacaaataacttaaacagtgattagccttaagtctacttgtgtcaacacaagatttgaggacagaatgaatcttctatttattttctgggcatttcttaaaactatgtttgttcctattaatccatgaaatatccattagttcacatacccaccgttttttatatttgtagctcagcaacacaaagacaacaaaaatataataataacaataaaccagcaagtaaattaacttactgttgtttgttttgttttgttttgaaatgagcgtcagtgaatctagtgctatatctgccaatgtcttgcttgtatcaggagctcttagaaaaagttcacacctaagagcactatgagttggaaatgcctattttagatgtgtttctcccatgtttttcctccaaaatcactcagtgaacctggttttacttgacttattttggagtgacatcctcaaagcatgctgaggactgcaactaccaaatataaagctggaaaggagtgatgctgcctgatgctagtgacaagttgttccttgtgtggcagacagattcaaatggattaatgttcaagccaagccctttcacctctactttctcatgaggagtgacagagaagaatgtgtggcttgtccatagacctcctgactcttctgccacctttgagttgacaccactttctgatctgagacagtttgtcacttagggtcagtagttttgccattcagtgaagttgtacaatggatttcctctgtggtgggaggaagagcaggaaagagagaaggaaagagagaggaatcggggtggggtaagaaatacagagagagagagagtgagagaaggaggatctcttttactaaatgttatctttgcctttttaattggtatttttagataataataactttcctatattaatagctaaaccctgtccttattatccattcagtgtgtatgatatgctcatacctgtgaggctccgtgatgggaaatgacatagtactctttgttcccccaagttctttttgccacttttcctggccatggtctcatcaaagcatttggaaaatgtgcagctgtggtcttccaggaggggacagatattgtactcatcgagtcggtacctggtgtctccactctctcatgacttagcccttcccctctctctccatccagccatgtggtttgtgttgaattaactgtccttgctgcaggatgaggccctaatgtgtttaagctaatcactatttcctatcccttgggtcatggtgtttagctcagggttggtcatgtgtttttagcaagggagcctcagggctttttgtggcctttccaactctggcctctacctcttgttatgaatgaagatgcattgagcgccgtgtgctcttggcactcatgttatgaccagaggacaacagcatcaggcagatacagcagaagtcagagaggggagatgcaaacaaatagggtgttttggttgttccctgtagcccatgctactgctggatgtttcagttatatgtgatagtaaattccttttattaaaggctgtttgatgggtttttcttatttgtcacccaaatgaaccccaaagggtcacaaaaacctgactgaatttcaaaatactttgtcattaattcttaattggtggtgggaactaaacaaagaaaacaccaattatggcaaaccatcgtgaacagtgaaagtttgacactaacaataatacataagacctaaaagtaagaccactgaagttttgcatcaaatcagccagatttctccctttctctgaactgaagaaaaatagtctacatcatggctgtttgttttaacttaaaaagtgtgaggaagtgagcatccagccccaagctacagtaaacagctcgttcaagcaaattacctagaacaaaagaaacacctctgacataatgtgggggtccaagcctgaaaataatagggtgctcagcaaagtcccagaacccctgtaacaagagcccggtagttcttatagcattcggagccaatgggaaggagtacacttttaaaatgtggtacagttggtgctgaagtctctttacccttgatttttcttttccctcctgaataggaaagcagagctagctctgtcatattgagccagttggtaatgggctctgccaggcgtggaagagataaaagccaccacctgcctcacccacgctccccctaccccatttcccggtctccggttgtctgcacagctgctgacagccagtcattgttccaccccagggctgcctgggagctcagccgtcccagtctcagaagcacaattgcagtttgaatgcagctcctgggtgggtttcctgtgcaccttggccatgaccccttggaaggctgtatgcctgcaagttgagcagagtctgatcatacacggcttaagtacttgccatgtgccagggcctatgaagaggagaacacaaaccagcgttacagggagggaaaagggtttgagcaaaagcaagagaagaaaaagtatgtataacaacattttgggggcatctattagttttctggctgtccagggtctactcatcttacttgctgagtagaacccctctttctcctcgagtatttctcccaggcctggccagtgagagcattgcattccctcctggcaactgtgattgggtcagagatgggcaaacgacttagctcaacgaagcccctgagcctcattgcacagacctagctttgagaatgagggagattctcttctttctttctacttgagaggagaatttataaagaggaatagtcaaaagtaagcctgaaagagcattttgtggcaaatatattcttgcttcttgggcatggtagacactgtgataagcaactcagaaccaccccctactttaggaataaaggacttgttccccagcagctgggagtgaggctggtagacagtcctcagctgtcaagcccctttgaggattgcctcaactgaagagagctaccgtgcgcaaggccatgccacctttttggcataatccatatccagtgactgatcaaagtaggggtatagaggcttgacttttttgctgcagttcaggacaactctggaaggtcaacccatcttcagcgttccttctagggccaactgaaacttcccttgaggttgcattgcagctccctctgcccactcctgcttctgtcccttcccttctatggcagtgtatcccaagagccctccctaataaagctcctgcaggttaacctaccttccagggagcccaacctacaacaccaagataaattgcttgtattttttcctggcggtggagcttagtgactgaaatgaagcatgatcactctgagcagaaggatggcagtaaactgaagcatgacttaagaagatgatgcaaatcatcacatttctcctgcctgtagctcaggatccaaacaccagtgaaagccatggccatggccatgcacttctccttttaggccatatggcattcagtgtgcagttcactattcaacaaattgaccacttgttttggttttatgcaggcacaatctgaaaatcatagttctgctgttaacatcaaataccttttaatgatgtttgacatgaaaaccaccatatactcttatactttccccctggttgtctggtgtgaagcatcttttaaagaaaatttatggtagttacctttataatggtataactcttaccaagtttaaaattaaaatgttatcacaagtggcatttcccatcccatttcaaatgtagagtacggcgagaagtctcaggaaattaaaatattgcctttaaagccctccttttatggtgatgtgaaggaaattgcagcacactagcatttacccaactatcaatatttttttatagtctaaaatatttgccaacattttccccacgtgaaatctattatatgaaatgattaaaaacaaacatcacgtgcactatacgttggagatgcttttaataacttggagtcagagtaaatgatcaccagggatcagagttaatacgggttgaaaggatgcccttaaaatcatgacagtggccttgtattaagcttgtggtttacatgcttttttctgtactgaatcgctaaaataaacaggcattcttccagttaattgtgtgtgagtgtatgtgtgcattgcatagtcacacattccatattgcttctgaaacataattttatgtaaatgattgtaaaaaacagaaatctaagctacctcagtactgttatataatccgtaacagatttgccaacccaaaagcctaattctatcgttaagacctaaattcatatattttataaaatatatgatattgatgttgtccataagctttttttgatgcgatccccccttatacaaacccagtttttattgtactcttttgtaataattttgtataatgtggtctcttcaaaagcgagaccagcacctattcgtttttaagtcctactacataggaccatacggcatgttgcattgctatttgaatctttttagaatggatcaggatgtcccaaaaaatcttagaagctgtactaatctcagcagtataaatactatatacttataacactattatataaatgtttaataattcaaacttcttttacagtaatttagtttttgaacttttaatattaattttttcattctagtttttttgttttatttaacatttggcttcttcagaggaactgcaaccaaactttaaattacagatttattattcaagagtcacaaaattctatgaatataaaagaaacttatctaattgaactttcaaatcatagtttcataagtttatacataacctttatacatctaaagttattaatgcttaaaactgtactgtgacttttgagcaccccagaagtctggttgttaattttttttctacatttttaatctcctaactatgtgtgtttttttttttttggtagtacccccagcacacaattttcccagtaagtacaagcatgtaaaatacaatttccttgccagttaatgttccatacactctaattgtgaaagccactgtatttagtgacaaatttaatcttcagtacttggaagaaggcaacatgggttaagattaaaaaagaggacataattgttgagttctaggtatcttcacatttttaaaacaaatgttctggaactgatgttcacgaaacaggtcagcccctcactgaaccagttctgctgtgttgataaatttcttgttagaactatggcaggaagcaaagcaaaatgattatagaaaaacatgtgctttagcagcaagatggttatttgagcatatagttttcctcttgggtgtccttgaataggcctatgttgagttgaagggagccaagatgataaaccagacataaagagctctaagcataggtttagaaaacggaagcttcttggaaccattttctatttgacagaaacaaaccctgactcagccttctcatttttccacataagtacactgaattctcttccccatccaaggtgtggatctttctggaaaaacctctagctgaagtgtttttacgtctgcaagaattaaaggtcacagactcttgtttctagacaacaaggacagttcactttctgggtgttaatgaaaatccttctatcttgaatacttcctgagaatacttagagtattataacagtcatgaaaagaaatgatgaaaatacaatcacatgttatgggtggaggacagcagggtgcagtgtatcacttctcggtctagatgacacttcaaagtcccttctttctttctaaaactgtcccaggcttcagactgctgactctcctttcctgttctgagctgctacagtcgatcctgatatggtttggatgtttgtcccctccaaatctcatgttggaatgtgatcgcaatgttagaggtagagcctagtcggaggagtttgggacactggggcagatccctcaagatggcttggtaccctccccacagtaatgagtgggtttttgctctattccttcacacaagagttggttgtttaaaagagcctggcacgtcccccctctctctctcttgcttcctctcttgccatgtgtattagtttgttttcatgctgctgataaagacatacccaaaactgggaacgaagaaaggttgaattggacttacagttgcacatgactggggaggcctcagaataatggtgggaggcaaaacgcttgtcttacatggtagcggcaagggaaaatgaggaagaagcaaaagtggaaatccctgataaacccatcaggtcttgtgagacatattcactaccacgagaatagcacaaaaaagaccagcccccatgattcaattatctcctcctgggtccctcccacaacaagtgggaattctgggagatacaattcaagttgagattctggtggggtcacagccaaaccatatcatgctgcccttggcccctccaaatctcatgtcctcacatttcaaaaccaatcatgccttcccagcagtcctccaaagtcttagctcatttcagcattaacccaaaagtccacagtccaaagtctcatctgagacaagtcaagtcccttctgcctatgagcctgtaaaatcagaagcaaggtagttacttcctagattcaatgggggtacaggtattgggtaaatacagtcattccaaacgggagaaattggccaaaacaaaggggttacagggctcatgcaagtctgaaatccagcggggcagtcaaatcttaaagctccaaaatgatctcttttaactccatatctcacatccaggtaatgctgatgcaagaggtgggttcccaaagccttgggcagctccacccctgtggctttgcagggtacagccttcttcctggctgctttcacgggctggcattgagtgtctgtggcttttccaggttcacagtgcaagctgtcagtggatctgccattctggggtctggaggacggtggtcctcttctcacagctccactaggcggtaccccagtagggactgtgtgttggggctccaaccccacatttgccttctgcactgccctagcagaggttctccatgagggcaccacccctgcagcaaacttcttcctgggcatccaggcatttccgtacatcttctgaaatctagaaggaggttcccaaacctcaattctagacttctgtgcacctgcaggctcaacaccacatggaaactgccaaagcttggggcttccaccctctgaagccacagcccaagctttatgttggcccctttcagccatagctggagtagctgggacacagggcaccaagtccctagggtgcacacagcatggggaccctggacccagtgcatgaaatcactttttcctccttggcctctgggcctgtgatgggaggggctgctgggaagttctctgacatggcctggagacattttcctcgtggtcttgggaaataatattaggctccttactacttatgcaaatttctgcagccgccttgaatttctccccagaaaatggcttttccttttctatcgaatagtcaggctgcgacttttcccaaacttttatgctctgcttcccttataaaactgaatgcatttaatagcactcaagttacctcttgaatgctttgctgcttagaaatttctcccgccagataccttaaattatctctcaagttcaaagttccacaaacctttagggtaggggcaaaatgccgccagactctttgccaaaacataacaagagtcacctttgctctaggtcccaataagttcctcatctccacctgagatcaccttagcctgaattttattatccatattgctctcagcattttgggcaaagctattcaacaagtctctaggaagttccaaattttcccacattttcccatcttcttctgagcctccaaactgttccaacctctgcctgttatccagttccaaagatctttgagtatcttttcagcagcaccccactgtacgggtaccaatttactggattagtcaggattctcttagagggacagaattaataggatatatatatagagagacagagagagagagagagctctaagcacaggtttagaatgtgtatatcctaaagggctaggcccgtctctccttttcacgtttttctgcctgctttatattcgctggaagctgattagatggtgcacaccagattaagggtggatctgccttccccagcccactgactcaaatgttcatctcttttggcaacacccacacagacacacccaggataaatactttgtatccctcaatccaatcaagttgacactcagtattaaccatcacaccatgtgacatgcctgttcctcctttgctttctaccatgagtaaaagcttccagaggcatccctcgaagctgagcagatgctggtgtcatgcttgtacagcctgcagaatcattggccaaatttaaccttttttcttttaccaattacccagtctcaagtattctttacagcaacacaaaacagactaatacagacgccttgctaggtttgctctcctataagccatgaggtgtaatgggacttttattccagttttcccttcttcctctgaacacacacacacgcgcgcgcgcgcgcggagagagttttcttggaaagaagaaaggaagaaaacatttaattctcattaggacctaaagctttacaactacacaaagttatgagcttctattgtgtaagaacgttatatcatgtagtcattgaaataacccttttataagtcaaaaacgaagcaaaacaaaatttaaaaccccaaaatgcaaagaggatgagcagttgtttgtagtccagaagctggtgggtggcaggtttgtctaactacaaagcctttttccactacacccctgctgacccacatgagaagcagagagatggtgacaaaaaaatagagatttctgtatttaccaaagcctggaaaagttggtaccacttatggcctccttttctagactcttgactaacagacagctttccttttttaatgtccaagggtggagttctttaaaccttttcgttacttcatagtccagatcatactaactgtgtcttctagaacgtaatgatacagttagatgagggcatattactaataaaagaaaaaaatgaaggggagaagaagaaaaacagttagagaccatttgattattcttgaataggattgacaaacactttctgtaaagggccaagaataagtattttagtttttgtgtaccaagaggtaaaattgaggatattgtgtaggtactgatatagaaagagagaaagcaaatttttacgaacattttattgatgaaattaaacataataataattgaatacttaaaatattaactagtaaataagaagaaaatttattctagtaatgaaaaggatgaaatcatttttgggtgggtaacattttgcttaattgttgttcaaaattagttttccctgtcatcaagttgatcataaatacgtattgataaaaaagcattcttagcatctgggttatactgaaagagatgggaggctggatttgacctgcaggctatagtttgcctacttctgctgcaaaatctcctgtggatattcacatctcatggaatcaaggagaagccactactgtgttctcttgatttcccaagtcctcacctgaaaggtcatcttaaggaaggacttatcaaaattttttcctgggatacttctatctatactttaagaattatagataaatggcttgagacaataggagagaggagttagaagttgtctcagtgaaatttctataagatctatctgaaaaaatttatatgagttttgaaaattactctatgttgtgatcatatttgtttcctgaagcctgtgtcttaaaaccaaagtcaaaagaagattcaccatattgctaagtgaaggaagccaattttaaaaggctacatattgtctgataccaactgcagtcatgagccacttaataatagagatatgtcctgagaaatgcattgttaggcaatgtcgtcatcatgtgaacatcgtagagtgatttatgcaaacctacatggtatagcctactacacacctaggctatactggtatagtctattgctcctaggctacaaacttgtacatgttactgtactgagtagtgtaggcacatacaacacaatgttaacgatttgtgtatctaaacatgtgtaaacctagaaaacatccagcaaaaatacagtattataatcttataagacaccattgtcatatatgtagtctgatgttgacggaagtggtgtaatgtggcgcatgactctatctgacactctggaaaagggaaaactataggagactatatacacatatatatgtatacatatgtatacatatatatgtaatgtgtgtatacatatacacatgtgtgtatatgtatatgcatacacatgtgtatatgtatacacatgtgcatatacgtatatgcatacacatgtgcatatgtatacacatgtgtgtatgtgtatacacgtgtatgtgtatacacgtgtatgtgtatacacgtgtgtatacacatacgtgtgtgtatacacacacctgtgtgtatgtatacacatacaggtgtgcgtatacacacacctgtgtgtatgtatacacatacaggtgtgcgtatacacacacctgtgtgtatgtatacacacacctgtgtgtgtgtatacgcacacctgtgtgtgtgtatatgcacatatacatatacatatacatacacgtgtgtgtatgtatacacacagatgtatacacatgtgtgtatgcatacgcagtcttctgtatatatacatatatgtgtatatgtatatgcatatagtcttctatatatacacagatacgtatatatgtatatacatatataggagactatatatatgcacacatatatgtatacatatatgcctatatgtgtgtatatatatacatatgtatatatatgtgtatttttctcatggaatgcttcacaagtttccatgtcatccatgcacaggggccatgctaatattctctgtatcattccaattttagtatatgtgttgccaaagcaagcacaagagacaataaaaataccagaagttgccaggcattgggcagggaaagagatggctgggtggaactaatagtagtgaactattctgtatgatactgtaatggtggatacatgtcattatgcttttgacaaaactcatagagctatgtaacatgaagagtgaaccctaacataaactatggactttagttaataataatatatcaatactggttcagtaacaaatgtaccacaccaatgcaagatgctaataatacaggaaactgagaaagaggggagaggagtgtatgggaactctctgtactttcagctcaattcttctgtaagccaaaaactgctcaaaaaaatctatcaattaaaaaaatacatacatttatgtgcctatacatctactactgtgcatgcaaacaagcaaagttagcaggaataactgttgcattatgtaatcctttctaatattttttggtgtctattttatttattagtaaagaattaccttgaatatggtgagtgttagcaattatgaagctattattatttgttgctgtatacaacattggttgtatccctatgttacacaaacatgacagatattttagctgattaacctataattgcagggttcctaccaatgtaggcaactgcactttaaataccaattcacggtctgaagtatttaggatctaatggcagaaaagctccattttctggctttcttttcattgttcccagtaatattatttgatgtttttattggtggtagactttgattttgtatcattaaagttggatagaacatattttatggaattttacttgaaagggactattagaagcagaatagtctgtacaatttatgaacatgacttagaacacttgtattcatgtgacagtctcattcccatttaatctttaaatcagacattcacaacagaattttagagcattcttgcacacactggtgatatattctaaagaagacaagatgacctggttgtccacaatgacgagtaagcagcaattaactcttctcattacatagctttatgagttttgccaaatgcataatgacatgtatccaccattacagtatcatacagaatagtccactgctacaaaaatgccatgtgctccacctagccatctcttcctctgcccaacgcctgtcaacttctgatatttatatggtctccagtgcttgctttggcaacacatatactaaaattggaacgatacagagaatattagcatgtcccctgtgcagggatgacatggaaatttgtgaagcattccataaaaaattatatatatatatgcatatatgtatatattctctgtagttttttcttttccagagtgtcatatagagtcatgcaccacaattctatacccatgttgcagttacttttacaagaccttggaggatgtgtactgaccacatgcccagatcaggcttcagttccctcaggtacattccagtctcatgatgccatcatttgctagaaagtggcacagagtattaagaaggcagctctagaagaaaaagccttgggccagaatcccaagaaacacttagagcctctataactggaaatataagaccattcaaatacttttgagttttaaatgggcatttatatcttcagaaaactctgagaggcttacttgggccaccattcatagattccccctatggagaagggttaggagctacatatactccagccctcactcttggctcttaaatatgtcttcccagagagggcatgctttcctaatcacatagaagcagcacgggctaggctggcatcaccccctgttgatgacccaaggtattagtctgttctcacactgctaataaagacatactcaagactgggcaatttataatggactcacagttccacatggctgaggaggcctcacgatcatggcagagggcaaaagagaagcaaaggcatgtcttacatggcggcaggcaagagggtgtgtgcaggagaattcccctttagaaaaccatcagatctcgtgaaacttattcactatcaagaaaacagcatgggaaagacctgtccccatgattcaattacttcccatagattcgctcctatgacgtgggaattctgggggctgcaattcaagatgagatttgggtgggaacacagccaaaccgtatcacccaaggaacacatcagtgatcacttctcacacattttcactggagcacacaggctgaactccatgaactgtggtgtcttcattggtcaaatggggataaaggtactaccaccttggaagcctcctgtgaggattaactgatttaacatgtgagtgttcaataaatataagcaggtcctatcctactcatagcctagaattttcacaatgattaaagaagcgtgtaaactggacctcataagtcctcaatagtggatacctttattgctgataaaatttaattagatttatctctcccaccctacatcattctggtccaaagagcaggaactctgtagaactaagtttagtaccaaaagagatttattgaaggtatgccatattctaggcattaaaaaatactactattcattacttaatccttaaaatttctctttgaggttactattttatagtctccatccagatgagcgaattaagcagctttaaaatcatgaattttaacaggaaggacaagaaggaagagggagaagaagaaaaagaggaggaagaagaggaaggggaagaagaatgaaattaatatgtattcttagagtaacctgttaatctaaattaatttggtttatttgagtatatacctaattttcgagtgatttgtagggtttcaaatgtgttagcaaattagtagatatttaatataaatatcataataaaaaacatttgttaaaacatatgggaatttttaagtgatactctatattgcattttatattaatattatatttttaaaataaatttgtaatgttcaaaaacatgtttttctctaaacaaacgaaatacaaagttaacttctttataattctatacctatcctgtggttactatagattaccactgacacaaaacattttttccatactactatttaatacaagaattggaacagactattgatctagttttaacagatttagtgttgtaggtattttgttgaaaaatgatttccatcgatcaagagattgcttttccctcaagggaaatgagcccctgtctaaggtaccaacctcctcataaatagaatttgtagggagttcttatttccccccacgaggatgggatacaggtttaaatcacgattctttatcaaaagaagatttctcaccattagttaaacacaaaacactcagaatatgatatcctgagttttcaagtgtggtgactttccaatgttgttttttttgtttgtttacacacttaggaattttaagaaaaatataactacatgaagactattttttcacagtgggggtattattttcacaataaaaattatccatattattccatcttagaaaatttgagaattatattttataatttttattgtatatcagtttaaagattcttgttaatgggggagagagagggggttgtgtgtgtatgttcaatgaatcagtacaagcttccgatattatcagtctaagtcttgggtggtgtctacctccttgcttcagaagaggcagctctgatggtctcctcaagttccttggccagacccggaagcctgggcagtgtcaccttcctaaataggtctgttctcaagaattaactgctgcttagtgtgacaaataggaaaatgaaacaaagggggtgggggagggcacagatgaaaattctctacccctctacctactcctttcaccatcctcaggggctcctgatacaccagccaatagatctacactatcatttctgatagttttaataacccaaatgggctgaattatctattccaaagatctgtacagtagggtttctcagtttctgcactgtggacattttgggctggatgattctttggtctggagtagggaggggctggggtgctgtcctgtgcattgtgggatgtttagcggtatccctggcctctacccatcagatgccattggcacctcccaaccaaaactgtgcccagatcttgtcaaatgtcctcctggggtagaggaaaaaattaatccccctcaacccattgagagccactccatatatggtaatgcattagtgagaggcagaaaaagggaaagcctggatcatgaaggtaaatcctgtggtgcaactgtctagtgggatgcatttgcatgctctgtttctatgttcctctgttataaggaattaagccttacaagaagagtatgcaactcaaatattagtacctagctgacaaagaatttataactctgaagttacactgtggtagactagtatttcccagtcttcaggggggaacattaattagttctctgaaaacaaaagcttccctggtctctttcctctgaatgtacacgaacatattaaaggtccttgagtatccagtggtaaataaaaggcatttaccattgtttaaggttaaacaaagttctttaaggaaacaagattcttttctaatacccattcaaacccttttgtttccaacaatttgtaaagttgatgaataccatataaaccattccctcaaaatggaaggatttctaggtattctcttatcatagatttccacactaatttaaaatatttacactatcatcttgttactagagtcagatttaattgggactcagggttttacttgagaataatgttttgtgtttgtaaatgatataataatatatataaatatattttttatttatttatttttactatcggttcccattcaatagccatgagtagacttatgggcttagttaactcatatgactcttaatcaatggatcaattgcctgcatcaaaatgtgcttctgagtatttacttatttatgtatgtattttattattattatcatttctaaatacacccagggaactctgcggactgctgaaggagctttggagatatcaataaaagaaaatgatctagcacaattgcatgggcctgaccaataagaacatgccaatacgcattcagagccaagctcatcagcttgctagggcactcagtctggaggcagtctggcctacacagaggctgatgtcttagtggaaatcaggctcagagtcaagtgcaatgcaaagagccagggagaatgttctcctgcaagttcatctttacatgataataacaagacttaattaaaaatcactggtattttctctatttgtttcctaggcagaaagctcaaataccagactgtctggttcaaaattgaacacctggcaaccctaatgatttggtttacacagtgatttatgttgtgtcacagattcagaaatgtggtgtcagtgggggtaggagtgggggaacacagacacattcaggagaaaaagacctttactttcatctttatatgtttaattgggttaaaaaatgtttctcaggaaaaggaaatgttttcatctattattccattttattataggcatgtccatctctttgtcctatcatgtttccgctttttgctttcagtgctaatttccatagctttaacagactctgatgtctatcagatttgattttggtgttcctgacatagggctctgtcctaagtctgtgaaacagctaccatgtttcaatcactgtggcgatatgagtgtgtggtctggagccaaatggctgtttgaattacagctctactatttctcagctgtgtagatgagacacttaatctattttagccttaatttactcagtcataaaatgtggtggtagtgatggtggtggtggtggggggaaataatatctatttgtgaaaaaagtttagccttggcacagtggctcatgcctgtaatcccagcacttttggaggccaagccgggaggattgctggagcccaggagttcaataccagcctgggcaagagtaggactctctaattaaaaaaaaaaaaaaaaatgaaaaaaaatttcttatgagagtgaatgttctcacccctaatatgtgtgggtttcaggataagagtataaatggagcctgaatactctatctaaatatctcaaaattatgaattcccccaacaagttgctgaataaactgtgtgttgtctgcctgccttgacaaacataccttcaacatttaaaggtctgggtttaaatgtagaattctgaggctcctcagtgtcccatgctggaatgtggtggccttgggaaaatggaccttagctttaggcctggccctcctctcttcccaagctcttcttcacactgcaagggcctcccagatgatgcatgaagatcctggcccatatattcagctacatccacatccctagcaaaagggaggctaaggccattcctcaggcctagggcactgcccctggagggaagaccagtggaagatgcctggaaaggccctggaagtagcttcaaggccatttcgatagagaattctgggggcctgaaaacctagagccaaggggtggacctgggctcaggataggcaagtccccttgatccaaggtatcactgtaggaggaagggcagtcagaggagggccagagctgagccttctaatgcacagggcccagagtggagtgaggaacaatgctgggattagacacccaaatctactgaattagcgaagtccaagcaaagtactgcaaacaaggtctggcatatcacaagcaactaataagtgttacttttattattaagcacctactggatgtcaccttttagcactgaggatgtaacaatgaatagaaagtgatcactgctctgggatctgtccctctaatattaggcttctgcaccaacagtttgggctacctgctgtgacagggatatggaagtttgttaggtggagaataaatggaaacccctacctccctggaaggtcaagggaaggtcttacagaggaagccatggctgagctgagatgtgaagggtgaatatgagtttagccatcagatgactggtaaaggtggacagtccagtcaaagacaacaacttactggatacatggaggtcagaaagagcatggcatttagaataactagaaaaaaaaatgtttgttttgtgcagaggcagggtacttaggaggatggcaagtaatgaggttggagaaatgggcaaggaagaacaagatcgtgaatggtgagagtcatttccttagggagctacggatgtcacagtgaccttccacataattcagcatatctgctgcagaggtagccaagaaaccaagattaggacttcagctggacaatgttggcctgctggctcacagggcatggggagcaagttcacataaggcagtagggaagaggaggaaaactgcacacatccagggagattttagtgccagaattccggaaggctttcttccagaaggccctcaacctaactgccacgcctcctctcccacttttttatttagctacctcttatagactcatccttcagaacttagatgaagcattacacttcctccaggaatcccttcctaaattctcattctaattcagaagacattcttttgtatttctgcagtgtctcaaaaagtagattgcacgagacttattaattcattggtcagttttcctagaagagtggtttttaaactttatcatgaattctccaatgacttggagggcttgttgaaacacagatttctgaggcctatccacagactttctgattcagaaggacttagaattttcatatctaacaacttttccgatgaggctgatactgctagtttagggaccacactttgaggaccactgaggaaagagtttcacaagtcagagatttacagtggaggtaccaagcttttctcaagttagtttatcagaagcacaaaccatcaccctctaccaatcattataatgaagaccacttcatttcagtttatgtacaaaaactcatctccacagttatgccaagtgtatgaagacaaagaaacaatatcaggaaaagaggtttatttgattttgaatccttagccccttacacagtgcctgaaacatataagaggcagtgaataaatgcttattgagtgattacataaagagatgaatgggaggctgaggtgagcagattacgaggtcaggatatccagaccatcctggccaacatagtgaaatcccaactctactaaaaatacaaaaattagctgggtgtgatggtgcctgcctgtaaacccagctacccaggaggctgaggcacgagagttgcttgaacccaggaggcggaggttgcagtgagcaccactgcactccagcctggtgacagagcaagactccgtctccaaaaaaaaaaaaaaaaaaacctgttcatatatcttggacatttcaatttcagtgtactccagcagatttctgactgaccacatctgcatctccatgactgagggttttctagaactgtggaaggtccctttgcacaaggcaggctgaatgtgctagggaattaatgttctctaaagcagtcctcagcctgggaaatatggtgagactctgtctctacacaaaaatttttaaaaattagctgggcatagtggtgcatgcctatagtcccaggtattcggaagatcacttgagctcaggagtttgagttggaggctttggtgagctacttttgggagttggagaataactactcctgcttaattgcccttcggtaaaattttgaggcatgttctacacaatgtcccagaaatgcacagcagcattgagctctagttgccccagcagtcacctgcccagctgcatactattttattggcatctttctctcactacttgtgctcaacatctttgctcagggcatgtttccaaaggcatccaaactgaaaaggaggacaaggagctaaggataaaatatagatagatagacagatagatagatagatagatagtctagggagtatggcagagattccagataatgcaaattcagatgcacctgtcaaagtgacaaaaagaagattacaggcaaaagtagcagcagcaaaactggagctggctgtgagtcccccatcctgagtcctgcagttcatgatcttcatcccagatcccagtgtcacaggatctctagggtgttgcttttccagccggaaacctctgaggctggtagcgcctttgcccgaattttgcttgggcctgctgggcttattctgcctactcggcccatcagggtgcacttggctcgcgctaccagcccagatcccacacctgccaagggtgagctaggcacggagcagtgaagggtatgtgagggagctcagggtctggccactgtgcacagccaggctgtggtggggcgggcagcaccaggtgcctgcacaggcgccagctctatgcaaggctccagctgaaccaggcatactgcaaatggcttccgctgtggacgtcagggaacgtggtggcaccccgaagcttggagacgtcaggaacctcagagacccaaagagggtgttacagccctaactcgaggaggccctaggtctgagctccccaaagggctgcagctcttctctccttcccgtcgctggcaatgtggcaagcgaggggttgtgtttcagccctgtttgtgttacaactctttcagtcctgccatctggtgggtctgagttcttgtctggcatccaggaagaatgaggtatgtggacaactggaaggtgagcaaaatggagaggctcttccttgagtgacagaacagctctcaggaaacccatagtgggtagcacctttcctcaggcaggtcgtcctgataagcggctagcgttcagcagagaggggacccatactgggtagctcctttccacaggcaggccatcccgactaagtggaggagacctgaaatggatagttgattcccgcagctgttagtaccgtctgtgttaatctggcagagttagcggtgtttttatgggctcagaagggaggaagtgcatgctgattggtccatgggtagccataggcgggcctggagggagcaccataaattctctctgggccatggactccacccagaaatggcagcctggctcccaggcttcaggctgtccctggcttgaaggtggggtttcaccagggactcgcgcctttctccccaggaccctttctgcctcccgccatcagcatgccatccagggcacccaggctgttcgtgcccaggcccgcaccgagctgaccgcccccgctggcctccctcccacactcgtgagtacccaaagtccggaggggttgaggcgtcagggggctgtcatgtcagcgctgcctcaagggtgcacacacgcggccaggtggcaggagtgcctgggcttagccacaactttgctctgaaatcagagtgggcactgggagtgaggagaggccggagggcgggagcaggcacttctagcctgcagcgacaggtgggcttcccaggcccccaggagtacagggattcctgggtccggagctgtggctgggcgactgcagctccacctgggaactcagggctcccgccccgccaacttggtagggagtgggcctctggcctgctcctggcccccgtcggctccgcacgctgccctggcgcgcctacccctctgcacctggcgtcgtctttgcagcggacgctccagatgggccactgctgccattaccaggtggctgcagctggaggtaattctgcaggccgattgcccaacagagtaggatgggggattcacggagctgagagccaagacatcactttgagactcaaatccacacttcaccctgaactatccaggacactcagagctgccgacatttgctcaataattggtcaatttttgaccgtcactctaaccggaaatgcacatttaaaaactgtaccttcagcagctgctgtggaaagcagtttgacagatcctcaaaaagttaaacaaagaattgctacatgatctaccaatttcactttttggcatatacctaaaagaatttaaaacagggacccaaatagatacttgtacaccaatgttcatagcagcattattcactatagccaaaaggtggaaacaccccaaatggccatcaacagatgaatggataagcgaaatgtagtatatccataagacagaacatcattcagtttaaaaaggaatggaattctgttatatgccatggatgaaccttgaaaacattatgctaagtgcaataacccagacacaaaagggcaaatgttgtatgattccacttatacgaggtaaccagaataggcaaattcatagagacaaaaagtagattacgggtttccaggagctgggacaggggaggatggggcgttattgtttaataggtacagagtttcagtacgggggatgaaaatgttctggaaatggatagtggtgatggttgcacaaaaccgtggatgtaattaacaccactgaatggtatgcttaaaaatggctacagtgataaattacattatgtatattttaccacaattaaaaatgcatgtcttcatactaaaacaggtatcttaaaatgtttacctctgctgccaacgatggggaatgaaaaatcagtctcttgctatcctttcccgtggtgagctttcagctgccacactttctcattctcttccctcaagctgggccagatcacatgggcaggcagaggaaggaagacttgataaaaggtgtaattttgtcctgctgctgcttgtcgcagtatatgctttgtccattttatctgcttatgacccagttatttgctttttctctttatacacttgaggtaaccttggaaatgggctctaaaatctgaactgaaatgaaatggtcttcatgtacccccagtggtgtgatggtttgtgcttctaataaaataatttaagctaagctaagcgtgcatccactataactctctaacttgtgaaatctgtagcttcagaatcatcattcatcatttttgtcttccaagacactaatggaaattaaaataaacaaacctgtccatgttagaaagagaaaagatcctctacagtgacaagtttcacacaaattgcaatatgcataaaatatccaccaggttttaaaacaggtcatccattaagggttcaacagacacaagggagtattgcagttaaaaggtgggtagggtgttgtttaaccaacgttttattaatgaatgagagttcagacggcaaatgatagtctaacaacatcagtgtatatttgtgaagattaaataagactcatgtttcccccgtttggaggtttgcaaacgaaatctggcacaaaatatacaggaagataaactcgagaggaacgtagcctgtcacagtgattgatggggctgcttttcacccaacagtgtttgaaaatgtagatatccttaaataaatgacgccaagtgagccatgccagcctagggaattaagaagacattattgcattttgcagaaacaacataaagcactgctaccaaatttgatggttggaattctatatactttccatgacacctcacgatgtatatgctgcacaagagtgtatggtatcatttttagtaatgaggttaccaaggtgttccaaggtgaggcaaataactttctctgctgtgttcctggaggtgaattttaagactgcaaaatcagcagtatcattttctggaacactttaggaattcacctccacaactttcctttcccccagccccctcagtttagggtactttgaagagggactcaacatatagttgccaaaattgggggtgaggtgaggggatttataatagaaagtacaaagtttagaagtgatttattagcaagagagaaaagtattctcaaatggatgtaaattgtgaagcatttttttggtcaaaatcagcaagttatagcattcaatttgtttgcccatgatatattttgagttaaaaaaataaatactcataggcacataattaatgaaaagagcatagtattctgcatggtattttatcacctgtttctttcacttaacaggaattagtaatatactttgatgctaacaaaacatttttataatatatttagtagttgaaaacaatgctctgtcgtcaatctactttaattcattgttggacatttaacctggccctcccatttatacaaatagcactactgagaccatcattagagccagatcttgttttatatctttaattgtttaattagagcaaatgtctagaagtagaattgctggattcatgtgtcagtaaaaattttaggtcttttgatatgcattcatgcttatatcagcaggattcaagaagcccattttctcactcttttaccaccactgaatattatttaaaaagtggtaccaaggcagggtgtcttggctcaaacttgtaatccaagcactttgggaggctgaggctggaggattgcttaagcccaggagttccagaccagcctgggcaacatagtgagtccccatgtctacaaaaagtaataaatgaataaataaataaccggatgtggtggcatgcaccagtagtcctagctactcaggaggttgaggtgggaagatcacttttgcctgggaggtcaaggttgcagtgagccttgatcacaacactgcactgaagcctgggcaacagagtgagaccttgtctccaaaaaaataagtaaaataaaataaaataataaaatgtaggtaaaaaattgtagtcaaatttgggtatgcaagaaatatttttacttctttattttctttaagtgaaatttgatcttatctcaagccagcaactcaccctttccccacccatctgcactgtcaggaaaagcaatcagtgccattctttatggaacctcctgtcccttgctatggtcactgaggctcctacttgatacctagaaaatgggcaaagatttattacatcatggaggctgctgtgtcagacctcacagccccaggaagatgtgggcagttcattccaacggacaacaggatctttaactagacagagggaccctgttctttgtttttctctccccaacttggggcctaccaggaaatcctagggaccttcatcctcttctcctttcctagccatgggtattttcctctctggcactgccagccctgctccccctttttttttcctagtgtcatttcttttaggagatctggtgtcagtgaaaacaaaagccaggcatgccagctgtctgtaggcaacatccaagtccaagggaaggggaatggggggaggatggtctgcctacttgaaacagaggagccagaaatgaagggaaataaagcacaaataaatacttcaattaagtattttgacctatgtgtatgaatttgtctgtgtatttatagtcaatttatcagtctctctagttagttctaatagatttctttttcattagaacttgcttctcaaaaattatcacattaatactcttttttcgtgtttaaatgcaatccatcttcctggattggtgctatctctggaaagaacacttgtagaacttggatgataatgcttttatatgaccagtcgataatccataattgcagtacattacgatgaccatctatgtcccttttgtcttcactggtggttctcaaagtgtagttcccagatcagtataatcagcatcacctgggaacttgttagacaaattattggtcacaactccagacctactgactcagaaactctggtatcccccttccccccaccaatcagtagtttaacaagcccttcagctgatttcagtacatactaaagtttgaggactgctgctctacatcatcatcaatcataatcacgcactcatcttgctcatgggtactttagggtttccaaaccctttagatgattccaaatcaccaccgtgatttttaggggtaaggttaatgcaacaatacactaaagtcagtgtttaactgcacaaaaactcaccatcatctttctatacccaaagttgtgtctttagaaaaccatttctttaattggcaggcaactccagaattgatcatgtaggaaagcaaaattcattagcacgaactgtacaaaagtttgcacatcaaaaacccaaagcgtctcttctttttataaagatttagttacaaagataattataaagataattatgaaataattatgatttatatgttatataaataatgtaatcaatatttataatagataattataaaataatctttatgtgttcttttagaactataaaaattatgtttttaataagttttttattaaaaattggtctttttatgagactaattacaaagattaaagtctcctgcttagcttatctgtggtttgagtagctccagtagctcgatgggttagtgtgcagtggtacttatgcggtggcactttcatgacatgtggtttgccctctgaagctttgtgatctttcactgcattccaatactagaaataacatctttacatttttactctaagtcagttgccgccttgggaaatcaacttgtttttaggtgcttggttccctaagagggatatgaggagagtagataattttagtagttattaatgagaaatcctcaaaagccatacttttttaaattcttgtttttgaaacatttctggcacgataatacaggttgagaattaaaaacaagttttctcatttggcatgtttaagtgaagtcacttgcccagagcaggtactgctgtttatggcctcgcctgaatgtttgtggtacaactctttaggatgatgcttctgccaggactgtcacatgtacatgatttcaaatgtgctggcattttagtcagtgtattggagatagagtcttaaagcggctggaagagaacaatcttccttactttgattactttctctctctttaacactacctcatgcctttacttttaactattttaactttaactctttttttttttgaaccagacttgatgacaatccaggttgcaaattttagttttaccatgtattagctgtatgaacatgttagtttcctcatctataaaatggaaattttaatctatacctcacaaaacaatcaagagtaaatgaattacaattagacaggaggactaagggctactgttctatagcacagtatgagagtatagtaaataataatttattgtatatttcaaaatagccagaagagagaattttggatgttctcactacaaaaaaaaatgagaaatgcttgaggcaatggatgtgccagttaccctgatttgattattatacactgtatacatgtatcagaatatcatatgtattacataaatatgtacaattatgtgtcaattagaaattgtaaaaagggtaataaatgagataatgtatttaatgtgcttagaatatatgccacctagctaataacattattagcacataagaaataatcatatagttcttttacatcgtttcttaattctttggtatgatcgaaaatagaaattataagatttcaaactgcatttatatctctggataatttttacttcaaaactaggttatgtacatgattaacttttatttccaaccatttcaagaaaagaatatggagtaaaatcttatttataaaggaggaaatgaggtcttctggttgtaaatgacgttttatttacaacctggggacagcttccaatttattcagcaaggaattctttccaaaagttttttgatgtgagcagtgtatttatcttgtgctctgtttctggcccctgttattggttgtggccaagaaattataaaatataggatgaatctatcaggaactttgtgagtgtgaatggccagaggccacctgtccatgtgtgtgactctgctatggctgattcaacaatgcagcaaaccccagcagtttcagtagttccacaccttccgcttgttattaaggggtgacgttcaatgtgctcatgaggacgaggtcaggcctggcccaacctggaggccaggtgatggtccctagttggatgatctgaagacatcttttgatgcagtttgggttgaggaaggcaagagatgtattgatgctatcataggagtgaatcaggtgaggtaaaggcaaggaaacatgatatgaagtagaactggattcattataatatatgtgtgatttagtcacacaaatataccggcaaagaatgtcaagtgttaatcaaataggtcaactaataattgagggccaggcaaaggcaagccactgtcagggcaaagaagtgatacttttatctcaccccttatagagtccatggctgacacccctgtaacaaaggacctaataggagaaaagcataacaaatttatttaataaagttttatgtgacctgagagctttcagacacaaagaaccaaagacccagggaaaactgtgtttttttaatgcttaggactgatgaagaaaggacagtcacacagaaatgtgattggacaaaaagggtataatttgatgttaatgaagtataggagagaacctagcaaagcttgtttgttcacattcttcttggcctctctgtgtagcattcctttgccctggttatggggcaagacacctggcacaagaagcttatgacctgatcttaggggaggtaggtcagagagtaaccttttctaggttttatggctttctttggggaagaggagttgtagtttctatgacacaccttggtggagaaagggaatgggagaaaggagggcaaaggaaggttggagagaccttgcttttgaagcccttccagtctcctttacttcaaagtattctgcatggccaggtgccatacttcatggtattgtttaatgagccctgacatcacttaacaaaccacagtggcagatttcaagggatgttgtcagggagagtgggagaggagagtgtgatagacaactaaacagaaagcgactctacagcttgctaagggaagaagagagggaagcattaaatgagaaatcaactggagacagcaggtacttacggagacagcagatacttttagagacagcagatatttatagctggcgtcctacaccagggtttactttcatcatcccttttgttttcaaaactaagggtcatttttttcaacacaatgtcattatcagaacctagttgttgtaaagttttggatgctcccaaagtttctggagaggtaggtgtctgagtccttgcttccttccacaccttccacttgttattaaggggtcgacgttcaattacttagtggcatttattaccccaagatttctataagtgtcctcttggatgtgaagcattgttcatatatgaggggaaaagcaggtctttttgctgggaaccatatagaggtgatctcatagctttgaagtaccttgattggctaacacggtgacaccctgtctctactaaaaatacaaaaaattagccaggtgtggtggcacatgcctgtagtcccagctactagggaggctgaggcaggagaatggtaagaacccaggaggcggagcttgcagtgagtcgagatcgcgccactgcactccagcctgggcgacagagcgagactccgtctcaggaaaaaaaaaaaaaaagtaccttaatgcagcccctctcaatagtgtatttggctgggtccactccttccttttacttcccagatttagcttaattatggtgacaatggtttactctctctccattccccaccctgtttcctaatgttctttagccaagggctttgtagaaggactatgtttctaccagtggtatgtcactgaagtgggctattgaggtgaccaattaggacaaaggtgaggagtgtcttcaggggggtctttatctcatgtttcattcccttgtatggattgctgcttcctctacctttttggattgccaattccccatgtctacttttcttctatgggtttaacatagtgttttctctgaccctatcggaacattgttcagcagatggctttatataaagttattttgtttgctattaagcatcttagctatgctcaatgttttggggctgaattgttcattgtggcaatttgtaatatttgtaatatatttaagtaactctagagtcttggcttttaacattctcattcaattatgagggtcaggtcttgatctgaactatgtgtttatggccttttctcaactccttgtatagagatagttttccagaagtattaatgattgattgaagcagataaaatcttttatgttttcattcttttggaactcactttttggtggaaatacttgcaattcaactaatttactggtatgacttgttatatggattcttgacatgatgattggtttttataaatttgagctgtatttactcacttccatgaattgtgcagttatgaaaatttgaatctgctagtttctgatctccatttgtggaagaaaaagccaataaatgggaaagttattttaattctataatgctacatctagaaagggcgtgacaaatttttgtttgtaatacagttcccagtcattggaaggggacatctcttggtctgagtaatattcttcataatattaacacctgctcaatattgagcaaaacttcaattgcccacttctggccatatatccaactttagaaagtcatgtacttctagattttatagaagaatactacttctagattttgatttttttaaattaatttctctctctctctctcttacttttttgagacagggtctcactctgtcacccaggatgaagtacagtggcatgatcatggcttactgaagcctcaagttatcctcccacctcagtctcctgagtagctgagaccacaggcatgtaccaacacacccatcacacccatctaaatttttaaacattttttgtagtgatgggatctccctgtgttgcccaggctggtctcaagctcctgggctcaagtgatcctcctgcctcggcctcccaaagtgctgggattacaggtgtgagccaccacacccaaactgaattttttaatttatatttttcagatttgttactgtacccttcttgccattgagtacttaatttctccatcattgtttcttggagttttaatatcgaaatgcttcattatattgttcaataatgcagaatgtttgaatttaacatagagatttttaggcccataggctgaaataagtcatcaaaagatggaaaaacatatggtgatgaggcatgtcatacatgccaagcaggattggaggaagctggagaacttgaagccattcagggacaagaagattagcgagaggatttcaaagaagtttggagccccaagtcataagaaataaacacatgattccttatctcagactttactagtgaaagaaaaaataaaaaacaagctctctttcctagggatataaattatcctatgacaaatagaaagtgaaattctgtaggttattttcataacagaccttccagagaatttgctgatgactggaaaaggggaaaatgcaggaaaaaaaaggtataaatcctaagagtttctaaagtagccaaacaaggcaggaaaatgtctaatcttattgtgcaaaagggaggtggaatctgtgtggaagaaacagtaatataaaaataatggtacatgttctcatctgtgtaatgctcaatcatttccagtatgccctcacctggccacctgtaggagtatagcatcctacagcagaatgggacgtgtgtttggctgaggcctgactctcgccccttatagtttatgacaagagtattggggccaagcagggaagaaacatggaagaaacatctcattctagggcccacagtgaattatggccactgccgggacagagccagaatcatctcaggataggtatcttttacccacagatttctgcctcaggattgtggatgaacttgaaggtccctgtcttagcacctgaaattccatcagcagaagctcagcgtgccatagtttgcatagaacagaagcaggaaatcttaatgatgaactctacttacatccctttaatgggatcatggaactggtaggcaagaagcctagattgtatcttgcaaatttagagccaaatcttactgaaaggaatgagggaatatagatgagtagtgactactttatttttctacaacactgtttcctttttgagtcctgattctgctgacatggcacggaactttaagctcaatggtttaggtgtttctttcccttcctggggttgtatcaacattcctggaagtttgtgtggaactaggcctgggtgaaagggacccagctgttccttgaacctaagtctgctttgctgtgtccttcattcctatctatgtggcctctcaggtctagcaaacctcctgctgctttggtggcttgcttagggcatagtaagccactaggactccatgtttctatgaccaggcagtggactgaatttgttccacagacgcattttatttagcccacaaagttttaagaatctggaaattttatttgaataatgtagttttcagatttctcttgaaaaatgggaaatactgtaactcagtgcctgcattcttgcataggagcagccagctggctggggctgtgcctttgcatagggcattgctgtgcctttgcatggggcattggctctccaggcccacacaggcccctccagtgtccattggattccacctagcttccttcacccacttgagttttttgcatgatgcctccacgctgcacacccacattctctctctggagtttgtccctctctgagtggcttcttttgaaagattgtcttgggcccctgtactcctgggccttcagatcttcctttacttatcgcctcttcccttttctctttcccccagtcaaaaagaagcttttgcagtctgggcatggtggagaggagctcttttcattcactgtgcttctctctaacactttgtctgtacccctgattatggcctccacttcagatgccagtcacacatccaggcttcccgtatttctgaccaaccagctgatcagaggttcccacgacactctcctcgggtttgatattttattagaatggatcacagaactcaggaagacactttacttaatatgaccaatttattacaaaggacacaattcaagaatggccagacagaagagatgcatggggcagaaagaggcatgaagcttccaaaccttctctgggagcgccacactccttgtacctgcatgtgctcagcacccctgaaactctctgcactccattgtgtagggtttttatggaggtgtcattaaataggcatgattgattaagtcattggcctttggtgattgaattcaatctacagcctatctcccctccatggaggttggaaggtggggctgaaaggtgccaaccctctcatcacatggtcggatcctctggcaaccagacctcatcctgaagctatttaggggcccatcaagagtaatcctattagcataatctcaggtgtggttaaagagccttattatgaataaccaaagaggttcttcttactcctatcactcaggagcttacaagagttttagggagctctgtgccaggaactggggactgaatatatatttgttatatcacactatcagttttgaaattcaaaatggcacaatcaagattattcctgttttctcccttaacacactccttctctgagtcaatgagtacatctgtgcggagtgtctcccatttgccctccagacccactcttcccatctttcccattctctctgcctggagagctgatctgtatggactgtctcaatggacttctctgccttctggcttctttttgggtttggtcaatgggcagctctcccaggcagtctaaggtaaagaggagagtaaaggtgaggtgtttgctttttgtgattgtctacatgtgctgggaactacactttcttttcaagccttttggcttgaaaatgttaacagtgcctgcttgctaacttcagggaatgtcactagctctgggggttgctacagccttcccacatctttgtaaatagtctctattaaacactcaaattactctgtttgaaagtgccatttatttcctcttgggactctcacagataaaacgttatgtgcagttgtttatccatagaaatatttaataatatttatacagattttaagttttgtctaaaaatacattcaatgttaaaatgcagcatctgaaccttatgtcaatgtaagagttttctacaaaacagtcatatgtggttcaaaacacaagaggctgaattgaagctttttaactcctacatcacaaccttttaacacacaaggaatcctgagtgcaccagtttctaagagaacctaacagtactaaagatgatctagaaaaagaaaagaaaagaaaagaaatggggatgaattgtctgaggaagaattgtcagtaacaagttcatcatggccgtcaccctgcagaagaccctaatcagaaaacacagcttcacgcagctaaatttttaatgctcttctaaataatgtctgaggttagaatgtcagcttgggaatcccaaacatccagtaaaatgggacacctttgccacctctgtgagagtgttctgaccttgtctgtgtttttctccccttcagttcactcagcaacacagggaggtgagtaaaggatttggcagcacatttgaggcccgggggagaaagagtgcttgcaggcatgtctccacgttgcgcggaaaacatgatgtttagctgttgaaactattgtgaaacttggctttcttccttagtttgcctttttaataaattcctaaatcatgatttgattcataaattacaaatatatggtgtttgtacatgtgaaatacaagatcataaccatggagaaaggccaccattacccatagatttttaatcaaacaaattggtttattctgatgtttctctgataatttctctccagaccagggtttttttttttttttttttttttttccctttctgataacacaccacacttttggactatctacacaaatagctatgaaaaatggccttgttataactgagggaacttcattatattgaagtgctttttgaaaaatattctaaaatatgaaaactggccatccgaacaggagagcagtatttctgagggtgttctgctggctcgcctctccacgtctgacctgtcttctttgtgagctctgaatcttcctgtcacctcttcaacagcagtgtgttctgcaagtccagccttctcctctctgtggcgtcctttcggagatcatctgtacgctcaaggcttcagttaattacttgaataatgtatatatttaagcatcttcttcgcctttttctcttctgttttaggtcttctcagactcctcctagaacaatatagaataaatgccacataaggtaaaaattaaaaaatacatatatatatataagaaattcaaataaactgttttgtaaaagtaagagacaacatatggatcagtaatttaaaaatatatctccgaaccttcccacatgatgacttctaaagctataactcttacctcgtagtctcttttgaacataagttttgcaaaaagaatggtccccaaaaccaaaacatttcacgcacatgttcttccattaccgcagatttaccatgaccaagattaaacccaatgagaacatcttcctaccaaaaccctttagacggtctgtttctgtctgtgacacaattactcccagtaaacaagtgtcacgtctgtgtttttgcacatgtgtacctaggtatgtgtgcgcacacacacatgcatgtatgtattaagaaaggagttagtgtttattgttttaaccccacttcttactctggctgtccgttcccagtcagtttcaaatcttggattcttcttttgaaatgactcttaaagtcccccttcttctccattccagttgtgtttcttttaatcccaggctacagtcccctcacttctggactatcacaacacctgtccagttggcctctctgtctactctttccacgcctaggttataaattactcagttgtagctattatacctcataactttctgttccttgactttgctaatgctttccttctgaaaaggaatttattaatctgggctgttggtcctgttcctcttaacattttgtcaactatacttcaattacttgcatctgattaacagctgctgtgactttccctaaagtagaacatatttctttatgtctctttgataactcactgcattcattggttgcccttggctgaaaagcacattgcttatcaatgtgttttgttcacaatgatctggcagcccaagcatgatatttaatgtaattgatgtctcttatttactaatggatgttacatcatcattatttagaaaatttgctactgaattgacatctgattgaggatacgtgattgaggttaagagcctgtgaatgtttggagaatacttgtttatagtatgtactgtgcagtgtggtgtgctatctacaggctgcagctggcgtttccttctgttaatattctgtacttgatgtggctaagtaggcactgagatgctcaacttcagtgtttcctcctacctactgaaggacaaaacacttactggcagcaatcatctgatgcaatgtaagtaagaatgaaaaaaatacaggacacttatggaattatataagataaaaattagtatgatacacccatatttttaactcatttgtgtcagggtagttttaaatgaaagtgttattctaaatatggagaatctaaagatctatgtagttttaataatttattataagagaacttgagttagaggctttggagtgtcagtcattaaagtttactaattattctagccaccctgcccctccaattctgggtatatggtaagactgcatttactggagctcttctgattggacagagtttacaaccagttttacccactgagttgtgagtagcagtggctaaggcttttattacagtgtgattaggtttcctttgctttcattgcaacgtgatgaggtttcctttgcttttattacaatgtgatgaggtttccattgccaccatggctagcaatgatcttcacagtggctattctgtcagcctgggacccacagtgaagacattatggaacagagtttagccacctgtcactagacatgaacaagaaaaaagaaatacataatttttttaaagggctgggcatggtggctcacacctgtaattccagcactttaagaagccgaggcaggcagatcacttgaggccacgagttcaagaacagcccggccaacatggtgaaaccctgtctctagtaaataaataaataaataataaaaaattagccaggtgtggtggtgggtgcctgtagacccagctgctcaggagactgaagcatgagaattgcttgaacccaggaggcagacgttgtagtgagccaagatcagattgtgccactgtactccagcctgggtgacagagcaagactccatctcaaaaacaaacacacaaacaaacaaagcttcgtggtttgaagccactgatatgtaaaggagttttgttaccactgcataacctagtccctcctgacagatacacttggtgtgattctggttatctctttgactgtttcatctcatgtaggttacttaatcctctcattctttttacttttctgtaaaaaaaaaaaatgagtatagtatctacgtgcctaccttacagggttattataaagaccagattagataatgatgtatgtgaacgtgttacacaaataaatatacatacatataaaatatcattattattttctatgcaatcagataaacttctccagtaatgaactatagaaacgattcctgaaagagtagcctttaaaatattatttttaagtggtattcatttttggagcttaaaaatggttcttcattttaaacataatttatgctggtgctaagtctaaagcataaagaaggataaatgtataagaaaaatctttcacctcaacatacccccatccacattctcaattatagatgtgcctactgttaaaaatttcttatgaataatcatagcagtatttttaatacataatgtttttcaacattgttctgtcacttaacagtatattttgaacatttttctcattttttttctttttaatggtttcatgatactctactggataaatgaacagtgcattatatactttttcaatcaaaattttctttttaaaatttttctttgaaaaaatgaataacccttatcacttaacacagcttaaattattttttttaatgtccaaaagaaagaacattataggaacagatataatacatgccactgtctttgtgatgggaagtaaaaacaggataatagtaatatttatgatgtggaatgataaacagtaatgcctatagagatcagggagataaattagtaaaatcagagatgtgggctaaggaaaagcattgcaaggagagagaagggtaggaagggaaagaaagagggagaagaagaaagagaagagggagggagaggaagagaaaaaagaggagagagacttgttgccaccaagaaaatacatgtctttctaaaggcagctgctactcagctgaagtccactgttttcaataacaattctatctcatcattggcaaatattatttttcaagagaagtaaaaaaaaatcaatatatgtatgattttgattatttaaagtgagaagctaaatcagaaactttatttttaatgcataagccaaattacatttgttatttggggcaaccagatatagtcaaggcatagtgtgctaccctctaagataaaaaatataatacaggcacagagttttaacgtgtcttaaagaatatagctacatgaccgggtgcgttggctcatgcctgtaatcccagcactttgggaggccgaggcaggcagatcacctgaggttaggagttcaagaccagcctggccaacatggtgaaaccctgtctctactaaaaatacaaaaattagctgggcatggtggcaggcacctttaaccccagctgctcgggaggcagaggcaggagaatcgcttgaacccaggaggcggaggctgcagtaagccaagattgtgccactgcactccagcctggatgacagagtgagactctgtctcaggaaaaaaaaaaaaaaaagaatatagctgcatattttggtcttgtcttcataatctacctgtgtttcataccatagaaagcttcctgcctctaagcatgttttcataaacctacacaaccagcttcagttagcagaaatccttaagaaacaatattttagtgtaattttatttccagtctgtcttgtgctctaaagctcttaacaatcatacaaaaggagcttttgatgattctctctttgacttgccatttaccacctctttccatatcagaaatcaaagtggaattatgcatgttaatatggttgtaatttgactttcatatggtactgactaaaaagcactcaatacagcataccacattggtgtaaaagcaaatattttattaaagaattttgaaaagcacataatttatctccatacttttttcataattgattagttgtacaacatgcattttgataaattcaattacaaaataaaaatactcgatactcatatataaaaagtaacataattttaacatttttgtctatttacattggatgtttaacactgttgtctttttacactttctatttaggtcttttttttttttttttttttttttttgagatggagtcttgctccgttgcccaggctggagtgcagtggcatgatcttggctcactgcaagctccgcctcctgggttcacgctaggtttcttcttaaatgacctaaatgacatgagagatgcaggctgcagacattttttaaagtagtgaaatgcttgctctagagagtgtttttaagcctaggttgctttaattaataaaacttgtcatatatctcaaagaagggaaggtatgtgaaaaaaaaaaaaattcatccctgatgtaaggttgaatgcataattatttatacatatatgtaaattagaataaagatgactcttggttgactcaaagggtgttcaaaattggaagttattcttttatggaaggattttattataaaatgtaaaattatggttgaacaaagaggttttgttccatttggttatacatgctgagaaaattcttcatttttttaataagtctgaatatctcctttccaaacttggtaattttctggagtctaataataactgaaatccctttttaaaaacctgccaagagaacccacttttctgtctgatttaactaatgtaagtattagatttaatctgtttagttagggaaaaattagtttgtgaccgcaaatggctgtctgcattagttatatccaaatgaacagagtcatttttggaacattttttgatatccatttttcgtttacttggctagtttcccccaactttatcagttagggttcacagagtagttctacagaaccagaaatcagtaggagatgtgtgtgtgtgtgtgtgtgtgtgtgtgtgtgtgtgtgtgtgtgtgtgtgtgtgtgtgtgtcatagcagctgacagatccaaaatccgtagaactggggactggcaagcttaaactccatagggcaggcaggacagcgggaaacaccctggcagtggccgaagccgcagtctacacatgaaatttcctcttcttcaggaaaacctcagttttgctcttaaagcctttcagctgagtagatgaggcccactcagatcatcaagtataatctcctccacttcaagttaactggttgtagatgttaatcacatcaacaaaatagtttcagagctgcatcttggttagtgtttaattgaataactgagtactaaagtcttgccaaattgacacatacaactagccattataccatctctttttttttttttttttgacggagtctttctctgtccccgccaggctggggtgcagtgacgcaatctcagctcactgcaacttccacctcccaggttcaagccattctcctgcctcagcctgtcgagtagctgggactacaggcacgcgccactacgtccagctaattttttgtgtttttagtagagacagggtttcaccatgttggccaggatggtctcgaccttttgaccttgtgatccgcccgtcccggccttccaaagtgctgggatcacaggtgtaagccactgcgcccggccggcctataccatctttttataatcttcaaggaattttcttaaatcacctgactgagttccttctctgtgctcattctgtgcttgctgcattcatctgtcttgtaatttacaacaccatattaaggctagatatttatatgtttgtcacggtcctcaaactgtgtgtgctccttgaggttccagggaattagccatctatctttgtgttctctgtgcctagtgtgatgggtggcatatacaggcatcgcttgttttattgtgttttgctttattgtgctttgcagatattgtgtctttttacaaattgaaggtttgtggcaaccttgtattgagcaagcctattggcaccactttttaaagagcatgtgctcactttgtgctcctgtgtcacattttgataattctctcaatatctcaaacttttttgttattcttatctattttatagtgatccgtagtcagtgatctttgacattactattgtcattgttttggggtgccacaaactgtgctcataaaaggtcacaaacttaattaatcaatgtgtgtgctccgactgctccactgacctgtcattcccctgtctgtctccctctcctggagcctccgtattccctgagacatgacaatattgaaaccgagccagttaataactctacaatggcctttaagtgttcaagtgagagaaagaattgcaggtttatgttaaatcaaaagctagaaatgattcggcttagtgcggaaggcatgttgaaagcagagacagccaaatgctaggcctcttgtgccaaatagccaagttgtaaatgcaaaggaaaagttcttgaaggaaattaaaactgctattccagtgaacataagaatgataagaaagtgaaacagctttatgggagatatggagaaagttttagtggtctggacagaagatcaaaccaggcacatttccttaaaccaaaccctaatccagagcaacgccctaactctcttcagttctgtgaagtttgagaaagctgaagaagctgcagaagaaaaataggaagctagcagaggtcggttcctgagatttaatgaaagaagccatctctgtaacataaaagcgcaggtaaagccgcaagtgctgatgtagaagctgctgtagccagttatccagatctagctaaatttactgatgagcgtggctataccaaatgacagattttcaacgtagatgaaacagcgttatattggaagaagatgccacttgggatgttcatcactagaaaagagaagtcataggttggcctcaaagcttcaaagggcaggctgagtctattgttaggagctaatgcagtgggtgactttaagttgcagccagtgctcattggccattttggaatttctatcgtccttaagaattatgctaaatctactcttcctgcactctataaaaggaacaagaaagcctggatgacagcacatctgtttacagcatggttaactgaatattttaagcccactgttaagacctactgctgattaaaaaaaaaagattattttcaaaatattatcgcttattaacaatgcatctggtaacccaagagctgtactggagatatacaaagagattggcattgattatgcctgctaatacaacattccttctgcagcctatggatcaaggagtaagtatgactttcaagtcttattatttaaagaatacattttgtaaggccatagctgccatagatagtgattcctctgacaaatctgggcaaagaacattgaaaaccttctggaaaggattcaccattctagatgttattaaaaacatttgtggtttatgggaggaggacaaaatatcaacatgaacaggagcttggaagaaattgatttcaactcttatggatgactttgagaagtttaagagttcagtggagaaagtaactgcaaatgtggtggaaatagcaagagaacttgaattagaattggagcctaaagatgtgactgaattggtgcactcttgtgatgaaacttgaatggatgagggaattgcttcttacggatgagcaaagaaactggtttattgagatggaatctgctcctgatgaagatgctgtgaacattgttgaaataacaacaaaggatttagaatattccgtaaatttaattgataaaagtagtggcagggtttgaaaggattgaccctgatttttaaaataaattctactgtgtgaaaaatgctattaaatagcattgcatgctacagagaattttttgtgaaagagtcagttaattggctaacttctttgttgtcctattttaagaaattgccacagccaccccagcctcagcaaccaccaccctgatcagtcagcagccatcaccatagaggcaagactccccactatcaaaaaaatttcagctcactgaagactcagatgattattagtgttttttagtaataaagtattttttaaattaaggtaggtacattattttttagatataatgctattgcacccttaatcagctacagtatactacacacacaactttgatatatactagggaataaaaaaatgtgtgtgactcattttattgtggtggtctggaattgaacatgttaatattgctgagatatgcctgtattaggtgctcagtaacagcactccactgtagtacaaaatgtcatttaccacattacagagggagaatagatcacatttagcaccttagcttacctatacccacaacttttttttgttttgttttgagatggagtctcactctgtcacccaggctggagtgcaatggcatgatctccgctcactgcaacctccgtctccaggttcaagtgattcacctgtctcagcctcccaagtagctgagattacaggcttgtgccgccacatctagcttttttttttttttttttttgagatggagtttcactcttgttgctcaggctggagtgcaatggtgtgatcttggctccctgcaacctcttcctcctgggttcaagtgattctcctgcctcagcctcccaagtagctgggattacaggcgccttccaccacacccagctaatttttgtatttttagtagagacagggtttcgccatgttggccaggctggtcttaaactcctgacctcaagtgatccgcccaccttggcctctgaaagtgctgggattataggcatgagccaccacacctgggctatacccacaaattttgaataagatatataatgtaaattttaagggcatggtaatataatacaaacaaatcatcaggagtgaggattcctggtttttaattccaatccaggacctaaccggctggctgtgtttcagttcacccatcaatctctgggtcttggttttctcatctaaaagcatgaaggttgagtgagattattgtctctggttcagaagtggcctaatggtttacaagaagactgaacagatgtattttctccccctctttcttcaaatgcattgaaatgacagtgaagaattatagcggagaacaaatacatgacaggaaggtaaattgggaggcggggatgggaagggaggatcatcagaccagagttatgaatttaatttttgattaaggagaatggatggaatattgtaatggataatattaagtggaacaaggtttagcccagagtatatttaggaggaggctaaatgcaagggctactgtcagaattgccagcttctggaagctggattgggtggagggacagaaagcaacatcttttttttttttttttgagatggagtctcactctgttacccaggctagagtgcagtggcgccatctcggctcactgcctcctgaattcaagccattctcctgcctcagcctcccgagtagctgggattataggcgcccaccaccatgcacagctaatttttgtatttttagtagagacaaggtttcaccatgttggccaggctggtctcgaactcctgacctcaagtgatccgcctgcctcggcctcccaaagtgctgggattacaggcgtgagccacagcacctggccgaaagcaacatctttaaagtctacttgacagctgcaagacagcacccgaccccctcctctgtatgcagactaactggaagtctgacatttatggccaggtaaaacacagagcactcttctctcatgaaattagaggagctgagggagctaagcatttctaaagtggatgccagcaacccaaagataacttcgcctcgtcctggctatttgtgggaaacctcagttcaacagcttcttcatctttcagggtgaagtgaaatctgccagtttacatgccttgccccaagcactcagagctcccggcgagactcctgttaactagactgatgagttttttgactaaatgcttcattttccaccctcccttgcagctgaccatggtcatgtgattagattctggccagcagtatgtagacagcagtaatgttcacagctgttaggtgaagcccttgaagagatggcacgtttctttccccttccactcaaactacttggttcaacagtaaataactttaacatggtcccaattgtgtaaatttagctgtttaaaaaaaaaaagtttggaatcaatcaagggataatgtaaggaagactaaatcatggttataggacaaaatttaaatattttaaatgaaaaagaaatggtaaaactaaaataacctgtgaagagtcaaatatcatgtgtaactgatgtaacagcaaagagatttttaagtatatgattgacatgtatgatcacaacaacaaataagaactaatcatataactttcagatatcaggagaaacagataggagtggagatggggatagtaaaaataagttgtaactttgttaatagaagccaaaataaatttaaaaactagaagcctaagttcatcacaaagagttatgtggttacctgaccaacccgaaacagaagctgtttaagatgattgtctctggagaattaaatggaattgaggatgggatatatgagtcagagacttgtgtgtctcattttatgccctaccatatatattttttaaaaaagtgtgtgtgatagctttatatgatatcaataatgacgataaattacatagccatgctttaaaataatgccatcctaattttattaaagtaacttttctttacatgataggatatatgtacatgtagtatgtcaatttaattccctccattttattccaggactgccttccttaagtgttttctgtgttagaggatattttcaggaaaagcaagtgtaaagtaaacatttctccttggttattaaaaagttctaaagcccatcactagttgggatgctgtcctccctgtggtcatcagaataattcagagatcagattattctggtttatgtggcttgttctgggcaaatgagcaggccaagctgcatctcaagggttggccaacttctcagaggccatatatggccttctactcagaagacttctcctgcatataactacaaatcctttcccatcccaccttgcaaccatgacactaaccgtattgcattatgtatgtttatgtatattatgcattgggacataggtgagctcagctaggccatgacatcccacagttgagacaggtttgcttagaaagcaggtgtctgggtgtgaacatttgtgtgtcccattaactgccattcccgatccattatatcaatttcttcccttcccctgtagtctttcatccttggagcctggctcaggggattcatgggacagaaaagacaggatcggaatcagaatgttcttttttttgatctctcactgccccttacgttttattcagtgcagatagtttttccctgcccctaaatgaaaacttgatttgtctatgactttcctgttgatcctgagatagtaaaataccctgtcgcttggcagacaatcatggtctcaatttagaatttataatatcaagtcatgtgtgtcagaattctgaagttgatttaaagttcactttttctttctttcaccttgtctgaggcctgctatggaccggctgctcgacgtaggggaagggcatagtctttctactttctttttataccaaccatgtctcctccattagcttgaaaactgaagtttgtgattttactagggggagtcaaaaaaaggttaaagggggacagatgtagaaaagttcttatttgaaagctggcttcatgctcttacagtttcttcatagactgtcccccaaccccagcaaccccaatacctggtgatctgtcccttgcaattcttttgacctggggggttgtgttctatcttgtcactcattttcttctcaatagggttgccagatacaatacaggactctcaatcaaacttcaatatgagataaataatattgtcttagcataagtacatcccaaataatgtatggaatatacttatcctaaaaaattatttgttgtttaactgaaattcaaatttaactaggcatactgtatttctatttgctaaatctggcaactgtaggtagaagatgtttttcagggatgtctgcttttttgggccaaccaaatctggatatttaattatgctatgctctactactacaacattatttttccatgtcaagcaccttttcacaaatataacatcttaaaagagcttcgtagagcaactgaatatgttataaacttttccttctttttaaaaatgtaaccatctgtccaaaactgtaactcaaatgttaaacatttagtacattaaaaaaattatatcagtacctacatgtgagagagtgttttaagtcaactagagcgtcaacttataagaagctatggttggaaggaagtgaccctttctacatgtcagtcagtatcttctgaaacaactggcagacagtaggtgcttaatgaacatttgatgactgactcatagtgttatctatggttttattatgtaaaattatttcaagaatttccccaaatttaaattccaatgttgctaattcatcactgctatatctgtacagtactagaattacacacacaatgaaaagaatcctgggccagacgcagtggctcacacttgtgatcccagcactttgggaggctgaggcaggcggatcacctgaggtcagtctggccaacatggtgaaaaccatgtctctactaaaaatacacaaattagctgggtgtggtggcgcatgcctgtaatcacagctactcaggaggctgaggcatgagaatagcttgagcccaggaggtggaggctgcagtgaaccgagatcacaccactgcactccagcctgggagacagagcaagactttgtctcaaaaaaaaagaatagaaaaagaaaaaaaaagaaaagaattctggatgcacattatgattaagtggatctcagcaactgatgtcttctgagatgggttgtgaatatttaataacagggattattagaacaaactattgctttccttatgggggcagtagaattttgtttctttcaggaccattaaagagacagctgtgccagagaaaggactagtttatcccttcttttcaattccatcaggcctgttctgagccaaatccattccaatcagtttgactcattattcttcaagatggaaagctggatatttttacccaacatataggaatttcatgtgacttctcaaattcatacaaaacacttgcaaaagagaacagaattttttaagagaaacttttaaagctccttgcctctaacatcactttcttagctagccaatttcatgtagccaaggaggtaaatggatgtagctaagtaatttcctttcaataaattgaaataaagattccctaaagcttgctgtatactactagaagtcagaaaaagaagatgacactagaaatagtaaagtatcttcctatctgctacagattagaggcaaatataaatatgaccgctgccatctccccccaacaacagtgcaaaatattctggtacaaatatgtgaaggaaaaggctaacacatgcatatacaaaatgccatttgatagcattcgtgttacacccttgggaaggagattgctagccttgctgtccctaattcagttgtaaagaaattgtatataacgtttcaagttggttaagctggaattccatttccaagaatcccctgccctgtgtgattctggttgcgttggctaaaagaagagttttgaaggttgaagtgaagcagcaaccattcctctctgaaggttgtcacagttcaatgtggtgacagtcgcagagatgctggcaagttctggcttgatcttactctcctccaccctgcgtcttgctcttctttctacctgctttccccgtttaccaagcacggcccaagacccagcaccacaggcttgactgcagacccacagaggcaacagcctcggggcatttccctctctatgaaccttcccttcatgcttctcttgcatggctgggcacccttggcttctcagattgactggatggtgacttcccccatcttccaactttcccccagcgccttcatttccccagcctttcccacaactgtataaagtctgctagctgtaacaaatcccttctcccatggcttcatgtgccaaaggtcactgaggattactgaagcccagtttctctggacatcaaagttctcatttagaacaaagctgccatcaaagtgtctagctctgcattatgcaatagactgtgcccttgctaaaggtaaacttgatgtgactgcatttggatgtaacagccaaatatacactagcagtatacccatgagtaataggaacttcttgagaataacaatcccatctgagagaaaagctcatacacaatgaagccggctcaggaagcttagcctcattacaatgccgtgatttttaacttgtgtgggggtgttgctggtaaaattgagtagcaggcaccctgtatgggtgaaagctcagagaagttaattcaataaaagtcaagatggtatgaaattgctgatgaggggggacagaatgattttacagcatgtattttaaaaggccctaatgcttgtgatagtgtatgctcagatatctggattatttccttctttggaccactaccatcaactttgaagacaaccctcatttctcaatgtgcaggagctgtcttgccctgcccactccctccgtactcacctgtaaatgctgcctcctagaatagctgtgatcctgcctaagggcttttgtcaggcagcaggaacctttcacccacatgagcaaaacagaaatgctggagtgttcatgcccttggtggcatcactcaataacaataaggaatcagtggatacctacccgagtgtgtgccctagtctgtctccccaagctcttcagtgggtttgagctctagtagcctgcagtggtaatgcacgtgataatgcaccctgttttagctgctctcccttccctgtctcactttcccactcccgtgctgatatttcctgggatctgcctcctaataaaccacttgcatgtgagtctgtgtctccaagcctgcttctgagggattaaaactaatgccttctccatggctcttagccagggatgcttcttcctggctatttgttctcattaaggattcgtttaggttaaaatttgtattgggtaaaaagagaaggggaaggggctttgcaggtaaagcaaagatgtctgatgataaagtgtactatgatactaaattatagatttccctggaagcctccaaatgaattttgggtctcagagagagttatgagacccggaggatggtaggaaggggcctgtctctctctttctaagcccagtgagagggacttcaacaagactctttggggagcttgatatgcacctctacaggtggggagacacgatgttctggtgcctgccacctctctagagaagctgagagttagaggagagcaggcagcttgttgctctgaaggcagagcaagggcagatactgcagccttgggcttgccctgggtcctagtggtcacttgctaacataccttatatttgctgatgaagaatgggggagtgcttctagtggaaaggaatttggccttgtgcgtgagagagagagggagtgtgcatgttctcttagatcctgaaaataggtaaacagcctcaggagaaagaggctggagcaaatagctgcatttccaggtgttgagaaataggatggctgaatttaacaaaaatacaatatgcccagttaaatttaaattttagttgagcaatgatttgttttgaaagtataagtagatcccatgcactgactgggatgtacttacgtaaaaattattatttgttgttcaggtgaaattcaaatttacctagacatcctgtattttatctggcaactctgcttccaaaccgcctccatttcccagcaggactagaaggaaggttctgtaattgtgaaaatgaagtacttatcatgatacctgtaaaaaaaaaaaatccttggagtagaaagtgaaggttttgctgtgctcccgaactgagctaaagtgttaataaaaacttaatgctcaacttaattaattgttttttcttttaactaattaatctattgatcacatatttactgagtgaatactataggtcagacatagttccaagcactaggcacacaacagtgaacaaagcagatcaagttcttgacctcacagagctttgattctagtgatgtctgtacgtggcaatccgaatagaacttgggaccaaggaggcctgcagagttttgaagcaggtgatggttcctgccttagctcttgcaattcttgcctcctgcactggtgtccaaaactccccagggacaccatcaagaggaaaacctccattattgccagcactgctcggccttgctaagatctgtctgcagatgggatttggggacaatatgactgcagactgctcagctagacctggtgctatatatttccttcataccatacttcatttccaaagggattcgaagcagcaaactcatgcagctttatctgcttcactcactcattcattcgcttcattcagtcaaaaaagagatgagtaaggcatggctcccagctcacagggccatgaaccatgatacgctggagtaaaggaaggacaaggccctcaaagcaagaagctaccgactctgggaactgcaaattgcaatgtcatcatatatgatgctgtcaagaaaaaacaaattaaggagaaacaggaaatgcttcaactccctctcctataattcaattacaattttgcttcctgcttcttttcctaaccctttctaccacactctgtgagggtcatagaatgaaaacaaatataaatactgaattgcaaccacatgcagatagcacatgtaataaaagaagcctgcctatcatggaatttaacatgactggctggggggaatcaggctctttgtccttttaaacttggctcatattttaaatgacgttcctctgggtacatcatgttttagtctaaaagaaaagtatcaggccagtttgtatacacattcaaataaatatactttaccaggtaggtgtctgcattaacctagggaatgtatgagtgtgtgagtgtttagccagccacacatattgtgtgtatactcaccatgtgtgtatagaaaatgctacctgcatgggttgacaatttgatgtttcctaccttatgctaactattcccctttggccagttttttccccaacatcagtaatattattcagttattccctaaggggtgaaaattaagtgctattctgtgtgcagagtaggggaaattaaatctagctgcaacaagttggagctgctccataatccataatctgtagccatgatttgatttccaaaatttactgctggaaataaggttaatagtccccacatgttttcgttaagtctaaatttcacctcaattataggtgaggaaactgagactcagagaagctaaagcccccagtttaagtttgaagggctggttagtcacagtctctcgcaccagtgattgagtgactacagcctgctgccccctttttttagagggtgggtgtatacatcaaagcctgcatgtgttaaatacataggaggggaccaatctgagttggtacgtgaccccttcaccaaagtaggaactgagaaaatgaccttctccagctcacctctctagaaggaggggcactgatgatctttggagatgattttagaggcaaagctagaagctgcaaggccaccccagaaccaccaagcccagtggaacgtcagacggcatctgctcagatgctgatcttgtgtaattcataaatcactgagcctgttgactcggacttctgatgggctacataagcccaccaaggtatgttttaactctgctgtctttgcctttctaatatttcacattgaagttcttataatgcagaatctccctgaaacttctaatgggtttcattcttttgttgactcttcattcattcaggtaagtaacttcgcatttttcatttgtactggtatcagccatttcctaaacattttaatgttgctggttttgaataatagccactccacgcatagcaatctcaacctcccgctccactcaggcaaatgcagccatccatttacagatgtgcataggagctctttgcttatcagggctgccgttttcacaagatcccaagccttatagattccattacactccgcaaaacggcacacttggtctttgtgttgtatgcacttatgtccaagttttatgattattcaagagagtggtcgtggcataagaactctgaattaagcctgagtgatgctggcatgccagaggcaagtgtgagcacagatcttgacagccaaatagcacatcctgttccatatcacataaagttaagtgtgcacaccatatgaatagccacgtacattatcttatactgcagttcagagtagttggtaaacggaaaaaaaaagattctctgttttcctcatttctatgcatgatgacagatcttgacagtatcttggagggttgctaatttagtttcaggcagaaccatgcaattcctattgtctcagcatgactagaccacctcttcagatttcataatgggaaaataacacaatatctgcatttgttcttctggcagccagctagtggtgtgattgcattgttttctcaatcaagaagtaccattatttcagatagactggtacatggaagaagaaaaaaagtaccattgcttttgtcttcattgagttacatcaggatgattttctttggtagtgttatattagagaaagtaggcagggcgcggtggctcacgcctgtaatcccagcactttgggaggccgaggcgggcggatcacaaggtcaggagatcgagaccatcctgactaacacagtgaaaccccatctctactaaaaatacaaaaaattagccaggctcggtggcagcggctgtagtcccagctactccggaggctgaggcaggagaatggcgtgaacctgggaggcggagcttgcagtgagccaagatcgcgccactgcactctagcctgggcgacagagcgagactccgtctccaaaaaaaaaaaaaaaaagagaaagtaatttacagttttattttctctcatttaagcatctaacattattatatgcctaacagagtatatttatctcataaaagttgctgagaattcttttaaattaaatttactccgtagttgcattatattataaaataagagatgtattccagggaagaaagttttaagtaatacttttatattaatcaactgttgttgcataagaaacaaccacaaaaagtttattggcataaatcagtaaacattatttttcatccacacatctgtcatccagctgatgtggctctgctccaggcttgggggttgagtttaggtttgctccacattctggggcccagcttgggagtattctatccggtggctacctagggcagtgttctcatgttagaggtcggaagctcccagaggggaaagtgaaaacaagagctgctttcttttttttttttatttttaatttttatttttattttttgagatggagtctcgctctgtcacccaggctggagtacaatggtacgatctcagctcactgcaacttccgcctcctgggttcaagtgattctcctgcctcagcctctggagtagctgggattacaggcgcccaccacaacgcctggctaatttttttgtatttttagtagagacacggtttcaccatgttggccaggctggtctcgaactcccgacctcaggtgatctgcccacctcggcctcccaaactgctgggatggcaggtgtgagccactgcgcccagccaacaagagctgctgcttaagacctaagctcagaataggcccaatgttactgttgcctacattcgttcgccaaatcaagtcatacgacaaaaaccaacatcaatgacactaggaaaaatacttatcccatgattacaccttcagctttaaaagtgcagtgaactcggccaggagcagtggctcatgcctgtaaccccagcattttgggaggccgaggcgggtagattgactgagctagggagttcaaaaccagcctggccaacatggtgaaaccccatctctactaaaaatacaaaaaaattatgcaggcgtggtggtgggcacctgtaattccagctactcaggaggctgaggcaggagaatcgcttgaacccgcaaggcggaggttgcagtgagccaagactgcaccactgcactccatcctgggtgacagagagagactctgtctcgaaaaaaaaaaaaaaaggaataagtgcagcgaactacaggctcttatttaaatctaagttttaaattcgtgcaatatgaataacaatcatatactacagtcaaatttcaaaacaaaaaaaacacaaagaatggaaaaaaagtaaccagtttggcaggctgtttctcattttatcccatttcacattttatttcctattttatcttctaagagtcagaaacaaattccgataatgtagagaaagttcattagcaattttattaagaaatgcaactaatttttaagtgctgtgttaaaccaacaaatgctcaaattcatttacattaataagattacactattttaaattttcacaggcaaatgtattgaaatataatgtcatggcttaccctaatgcttattattatatgtataaagactttaaaaataattgattttgatattgtttgtattttgttttgttttgtttgtttgtttgtttgtttttgagatggagtctcactctgttgctcaggctggagtgcagtggtgcgatctaagctcactgcaacctttgtctcccaggttcgagtgattctcctgcctcagccaccagagtagctgggattacaggtgtgggccaccacacccggctaatttttgtatctttagtagagatggggtttcaccatgttgtctaggctggtctccaactcctgatctcaagtgatccacctgcctcagcctcccaaagtgctgggattacaggtgtgagccaccatgcccagcctgaaattaattattaagagctctttcagatgactatgtttttcaagctttgtataaacatggcatacacattgtatgtagatatattgatttatcaatttattgattggtgataaagattggatgggggtggggaatggttatgtgtgagaaaataatgtttgttaactactctctacaaattggttttataatacatattttacctaatgagaatgtggagtctcaaggaacacttgcccagagaatttcagttaacaaataataaatgtatctcattttgttcacatagataaaaccagtagtgaagcttatattcttctcatgcaccatactgctattctggttgacacagctgcaagaaggttaatttcgttcctctttttcttccttagcaatttttttaaataacaaaagttaaattttatctgggcatcttctcttttgagatacactggatggatatttctctgccacccagaggataaaagattataattttcttcagtcttctgataatatcatgcattttttcatatgcttttggggattgcagatggtcactgaataattgttattgtattattacatattttagaagtcataattgtaatgacttctaaaatatatcacatgactacttgtgattgacttcagcatacattgtatatagtttaaaaaatattctcaaaataccaattggtcatgattttgaaccattggtgtgcacagaacaaatgcagaaatgttttgtgaacaaatgatatagtttggatatttctcccctccaagtctcatatagaaatgtgaccccccgtgttggaggtgggggtctagtgggaggtgtttgggtcatgggagaagatccttcatgaatggtttggtgccctcctcatagtgttagttcatgtgagagctagttgtttaaaagagcctagcacctccttccctctctcttgctccctcatgccatgtgacatgctggctccccctttgccttccactatggttgtaagcttcctgaagcttcatcagaagctgagtagatatgggtgtgatgtttgtacagccagcagaactgtcagccaaatacacctgttttctttataaattacccagccttaggcattcctttatagcaataaaaaatggactgacacagaaaattgttactgagaagtggggcattgctgtaaagatacttgaagatgtgaaagtggctttgaaactggtaatgggcacagggttggaagagtttggaaggcttagaaaaagacaggaagacaagggaaagtttgcaacttcttagagacttgttaagtggttgtgaccaaaatgccaatagaaatatggacagtgaaggccaggctgactcagataaaaatgaggaagttattgggaactagtgtagagaacaaggtagtgctagtaccttgttgtgtactagcaaagggcttggctgcattgcatccacgtctgaggcctctgtggaaggtgaaacttaagagtgatgacttaggatatttggaagaagaaatctctaagcagcaaagcattcaagatgtggcatggctgcttctgaaaacctatacatagatatgggagcaaaaaaatgacttaaagttggaacttacaattcaatgagaagcagagcttaaaaatttggaaaattcacaacttgaccctgtggtagaaaaggaaaaagcattttcaggagagacattcaagtgggcttcagagcaaccacttgctagagagatttgcatgactgaaagggagccaagtgctaatattcaagacaatgaataaaaggccttgaaggcatttcagaactctaggctgcccttcccatcacaggcccagagacctagaaggaaggaaggaattgattagggggccaggcccaaggctccactttccttgcagcctcaggacactgctccctggatccacgctagcagtgctgtagcttcagctataagggccccaggtacagcttgggctgccactgtggagagcacaagccataagccttggtgagttccatgtgttgcgaagtctgcaagcatgcagaatgcaagagtgaaggaggcttggtagcttccacctacatttcagagactgtatgggaaagcgtgggtgcccaggcagtagcctgctacagaggcggagcccctgcagagagtctctactaggtcaatgtctaggggaaaatgtggggttggagctaccatacagaatccccactggggcactgcctagtggagctgtgggaaggggttgccaccctctagacaagagaatggtagagtcaccagcagcttgcaccttgagcctggaaaagccacaggcactcaactccaacctttgaaagcagtcacagagcacagaggctgcaccctacaaagctacaggggcagggcttcccaaggccttgggagcccacccctcacaccagtgtgcttaggatgaagagcctggagtcaaggattatgctggagctgtaagatttagtgtctgccctgctgttgcctcattcttttggctgattcctccctgtagtaatgggattgtttacccaatgccagttctaccattgtatcttggaagtaaataacttatttttgattttacacgttcctaggtagaaggaacttgccatgggtttcagatgagggtttggacttttgagttaatgctggaatgagttaagactttggggaactactgggaagggatggttgtattttacagtgtgagaaggacatgaaatttgggggatcaggggtagaatgatatggcctggatatctgtcctctccaaatctcatgttgaaatgtaatcctcaattttggaggcaaggtctagtggggagtgtttagctcttagggagcagatccctcatgaatggcttggtgtcctccccatagtttcagttcatgcaagagttacttgtttaaaagagcctggcacctcctccgctctcttttgctccttctcatcatgtgacacactggctccccctttgccttctatcatgattacaagcttcctgcagcctcaccagaagctgaatggatcgtggtaccatgcttgcacagctgcagaaccatgagccaaagaaaccttttctttataagttacccagtctcaggtattcctttatggcaactcaaaacagattaacaccaaaaaggaatggagacatctacccgcttttcactagggtaaacttgaatacctttgttttgttttgtttttggaaaaaaaaaaaaacccaaaaaagtcttaaattattacgaatagcaaaaattagtgatcagcaagcaaccaacttgtggttaagtaataaaatttgtaagactattatagccaggaattctgtttttgaaaaatgactttaacaatgggctttggctctattttgaatcttaaagaggataagaaatatgagctcccaatatacaatggaatttaaatacaacaattgtggaagttttgtacagttgttgatggattacccacagctgacatgcttttacttggtcagaagataaaaagaatagaaacatttaggccattcgtgtgttgttaaagcaagttggaattcaagaagacatctgattccactaaatcagcgaggagttttcaaaaagcagatggcattttaagccaaaagacagtcctttgaaggatcttgagacatgtaatttatctgaatacatgttgctctcatctgtgatttcctggaggataggaactatgtcagattcatgccttccttccctagctcagtgactggaaagcagaggggctcaataaatgtcttaagagaaaagagaggagaaaattttgtaatgctatttgaaactttatgcaaaatatttgctcaagtatttcacactcagtactttttactttttgcctatatgcatactaaagtacaaataaattattgctgattgtgttgattttgcccattaaatttgcattgtatttattttaaacaagtctatgtttttagacattaagataaaaatgctaccttatagaaaaacaatgaacagtgctgtaaattaaaattagcaccttagaaacaaaactaaatagatttcagggtttgttgttctgaagtaaattctgtgctgcaaattttgaatcctaaaattcagaacataatttttaggctccataaaacatgtttgtggttggctgctttatagtaacatatttttgtatgcatttggcttcatttcttctattattgtgattctcattccacttgttacctagcagttgccttttctactgtttaaaaaattttttaagggggaaatgtgttttgtaactcagaaaaacataatgtaagatttctcaaaatatatgattttaaaacaaggacaataaatgatttcctcttaaaactgacattacttaaattactaacacaataatatctttaaatgtctacatacatgttaaatggattgtaatgtcttttgaaaaatatttacatattttgtttcagagactaagtatactcaatttatctacaatgattcctttgttgacaaatagttacaggcgtgactgatttgatagttcattggaagaagatcttcggtatctttcataaagcttagaattggcctggtatttaaaaaataattcatgttggagtaatttttgtatggttaatccatttaaagacagacaggataattcatttttcactgaatcatctagatagtagaggcctataattgatgatggcaagaataagaatatttaacctttgggtgaaccaaatgaataaaactctttgcaacaattcttatgggtagaaacagtatttttctgactctagtttagtatcttgggcttcttcccaactgtgagcttatggagaaatgattcctctaaggcagaatattacttaggttattgtcctattatttctttcctttccatcaattacttccagtctagcagcttttagcaagattcttgtttgaggttagccatcctgctatataatctggagtctaggaaaagtacatgtcattttacctggatattttactcaatattaaacatttatgttctaagtttgaatatccccctttccacatctaaaaaagaataaatcaaatagtaaaccccattgctataatttgaatgtgtcccccaaagtttgtgtgttgaaaacttgatccccaaagcagtggtgttggaagatggggcctaataaaaggtgtttgggtcatgggggcaccatcctcatgaataggttaatgtccttatcttataagtgggtttgttagcatgagaattggttcatcttctcttgcatactctctcttgccctttctttgcccttctgccatgggatgataatatcaagaaggcctctaccagaagctagcaccttgatattggactttccagcctctagaactgtgagaaatgaactttttaaaattataaattccccagtctctgctattgtgttatagcagcaaaaaaatggactaagatacccatgaaggagaagtgataataaagacaagcttaaagctatctatatttgaagactcttgaaaaactatgaatatgtctccaactactatcaaagatgttagttagaatatagattataaaaaaatcccatacctcaaccattctcactactagaaacacatattactaaaaccctgtggcctgccaattgtaaggtaatcttttaacataagaaactgcattaattttctataaacccaaagacttgcacaattatttcagaagtgtaattctcccaacacacacacacacacacacacacacacacacacacacacacacgtaccacatttcttttcagtagcttgactataacttggaaaaaatgctttagagaaatcacttcaggatggtggaaaaaacaaagaatcataattctccttatgtgtaatcaatagtaacactccatctcatgtataagtttcatatactttcaagtccagctctctggctttgttcatttcattcaacaggactgaaacaaaggtcttggcctcagtttttcacatgaagatgtttgcaaaggaaacagtattttaaagagtatttaattcacagaagctgactataaaaaataactaagaagcttcttttcttccaagacttagtgtttcccttgttaatgagacatttgtcatatagacttgtttactgccttgttcagtttcatagaaaaaaatgatgtacttttagaatttgatatagaaaatattaccagaaaaattataacaaatggcatgtttagaatttatagtctgctgaaatacaatttaggtctttattttactatgaaaatgcaatcaatagccaaaatccaacgtattccagtgattgaagtttatttgaatactgtgaagttgtgaaatacatatttggtcttccctctgtgtctttctataagctaatgagttagctggtgactggcagcccctaggtagcttaaggatgggggctggtcacagaaaaggccaaagaaggcatgattagagggttgagacttttcagccccatcctcaacctctggggagtgtagaggggctgaaggttgagttgatcaacagtggccaataatttaatcaatcatgcgtacctaatgaagcttgtataaaaacctgaaaagactgggttcagggagcttccagatagctgaacacctgaagacgactggagggtacccccctggaaggggcttggaagattggctcctcccatacttattcattccttatccgtatcttttgtaatgtcctataaattgcacccgaggaggaggttgtgggaacctcgatttagagctggtggtcagaagcacaggtaaaataacttgtgctttcaacttacatttgaagccagggggacagtcttgtgggactgaaacctgaacctgtggtatctggcactatctccaggtagaaagtatcagaactgagttagaggacacatagctggtatccactgcagaattgattgcttgcttggtgtggaatgaaaatgcaatgtattggaagcccctctctcccccatatctgatgtcagaagcgttctgtgtgatgtgatgtggtgggtagagaatagaaaacacacacttcagtttttactatatccttccacgtatttactgacagcaggcattcatatggaatgtcaggcactgcaagcgatacacacatccataagacagcatctcttccattaagaatcttaccaactcacaaaagaaaagagatatgaatacatggaaaggtaaatggcaatagagtatttaaataagtaagtagaatttgaatttgtctttgataatggtgaggaggtgaaaggagttcttgaaagtctggaacaaaaatcaaatcaacttatgagtggatagaagatgggtaggtaatgctaaagccagtatagtaacatatgttaagtgtagactctaggtgggttcattgtaaaattatttcagcttttctgtatgtttgaaattttcattaaaaaatgatgaaaaaagacgagcatataaagggagagaagtaaactactttgatgggcatttaatttgatgtaatggaaaataaaatacgaaaggtaagttctaggaataattgtattttattagttctctgcttcatttggtcagaaaactaaaggcatttaatgttagagaataaattacattgtgtatctatcagctaataatagaatttccaactcaaattggcttatgtataaggaaagttattatcgtgcctaacaggaaaaccaaaattaggacagacttcagggctgtttaaatcagttccttgtaaattctctgaggggtgtaagcaccctctctgctgtctataacatcatcttcaatatgaggctagtttctatccactcaaaagatggctgacagcagtcttctctctttccattgcaaaaaaatgactgccttcattttcccagttgccctgagtaaactcctccttgtgtctttctgtcctaaattgatttaaacctgcccagttctgaatcaagctctggtaagagggtgaggaaatacaggctcatgactggcttagactcgtcatggcagggggcagcaacacagtgaccactgcagggtagagaagagacaaagacaccctccatgagcgctgaaggataaagggtgggggaaaggcatttgttcgtaaaaagtgtaaaccaggtacttttaggaaaattttaggggaagaatatgttataaaagagaattatctttatgacagtaacttttttcaatgattataaaggcgatatgtgttaactatcaaaacttcataaaaggcgatcagttataaccttataatcaaggtttatgttgacatttccttcaaacatttattatgtgtgtctgtgtgaataaatatatatgttatatacttgttatgatactgcctatacaattttgtgttccacttgctttccttaccattatatcaccaatatttttaatgtccttgtaatgtatttacaaattttgtttaaatggctgcatatctttccattacagaaaagtacttcatttgggtaaatattcttatacgatacaatatttaaaataaatcaatttctgctttgttattaacactggtataaatatctttataataaaacattgtctgaatctctgattatttccttagaaaagattttcaattagtatatcattaagccaaactgtatgaatagttttaatctcaatacatattgtcaaattaagcttgtcacattttatacttataattgagtgatgattccatggtttctaagtattactgttattatcattactattatttagcaactcccttttggcaggaacaatatgctttctcacttttcagctccaaggaggtctgtaggagatatagctacaaatatgttttctgtcacttttgttcttcattaccatcttgctgcatttcttccttcttctttggcattcttacatttaaaaagtagagatggggacatgtctctgttatttcttcttttatttatttctaaatctatttcttgttatttcttgatctaatatccatacaggtttaggatgtaagcatttaaactttcatacgtagaactccacatagcaatgaaggaagaaatcaaagagtaaatgaatgaattagtgaatgaatgcaatgaatgagaatgcaatatctggtagttcagaatgaaattttccttatcaagtccataaaatttgcaaattacttcataaaagtgctttataggttttggcattttaacaatgtttacagtgttttagaagagacaaaagatttcagtcttgtggcagttagccagaatagggagcaaatgtgcatgtaattgcactattaagttattaagggtggtaagaaatttacacaaaacagaccctgaattgttttaaattctgttagttgaaaggttaacaaaggagaaattatattctttaactcctttttttgtttgtttgtttttaattcacctttattttccacttggccacattattttcttgttaaataaagaagagttatgaattttcttaatgagttaataatgtaagctgaatgtccacaggtaaagggtcttatgtttcaagttcatgacattaggcgacaaaaatcagtatatccaagtatgaatgagtagggaaaaaaagttatttcatttctggaaccatatttttagttccaggatgtaacactgtaggagataatatatgtgaaagcgtcttgaaattgtaaagcactatctaaatgtaaaggattagtattagtagtgtggtaaatcatttttctgaaggttggtttggaccatttatattttcaaagtagatgaatagaagaaaaatatgttttactccaagaatggctgatttcctcctctagagtagttgtagcacttttcctggtttgatttgattaatccttatgccttcctggtgaggaagattggaggctcacgttgcatttttatggatcttgcctacattaagtttcagatatatagatgccatttcttaccagtgcagctgactcgtctgtcttttaattatttcttttatcactgaatttcagatggacacactagagggaccatagcagggagcccactgcagcggcagcagttgctgcagcgtttggaagtgttgatatggcttctggaggtttttcctgatgctttgagctgggctgggggagggggaggcattctcagaaagctcacaggactcaatgcggggaaagggccactggaaaaggagctacccaagccattactcttcagctttcactgagtgtttatatgccttggttttatttcagaaaactaattatggaacattccagcattcttcataaaaagtgagcttggggagtttatcgggtcctggggagtcataagaaaaggatcaatccaagaggtggagcagaaaacaatcaggggacttggagtttgccagctggaaaaaaagttaaaagcggccaaagagccctggaagataatagaagctatattcagattcccaagttgtattctgagtttttgctccttggaatatccatagtcctccatttcagtttccaaagtaccccttctcctaagaactcaagaggctacccaatttttctcacaatgtccatacagagaagggggatgaaaggccaggtattgttatttcaatgtcaggcacacacagaaactcaggcataggaaagtaaactgctcaggatgacaaagtgttgttaggtgatataggcttcaattttattttttactcttcaaaaacttttatttggtcaagtgatatttgagagagatataaaaaaaatcttctttataaaaatgtcagtgccttccaggccatgtgtattcttccctgttttaggaattatcaggaactattgggaacaactgaggcctcttggtcactagttacatacctcctttgaacaatctcttccttcactttctttttttttttttctgcaatcttcgactcctgggttcaagcgattctcctgtctcagcctctcgagtagctgggactacaggccctgccactatgcccagctaatttttatatttttagtagagtcaggattttgtcatattggtcaggctggtcacagactcctgacctcaggtgatccacctggcttagcctcccaaaatgctgggattataggcatgagccaccatgcctggcctcttccttcactttcttacagtgaggcctggctgtctccaaaggatttgctctccctgcagccttctcatccagttctgttcatttttcctgtacaccatgcaccatgggtcctagatgaaagaaagatgacctccttgttcataaaaatcatttgcagactatttttccttctcttctagaaagaaaaaaagaatcaacttctttgaaatgtatgtttacttgtatgtcctcagattatcccatctagagttaacattttttctcctggttgcttcctctcagttacagggaattttagcattttttcccccatgactactttcttaattcttggtggctccagcaaagaatggaaggttcttggctggtccatccatcacctaagccccccagttccttgactttctctccttcacttctcttctggtctacccatcctcactcactccctgcacagtcatactctttttgatcttgccattgcaataattgcaccagctccataatgttagttttgagcatcccgttctttgactactacttcttatctttgcagctccttccctgaatccaagaagccattaatcccacacacatctccacacttgagcctactatattccaccattcatcctccccttaacattcacacctccctggcatggagttcacaagccactgtgatgatctctccagaacacacaccctcaactcccttgactccctcaaagtcacctagaaaaaactcaccaccagttaagtcctcctttctgcctgctctccacctatttccaggcagttgaacatgactggggaaaagctcacaaccacactctggtctcaagtgggtcctcagcctcctagaaagtctcttcacattccctcagttaagccagtccctcatcactaagaaaaccacttcctcagtcattaacatcattagcatcaactccaatctacttgttttcaactttccccagagaaaatagaagctatcaccagagaactttgtcttcaaactactaaatctaccaacctgcctgcttctttatcccatacacttaccctggatccctggccctcactcacttgatgtttgcttctgccttagccatattttttcttttctcttgactctaatgccttccatcttcaaaacagaacagccaaataaataaataaataaataaataaataaataaataaataaataacatcctctctcctgtgtcccctcttcagctactcttccaggcttttagagcagaactcctcaaaagacatgtctttgtgatctctccacttcctcacaaccattgtctctcaaactcacaagtctactgcaaaacacacttgttaaagtcaatgttaaagtcagcgatgagttccctcttaccaaatacactggtcagtttcctgatcagtatatgtatcttaatatgcactgccgcagcatctgacataatggtcacatcttcctttccgaaacaccttgttcctttgcccttggacatccttcactcttattttctcttactttattagctccttcctcctactctctttttctggttccttttgaacactggagttttccagggctcagttcttggaccctttttcttctgtatcttcgcttaatgtctttaagtgacattaaccaggtctgttccactttatggtttatttgctgaggaattcagctcctaccttttccctgtgttccagactcattcatgcacttgtctgtttagtgtttttgcctggaaatctaataggcatcataagcataacatgttcgaaaagaactatgagtgtccaaaattcaccattccccattctcttcttaaaaattagtatcctctttaacttagttgctcaaagcctaaaaccttagctttatgctttacttttctccctctgtctcttcctctgtatctcttctttctcgccttttctccctctctcttgctgtcttattctccacatccactccacgagtaaatcttgcttactctaccttcaaatatatcactttaaaattatttattgtttatctactccactagaacataagctcccagaggccaggagctttttgtcttatttgctactgtttcttcaagcatttagaatgagaattggcagactatgacccatcagccaaatccaggctttcactgaatggtttttacatctttacatggttaaaacattaaaaaataaaataaaattttgtaataaaaaaattaaatgaaattcaaatttcagtatccagaaataaagttttattggaacacagccatgctcatttgtttacatgttgtctatagctattttgtcattacaacaactgagttgagtagttctgacagagatttttatgggatgcaaagctgaaaatattcacaatctggcactttgtagaaaaaagcttggcagtttctaccgtggattaacattccttcacagaagctgaagcttaaatttattttttctgctagttccaataatgaattcagaactcagtcttgtatccatgaaccacatggctattcttgaaccaacccctgatgaagtgttagaccacagttaattgtataaatctgggtccatgcccatctctaaagctggggaatggagaaggattaacactctctatatcatatgggcttaatatggaagagaggcagtttcccaagggaagttgacacgctataaccaagaggggtgagtagagaccacccctctgataggaaaaacaaaacacttgttttctacatggaccttcctgctattttttaaaaaatggcacattccaaaactcttaatcctatcaggaattaaaattttttgttactaagttatacatacttagtttactagaatgtaatacttggtaccttaaaccatctgtatcttggataggatctttgttttcttaaatccatggactccaaacatatataactattactttttgaagctaattgtgctggaatgggacatagtccaggaggtatgaaaatggatgtcatgcctgggaggcgtggaccaatttatagatgtcctaggcaggagccaggctactggtaccacatgtacactcagcttcttggcaatgacagaatgagatctctgcatgttgtacctcattccagctctctttcctcattgtgagaattaaggaccacccagccagagtgggaggttatctgctacaagtccttactaatttatcagacaaaccaattcaaggtatcagaattcatggagaagaggagaggacagatttctgactaaaccgtgtgtctgaatctccccctcaataaagggaagccattggagatcattaagaaacaaacaaaaacttttatatggtcagattgtgttttagcaagcttattggcggtagtttggaggctgtgtcatagaggaaaaagataatatagaatggattgtggccattggtaattctcctaactcaataacttcttagtctcgtattcttgaagtcatggagaaatccttgagtcagtgaaatgttcctttatcacaatgtcacactgcaagaggtttttttttttttttttttttttcctaagctgaagatagaactgttttggaaatcatagaaacatatttgcaacatgcaagatgttatttctgcattgatcattttaattcaagaaattagtttgggaattagacttcaatagtcttgtgattcacccttttgaaattaatgaagatttacaattttgagttcctctttgctagcattttcccctttgaatagcaatgctttgttcataattgtgacatttcttttctgttcgcattctctcactgagaattctctttgatagggtggattttctgcaatagaaataacatttttgtgcaactaaaaaaaagccaaatgccaaagggtaaaaaataagtttttgtggttataagattgttaaatgtagatgtaaaattatgttatttctgatgtcccatccaattgtggcataagcctgaagtttcgttcaccctgagatctcttattatcagccttttctggggtgaggtctagctcacacagaatccccagtgtaagggctgtgatgttattttaaacatttcattaatttaaaactgtcatttaacaatggcctctagttctaccaatggacttccttgtgggtttctgacaaaggtcgtggtctgtggtccctctccacacctaattgtgatgaccttctgagaataatgactgctgcttcacatctaccttcccagctttgtgaatctctggggttggccagctgtcacttagaatcatacaaggaaagggattctgcaagatgtaggcccagcttaaccaagcagacacacaccctattttcttctttcactaaaaccaatcattccctattttattctttaaacaaaggactactcgacaatgctattaattttcagcataattaattacgcctaaaagtaaattatactcttcctttaggggttgcttatttgtcacaacttgcccctggcaagtctgcatcttgtcaactagcagtttgtactcttgtcttctttttctcttgcctttaaataggaactataatcagtttattttccctccacatcaacaataattttttttttttacttaattttcttagaaaattctaggctggcatgtaaaatgtaatggttggtattagagcaaagcatgtagcacaatgaaacgccatctttaataaaggcatatgtgcctttattaaaggtttctccaaggtttctgttacaggaaatcatacatcatgggtggctagaggagaggcatcactgtctatgggagtcattggagcagaaacagatttatttcatattcttcctttgactattcaaacatagaccaccagatttatgaaatcctatgttctgtatctctgtatcttcctttcccctgatgtcatttatttgaaccacagcacaaaatgagattgagtaggcaaaggccattaaattcaatgtcattataggaggtgcaaggggaagcttggattcttatgagcacattctccacaagtagaaaccttaagaagcaacactaggttttttttttttgttttttttttttaatgaagttttgctctttttgcccatcctggagtgcagtggcgcgatctggactcactgcaacctctgcctcccgggttcaagtgattctcctgcctcagcttcccaagtagctggaattaacaggtgtgcatcaccattcccggctaaatttttgtatttttaatagagatggggtttcaccatattggccatgctggtctcgaagtcctgacctcatgtgatctgcccacctcagcatcccaaagtgctgggattacagacgtgagccaccacacccggccaactagtttttcttaccatctctcttgcttttcctcttcaccatgagatcaccatagccatgtggagcagagtcttggctgacccatggccaccaacatacaacatgagtgagaaagaagtcaaggctatttttattttgtaagccactgaaatgtggagtctgttatcacagtaaaagctaattaatatggaagttagaaataaattgcaccaaactgctaacagtgactctttctgtcatgttgaggagattagaggttactatgatttttcttactttgtttgtattttccctgttactgtattatgaataattttagatgtggaaaaaagttatttttttcttttaagcatacattcagttcttccttggcaacagacatttgaaatgtaattaaatttggactattcttgaacaaaggtgtttgccatactcagggcaaacttgtaatgctgcattaaaacatatatgtccttcaaattgacctacagattcaatgcaatacttttcaaaatcctgctggctttggagaaattaataagctaatcctaaaattcatatggaaactcaggggacctagaatagcttaaaacaatcttgagaaagaagaacaaagttgtaggactcacacttcctgatctcaaagttacagtaatcaagatactgtggtactaatatagaatcaaaatataaatcaatagaatataactgagactccctgagtaaatcctcacataatggtccattgtttttcaacaagaatgccaaaacaattcagtagaggaaagaatgctgctagaatgactgggtatcctcaaggaaaagaatgaagttggaccctctatctcacatcatatataaaaattaacacaaaatgaattcaagacctaaatgtaagagccaaaactgtaaaactggattagaagagaatttagggatgcattttcatgaccttggtttaaggcaatagtttcttggatatgaaacaacaagcacaagcaagaaaagaaaaaacatagataaattgaacttcatcaaaattaaaaacttttgtgcttcaaaggacacaagaaaatgaagagctggcccacagaaggagagaaaatatttgaaaatgatatgtatgataagggtctcatacctagcatacataaagaacttttacaagtcaataatagaaagacaaagagctcagtttaatcatgagggggacatggatggtaggatgtaagtatatacaaggggaaactgacatgtctttaggaagttagatatctattaaaaggactagcataatacttgtatatcccttgtttggaaatgtgatattcttattgattcctttggtctacactgatcaccacttttcaatatattagaatattgcaaaaatcacaccactaacatgattcaaaacaaactcctatgtattgagtcgataatatattcaaagcattatattggaccttgcagaatttaaagatgaataacacacacacacacaacacacacacacacacacacacacacacacacacacacagattttttcttgaagtaatgtttagttcacagaatccattcctcaggccacccatatcaacactgcttgaaacttaacaagtacattctcaggacccacccacccaccaaccagatctactgaattagaacctcgctctggtgaggtggggttgagggagtcccagcaatacacgtcccacatcttgttaagtcctccaggtgattctgatgcatgttaacatctgagaaccactgggttaagagatgaagaattaaaaaaattattcaagctcatatactacaagacagaatacagtaaatggcctaaaataggtacaaagtattgcatttcgtggctaacttgcaaattgtaactagtttaaaaaatgatttgttattgaatacacactatgtatgttatcttttgctaagttttatgaaaagcattttgttttgaataaaatttcttcccatctctagaatagagccgtgattatgaactaagtagggaagaaggaggaatatcagaatcaactaagggtctttatcagattacctgagtctccctctactctggccccaatcccctgttgaaaaccacagttctagatggtcacaatggagaatcttaaatattcagaatgttactttgatcagattatttttggataccagctaatccagtgatcatcattttgattctttattttacctaccctttagtctgttcactaacatttgattgctgctctgagtctttaatttaaaacaaacacatgaagtatcttgtagggcttatggaagaggtgaaatcagagtgaagtgacagtcaagttttccttctaactgtgacacacactagtataacgttgtacaggccacttaacatttctgatgaggcttaatttcattatctctaatattagttcaagatcccccgcttactttacaggatattgagaggactaaaggagataatatttgtgaggttatatagcacatattaggccctttaagattagcaatgatggtccttccatatttttctagagatgtccttctcctgaattcctgacctatcagtggatatccatgatgtagaaaatacttccaaaacatttttactctttgataccataattgtagggaaaatctatttaattatctataccaatacctatcatctatttatgtatctttattatctctcttatttatctttctatttctctatcaattatctatcagttaaatggaagcagacacttttatattgagaatgtatagctatcgggactctattcaattaacagaattaaattgatattgacaggcttaaagacaattcaaataactaaggaaatattgacaaaaaagaatgactaaggagagggaaaaatttgccttaccaaatattaaaacttctttcaaagctactataatctaaataccatggtattagcacactagtacacacatcagtggaacaaaatacagaattcaggcatagacccaagtttgcatggaaatataatatataatgaaagacatttcaattaactgcaattaactgtggtaagaatgttttatttaataaatggagctgacagaataaactatccatttggaaggagagcagagctatgtcttgcctcatatcagagatggattaaatacctaaattgtaatggattaaatatttaaatgtaaaacataaaagtaaaacttggactgtttgtttaactttgcggtaggagaggacttattaagaaagacattgattaaaaaggtgcgatacatatttgactgtttaaaaattaaaatttttcatggcaaatgtcaatataaacaaaattaaaagacaaatatgagtgggaaaaatatgttaccaatttgaaagaattagtctgtaatatagaaaaagttctcacaaatttgtaaagacaatgagcaaggatatcttttctaggtaatatacagaagaaaaaaattttaaatggtcaataaacatataaagatatgtttaacctttctagtaaagcaaattcaaataaaaacaataatgaaattgtgttcttcattcataaattgggaaaaaattaaaatattgatttttttcacatgccaggtaacatgtagggaaatgatcattgtcatgcatttttaaagggaaagtgaattgttttaaaacattgcaaattaatcagataatagtaaaataaaataatgccagtgctcatttgcataacactcacactttggagaatttatcctacaaaaatcagtttgcaatatatgaggatcaaaatgcaagagtgcctcttttggcatcatatataatggcaataacctggaaacaatctgagtgtcttttggtaagagaatggctgaatcaaatatgggacatccatcctatggattatgattaagctgtccaaagcaatgaaatagatcagcatctgctgacttgaaagaataaccattaaaacatatatactatattttatatatatatatatatatatatatatatatatatatatatatatatatatataatattttgtgtgtgtgtgtgtgttgctttaaagtcaggcaaagctactgagaaatgtgaggttatttcataattgtgaaaaaattaactgctggatatgtgtatagatgtatctgtgaatcgatgaataaggaagaaaaagtgagaggatacaaataaggaaatgaacatcacttatacatttacatggggacttgactggaagagagttgctggggatgatgaattttttgattagacatctttgatttgtttcacatgtcataaatatataataactctaacttaaaaatataataaagacaggactcaggttaggtgtaatcttctatgtatgtgcacagtacaggtctggaagggccatgccaaattgccaattttagaacctcttaggaggagagtggtattaggaaaagagggtaaaagagagtaagctttttcttgtacatatttctgtatttattaatgactgttattttacaatgagtacctattcaggtattgctcatgtgatttaaaaataaataattgttttcacccaagctttaaatagttgtttacacccaagcagtagagtaggacagttttttttctcccttcagtagacaacagttattggcacaaacattagcaagcataatggttgtaatttggttgaagaagataatcatgtattagcttaagtaaaatgcaatgccttgcaaagatctgtcattctatgaaagtattgacttagagtagtcccaactaggaaatacaaggcgtaatccacagattcttgtgcaattcagctgtattatctcttatagctcctataaaccttaacactaattaaggatctttaagaggtttttaactagagggatgggagaaagggtgtctttatccccacttaggcagaagaaatgttttaaagtggaaaatgagcaattgatggttgccttgccaagtataattaagaaaattcagcagcactgattgtaccaagttctggaagtaaaatctgccagaggctgagatttggcctttatgtaatactaatactgtaaactcaacatgtcaactcttttatctgattttaattcttggaataagctataatctctcacgtatagcataatgtattttatgcccatggcccaaagcaaaaggtctccttttgcttccctccctcctacattatctgggaacttggtgtcaactcctttacgctctgtacctccctttgcccttgagtcctgctgccacactgaaggcctgccttcttctcagctgttcactaacttcttttactgcacagtttgctggttgtgatttcttatttttttcaagaggattgagagacttagaaaagcttctaggacccagagaaggaagctgtagtggctaaacttcacagacatcatgactggcaagaagtatctggctcataggaagttcttgccttcagggatataggagttttcttgcaaatgtaaaccctgaatagtttgaaaaattatgtagccatatgaaacaagagcataagccatgtgtgatagggctacgtaggatcagctttcagaggagtagtttagatcagtgtgtgctgagatgtttgagagagaataaaaatcacacaggatttggtctgttgcactgctggagaaaattaggagatgatatttatgtataaattctcaaagatatatgttgacctgctacagcagtaatatatgctaggacatataatatcactttggatagataaatgtacatatatatatatatgtgagggcaggaatgaattgttcaatggtattggtgataggtttagggttaagaatgctaattaacttatttttaccatacactggatgcaactatctctttcttccatggcactacactcttgtttgatataatttatctttcccaaagatggtgatcattttctttgatattcagcccaatgcactgaaatattgtttgcccagagcctatgttttcttctaccttcctcactgcttacaagaacaaaaggtacactacaaatctaatttcatgcaattggcctatttatgagccacataaatgtggcacaaacacatttaccgagaactataattttaagaattaagtccctctgggggaagaagaagagaggtagaattatatgcatgaatggggctgaaagagctgttcaaagtttggtgatgagtgggcaaactcaggagagctgagtacccttggtaagttaaaaaagtaagtcagtattcaagagactaggaagaacatgaaagaagcccatgcaggagaataagcagtgagataaactgagttttggagacacagaaatgtccttggaacccaggaatacaaagcctggtgaagtggacggagattctagggatactttctgtgccccatccataccctttcagatattatcattgtcatataagtggctgacttccccctgccatcatgttcattacttggcctaagggctttctctaatcaatggagtccacctagacctagcataatgaagaaatagagaaaatacaagtattgaccttccctccccacccacctccccaactatagcatccttcaaccaaggatgaggtgtaaatgcctcaacttcctccttgggtgagataacactggatcctagcaatccgaattgcaattaatctgcagttatctacagtactaacacctagtaacacattcaacattgacttatcttcctttccccactttaccattgcctctctggtatggtctgggatcccctccccaaaaacctagctacataaatctagatttgttccaaatcttactttgggggaatccaaactaagatggggatatgtatacaaaaaggttagggaaggacttaaaaaataaaaccaaacaaaaaaaaaatgaaaaataaaagtttttatgtgatccaactaggacagttaagataaatgaatgaaaatattttttttttcctttaactaaaactgtttaaaaaagagtttaggaaacattgttatttaccgattttctggattagtgttttgtgaaggaaagggaaacatcatgggcacttttttaaagtaagcttctgcaaactgtaatgctttaaaccaaaccgcatgttaactggaataatgggaacccacgtcactaagagacccattgcctggttctctgtggtttcttaccacagtagttgtttttgaaaataggtggtctttttcaaagagcacttatgttatgtgttgaaataatgaaaaagcttctgaaacacaatatgcattttttaatctagtaataaagaaagtaatgtggctgaataatgcctggctagattagttttgacactgtatttgctttgtgttcaactttatctggcaatgcattattcactagtactatacacagtgctttattaagtcttaatcaaatgcattttatcataagtgtcaattcagtgctttgccattgtatttatatgtttttaaatactgagttctttgtaagtgaacgacaaatacttaggctggaaaataagattgtatttctggtgcttgggaatgaggtcattgtgtatgcacagagtggctttacattcacactaaagtcatttggaaacagattatattgccgtttcttttttctcctaataaaatgaaatgtaattttcttcaccaatgtgaaagctaagctggtttgaccaattgtggccatttaaataggtttgtagagcaaatagatataaattaaaacttttgctagtagatttttatttaatagattttggactaaattttcaaatgtgggttaacaataaaaatttatgcacaaactgacaagtgattacaggtacacacattttcaaatataattaataatatgtttaagtataataaaactataataaatttttataaagtattcattaaataattttattataattaaatattttcattataattaaaatttatatatttataacattttaaaataatttataattataacaaaatgttataaatacaagctggccttggaaagcttcttaggttttttttattttctaggaaggaaatgcttacaaaatatactattaagttaagatcttagacttactcttctgataatattggaaaacttcagtttaaaaagtattgtacaaatccaacttcaagtttcttgatatttcttttatcaaaacagcagctatagatttgtaaaagttctagtatttggagaaaaaatataaatattataaccctacaacattagtttggagaaatctgtttattccacaggtaaatgtatctgtaagactaacaaaattcataatttttgatttaaaaaatcagcacataaaaataattgcagggctttaaatgagcacagcattaagttgggctgctgtctctctccgaataagtgctaagtgaagcaggaatgttttaatggcatgaggccctacacaccaaaatggcattagcctctgagtaaatatcactagttggatagagttttattctacaaagtaaatacttaggaaattaaatattaattagtacttacatgtgcaatactaagaataaagtagaatcttctttaccctaaaacaatatcccaccatgccacataaatgacactgaagtgattatttgtaaaaacaaaagcgaaataaaattatgataatctccccaaattatctccccaccaaagattattgattttatttatttatgattttattttagaaaatcgtggtttgtataaaagggtcccaggtatatctggatgttttgataggagtttagggaatcctagaggcttccacgcagaatggattccatgaccatttttccatgaaaccatttgaaaccactaatgattggtgggccggggtccttttccattgtccttttgtgatatcttgcactttttcatttttattttttcttctttctcatttctttgctccaatgtttaaatattcctgccttgttagcgtgtttcattttcttggcctatgaactgctctactcataggtaaagcttggtccgttgtgaaaaggcctcagtaactttttaggtttgttctgatggattaataaatatgtttaagcttttgagattagtatttatttatttaaaaaagctacctcactaattttgaggaacactgaattaaattcaaagttttctttattatgaaaattctcagaacctttaatattcattctaatattcattctgatgacatatacttctaagagagggatataggatacaattatttctgcatcttatttgcccacagaaccccttttgtgtgggtagagggagcaatggaaaacttttatagtacttagtctgtgtcagacactgttctaagtgctttaccttatgaggagaaaaggaaaaaacttttttacagatgcagaaattgtgtcgagggaagctcagtgccttgccctctgtcaacagccaccaagggatagagccagcttatcacctgggcttctttaggattgtccattgaagggttggtcaaacatggttgtctggtccaatctttctgttgaccatttagttagtgagtatcgtatatgtcaaaatgaattcacattaattcttgatgcagacacagccataacaaataaatcacttcctttagactttaactttcagctgaagtgtcagttagatatatgttggctttgattcctcttatttgccttctatgtccaaataactttaatgaatacaaagctttatcagataataatactttgatgtacttatttgctcactttgcataatttgtaatatagaaaaaaaatcttcacatgctattttttcttacaaagtaataaaccagctgtatttatgaaccacctattatgagcatgcatttccagcagcagtctctcagtaaaagactcaatcaagttagaaaaaaatgtattagtagaggaataaggttttccttaaaattatttttatacttaaatatgtcaagcctgtagtctgtgtccaaatatttaaagttaagtattacccatttaaaaaacaaatttgactcttgtatacttaaaataaattcaaccacataactattttattttgaagtttttatttgtttgtttttggtttttttgttttgtttttcctttctattaagttaggacaagaaacaaaagcctcccatcaaaagataaggtgaaagcctcccatccacgtttcatgcttgttctccctgtgtattttaaaatctttttctttgtttcttaaaactaaaacaaaataaaaaacacaggaacattattgagatgctatttagtaatattaagaatgtccctgtgtgtaaggttattgatactggcatttgtgaaattaacatagggacatcaatgagagatctataacaggaaagattataggcctgggagggagagatctgggtcaagttttagcttcttccctgagtttgtgtgtgaccctgagcaagtcactaaggtctctgggtcacactttcttcaaagacctgtacagtgagaccatgggagtcaatcattgttatatcttttcactgtggtctcctcttctttttttttttttttttttttttttttttttagacagagtctcgctctgtcgtccaggctggagtgcagtgatgtgatctcggctcactgcaagctccgcctcccaggttcacgccattctcctgcctcagcctccccagtagctgggattacaggcgcccgccaccacacccggcaattttttgtatttttagtagagatggggtttcaccgtgttagctaggatggtctcaacctccagacctcgtgatccacccacttcggcctcccaaagtgctgggattacaggtgtgagccaccacgcccggcctgctgtggtctctaatgagccagtttaatgtttcttgaaccaacctttgctgtttaacacttgcttatcatgtttttaacagggatttctgacctctttgtagaagatttatagttttttgttttgttttgtgttttttgttttgttttgttttgttttttgagacagggtcttgctctgtagcccaggctggagtgcagtggcacaatctcggctcactgcaagctccgcctcccgggttcacgccattctcctgcctcagcctcccgagtagctgggactacaggcatctgccaccacgcctggctaattttttgtatttttagtagagatggggttttgccgtgttagccgggatggtctcgatctcctgacctcgtgatccacccaccttggcctcccgaagtgctgggattacaggcgtgagccaccgtgcccagccagaaaggttcttcagttctttatgtttgaataacaccatgttgtttgtgtgtgtgtgtgtgtgtgtgtgtgtgtgtctgcaagagaaagcaaaagagagattaaaatagatttagaaaacaatcagaattgtgagaatatagaagggattcactaaaagaatttctaatatcactaaaatcctcagctgatgtatcaatgagtctgtgattagctaacaaaagagtgtttttccccccaggtggacaatttggactttatgcaggtgtgcagtagtagaaccgtgaaggtagatacaattaaagttctgagaaatgaaaagacactaggccacgaataatggagcttgccagtagcagcagctagtagatccctttctccacggggccaaagagtttgatttgatttccagctctcaactcctactcaaggtgcaatcatcagtcccctgcagggtactctaggattctggagacattaagaagcacagaacgtggctgcatccctttttccgaatgggctttggtgcaagcagttcgtaagtggctagtaagaatttattgttcatgtatgttttttctcttgggagtctgtaattattttaaaatattagccataaatcccatgctaatatatatataaatatatataaatacgtatttatatatataaatatatataatatatgttttttgtttgttcctttttttgagacagagtcttgctcactctgtcgcccaggctggagtacagtggcgtgatcttggctcagtgcagcctccgcctgccaggttcaagcaattctcctgtctcagccttctgagtagctgagactatagatgtgcaccactgtgcccagctaatttttatatttttagtagaaacaagctttcaccatgttgaccaggctggtctggagctcctgacgtcaagtaatccgcctgcctcggcctcccaaagtgctgggattataggcgtgagccactatgctaatttttttttttttttttttttgagttggagtctcactctgttgcccaggctagagtgcagtggcgtgatcttggctcactgaaacctccatctcctgggttcaagcaattatcttacctcagcctcccaagtagagggaattacaggtgctcgccaccacgcccagttaatttttgcatttttagtaaagacagggtttcaccacattggccaggctcgtctcgaactcctgacctcaggtgatctgcccgcctcggcctcccaaagtgcttggattacaggcatgaaccactgtgcccggtgctaatttttaaaagtattaatttgcttttgcgagactcaattgtatgccaaaaattacctcaatatttgacttggagactgtagaccaaacttgcatcattatggaaaaacaatatgcaaaatttggccttggcattgcccaaagtgtggtattttgcattgtactatttgtttctgtatgtcatggagtatgtatagtaataggaaatgatgagtatctttgcacaaaatgtaatgcttttactaacatctgtcagctattttgtgagaatattgccaaaatataacatttatcttggtgtatagttcaattttgcttttgtgagtgtttcttctattttattgccactaatatagcataacagatgtctttcagatgtgaaaaatcaattatttttcaatatacctcagtagttattagggcagattaatgtaaagtaccgtaagagtaatgtccaaataaaatgtcataagtgaacaatacaattcaatggagaaataggattgagttgatcttggtacctttgtggaaaacagggagaaaaaaatgaacaagtacaacaaaaatatgcaaggccatgctttgttgaaagatcaagtagatgctttagtgatagtattttcagtggaatggtcagctgccatggaaagttagggcaaggccaaaactgtttatgcttcatttctatcgacaaacacgtagctggtttctaatgaagatcaataaaaggtaatcttgggaatgggtatttcagtatccagaagtctttgcaggagaatatgaattatgaaatttatgaaagcctgagtgttaccttttggatgctggtgtttggcaagttcataacaatctttatgttacttatcacaaatgttatttgttttctaaaattttgaatttcaaggcctcaacacacttgagagagagctgccaaataaacttaaacactgttctacagcagaaccagtatgcccctggcacctaggtttagaggggcctggatctggtttcatggcacgagatgcatgcagtcacacagagccccatgcttagaagggaccaatattaaatgcttgatttgatgctctgctcctaccattctgaaattattaatttttgaacaaagggtctcacattttcatttcatagcaggtctcacagattatgcagtgagtcctgagggaagccatgaaaggatagggctctgtgatgattccaacctttctcacctgaatttgggtggcggctctgtagctgctctcctcataacagtgttcctttatttctgtatcccttactctgcctacattttcattctgatatggaggacagaccctctgggatgctaagttctctgaaaggcctgaagtgtcctccatgcttgacttcaggcacacgtaatgcctttgttggacatttatgccatgactcaccttcttgcatagttattcactcctccagctctaacactatgcgaggcatcatgcttagtgccgtgaatagagtggtgaataagatttagtccttgctatcctaagattatactttagaaggatagacaaccaagccaatggtcaaataaaagaagttatgatggtggtagaacagggctcacaggaacatgaaggaggagcacctaaggtggtgatatctaaatagagatctaaggtctaactgcaggtagatgtttcccctttggggggaaatcagagagtgttctagagagggaacagcatgagccaaagctcagaagtgaaaagctgccatcttcaggataattttctccgtagaaaattgcactactagttacattcagagtaggtactagccagagattcattttagagacttacaagtttgccagcagtaagcctatgaattagttaatggttttggctgagaggccaccacagaatatcctgcctgtactttaaccagatttttaatcacaaagttcatgtaatacatgtctgaactggaacatggacatccatggacacattgaaaatttcagtttagtgcttagaagccccaaacattgttgactggaggaaaaaatgttatattagttaacaaaggtatatactgctatggaatgaatattcgtgtgtcctcagcattcatatattgaagccctaaccactaaagtggtggtatttcaagttggagcctttgggaggtaataggtttagctgaggttgtgaggatggggccccatgatgggattagtgcccttagaagaagtgcccttataagaagagtaaaacaagaaaaaaatctctctctccacacacctgcaacaaggagaggccatgtgagttcacagtgagaagctgactgtctataagtcaggaagacagtccttgccaagaaccaaatctgacagcaatttgatcttggatccctcagcctccaggactgtgagaaataaatgtctgttggttgagctacccagtttatggtgtttggttatagcagcctgagccgactgagacaataatcggtactgagaagtaggctgatgctgtaaacaaacacctaaaaatatggaagtgactttggaaggggtgatggacacaggcgggaaaagttttgagatccattctagaaaaagctgagcttgccttgaatgttaaagcctactgtggtgagaaattagaaagaagataggagaggtacagagaaaacttccttctttgcagaatacataaataatcactaacagaatgttgatagaaatatggatggtaaaggcaattctggtgaggtctcagatggaaatgagaaacatgttgttggaaactggaggagggatggtaggattgaaaaaaaaaattcaaaagaaaaagaaaaaaaaagaaatgggaggaaagtaacccttgttataaaattacaaagaacttggctgaattctgtttgtgctcttgtgttttgtgacaggtagaacttgcaagtgatgacatttggatatttatttatttttctttctctctttctttttttaaatagagacagggtctcgccatgttgcccaggttggtcttgaactcctggattcaagcaatcctcctgccttggcctcccaaaatgctgggatctgtagcagactatagatagttcccaactgatgatggttcacctgattttttttctttatgatagatttgttgaggtattaaatgcatttttgacttatgatatttttgacttatgatgaatttgttgaggcacaagcctgttgtaagttgaggagcacttaaaatacatatcagtatctaatagtgtcccaagagtttgaaggattcttttgtagggggacccaaaactttatcttggctacaaattatacaagaaactggactcccgtacaactgaagtccctgtacagttgagcacctcaaataggccaagtaccacagctggccaacacagaataccacataagcagaaagttatctctgtagctaaaattcttcatctaacaaatggctttccaagagttcatttgaaggagaagacagaagtaagtagttggctaggtttttttgtgcctttgtagttggataagcattagaagtattaaagcctaagcctttcaaagagttgatctgcctggaaccttctgcagatcagagctctgtgaaagcaaatgctgactcattagctgggatggtgtgaattccagaattattgctaacaaatctatttccacttaaaatataaaaaagaaagccatgaaatgagaactgactttcccttaggcctctaacagtgctgtttggttacatattttgagaggcagaaaatgagtgaagaaaaagagccaccaagaaagattctctgcaggtgaacaggaaaaaaagtaacttattaccttgcttggtccatagcaggtttttcatttccctttaaaatgtgagaatttgatgactaagatactgctattactgttttcactgtaaatgagttgatggaaagagcatgttgcctgatagtaatctttcatgtgtatgtacaggtacagtaagttgataaaaataactgcattaaaaaggtatttagaaagttctggcagagatagtaaaatggatatatccaattttttgtgctctatttttgtacctgatgtagtcttcatccatggagactgagccctttttgttttcttggaaataaggcattttatctattgaaatgattcaatttcctatcagtctagactgtgatcttacacagtttagtttagttcatctgcagatccttctatttttgatttatttgaatccatgaaagttaacatgccattgtagaatgccagactactttcctctcccttttacatgtgatagactataaaaattatagcttaggttgattattgcttactgggcagtccagcacagataacccaggtgttggttcaaaaaaaaaaaaaagcattctggagtaattgacagcactaaacattttgcttttcagtgaaatttaagagttggtggttggaagctattcatatacacagcatcagcaggaaatccccaactctggatttttaagcatgaggctatttttattttttcattcctatttaagactatttcagaatacgaattatagactcctggttctcactttggagtaatttataatcttagaagattataaatatatagattttctaaaaggtctatccaacattgtattatttaaagtattgattatttaatatgaggtttattagtctttggttttttccctgctaaaattatttcatttatttattcgctttctcccttaagcaacttgtgtttattaactgctgaatctactagaatgtcttcctataagtattaagagtcctagtaaaaataacaacaaaattcataaacatgcacaaaatgctcaaatcataaggtaaagcacaaacaaaataagttaagccacagaaaggcagaagatatttgcaatgcatggacaggtgttaatattcagaatacataaagaacaaactaagaattaattaaaaaattaaacaatagataaaattgataaatacagacaggcaaataaaaaatcctaacagctcacaaataaaggaaaaacgttcgatctcattaatgagcagggaaatgtaaattaaaagcaaaataagttatttcacataaaaaatctaactatatgaaatattgccaagcatgtgaataaagagggactctcatgtccctggagaaagtttaactagtagaaatcttttagagtataatttaataatgtccagtaaatttgaagacacacaaatcctttaagagagcagttccactcccacatatatactctggtatatatagtagtagtgtttcactatcataatcttgcaactttgggacctgacatattagttagtcatgaaatcaatttttaattgagtagaatagaaaagagtgggaagtatcagagtgcatcatatgtagtaagaataataattgttttgtaaaacaatattttccaaaaatgtatgtgtatgtgtgtgcatgtgaacatgtacatttattttaaaatgtattgatttctgagaatcatagtcaaatatactagaaaagcactattgtagataaactcccacgtgtgaaaattgagatattttgtttataatagcaaaaaattagaaacaacccaaatgtggcaggagaaaggatgagaaaggcatgatatccccatataatagacagctgtacacagtgaaaatagatgatctggagtcccatgtattcatagaaatgcatatcaaaagcataattgtgagtttgcaaaaaaaagcaagttgaccaaactatttacattatgatgcctttataaaatgtttaaaacatacagtgatatgtcttatttagacataaatatatgtttaaatttattaaaatatgtacttatacatgggaatcataagcacaaaattcagcattgtgaaggaattgtgaaaagggattgtgaaggaatacacagatctcaatttatgttctgtttcaggaaaaaaacaaacaaaacagaggaattattttctcacatagcaagaagtctagaggcttagccaaattatcaaagacccaagtttcttccttctttccattctaccagtctcagtaggttttcttcatagtcacacggtggctactgaggttccaggtattacatgtagacttgccaagtccagtagtagaaaaagggccattttttttcatgtgtgggttttttgaaaaaagtgagcttttcctagacatccccagtaggttgaccagatgtgcctaatatgcttgttcttatatcagacactgacaagcacaatgggaccaacatggttgatgtatccaagtcacagggaaggaggtgaggacactggaacataattaaagctctaccagtgagaagaagaaaattctgttggaccattagtattggctgtaagtacctctatctgccttagggatacagaggtgaacagcacaagctcctgagtgagttctagtggagttaaaattctaatgaagaagactgataatcaaggacagttgaataagatgattttacatagagataaatccatgaagaagagaaaacaccaggatttatgagacagcaattggagagtgacctggaagccctctctgatcagacgacatttgagctgagaccagaattgcatgaagaaagcagccgtgagcagaactgaataaagggaatccaggaagagcaaatgtgctagtgcaggaatgaggttgttgtgtcggaagtaaaaaggaagtttggtatacctggggcaaagggagagaaatagagaatgggttacaatcaagactgtgaagcaatctgatttacagttttaaaagatggctatcacacaagtgatggtgatggctttttctagggttgggacagtggagataggggagaaatggacctactcatgttgaaatagtgaagagaaagtcaagtgttaaagaaggcaatgtaaagaatcaaagatgagcccagagtagcagatgtgacaaggtttgatttcaataaagtggctcttgggacggaactgaaagactaacctagacagggacgccactgtcctgtgagtagactcttccagaaagaaatagtatgatagtaggataagttctttgcatttccagagttcagcaaggcattcatttatgccttggtgaatatccacagcaagcagagtcctctttgctcaatgttcagaatccaacatatcaggtcctgttttcaggacttccagccgtgaggtagaaagtgctttaacgtatacttggttagcatgaactgctataaacccataaacaaattatggacagaaacattgaagactgcaaaaagatggaatggaaagaagattgccatcaagggcatacaaaatgactgtgtttgaataagtgcgtttgatacttcagcaggtaatttggacagcctttgtgcttgtctgacttcactggaatagtctacatacctgcggatctcgttgttgatacgcccatattgcttccagcgggtgctttacttacctgcaggactgggctttttcttttcctgctattacgctctaatctcctgtagttgcagcctccatcttgaatatgggatttagatcattaactttatatgccatatttaaaaagcaatttcaaccaatagatattagctattaaaataacttcttggttagtaaataggcccatttaaaactgcattttgatttctacatctgaaaatgaaagaccatagtattgttttattttatttttaaaagtccagaaaaaaggtgactatactattcttttccttcttaatccataaatgtgcaccaatataacatttattgatctgcatgcagcgtattggtaaaagatgaattgtccaagtaaactgaagaagacgcacaacatataagtattatataatataggtttcttttagttgcaagtgacaggaaacacaatttaaactaaaaaggaaatttgttcatgtggaactggaaggcctaggtgcagctggatgcagggactcaaatgatgttttttttctctccaactcagcttctcttccttgtcttggctctatttgtaaatggttgtccctttatggtgacaagacagctgaagcaattctagccttatgatctctcaggttcaactcctattttcaatattctggacaaaatctccttgcctatcattgcctctggttgcaccgttcctgaaataacctctgtgaaaaggggaataaagtgctctgattgggtcaaattcctacaacctcttgaagagggtattgaattcattatatccaaatatggggcctaacagtggagaaagggtgctttcctagtagggtattggggtgctgataccaaaataaatgagagtgaaagctgaggagtcagggaacatatgtgccctctaacagtgttagaggcagaaatgttgccatgtttggtttctaataatttgtcgaggaaaaattcttgtcctctaagatgataaatcattcagggagcttctcagtagtttgcttctgaactcccggcactagaggcaggcctggacttagagacagcagaaaggggttgcctaccccatgccacgtgcttgacatagactatctcattgactactcacaaatattttattagtagtcctatcttttaaatgaaaaacagcctcaggcaggctaaggaacatgtctaagttcatgcgacgacaattgaacagcgtggtgcctataggtaataatggggttctgtacatttcagtatcactatgagagtacatttctaatgttctcatcacaaaaaagttgtgtgatgcataacacataacatgaggtgatgaatgtgttacttagcttaatttaatcttttcatattgcattaaaattataacactgctttgcaccccataaatacatacaactataatttgtcaatatataatatgctttttaaagtgccatagtctgtatttgaactcaggtctttctgagggtaaagcccataatctcacctttatagcatgccactgtcttgccaaacacaactcttaactcacttactgggtcaagctttaatttatttatatgtggtatttcaattttgtgccgtaagcctagtggcatcaattttaagatgtaggctttacacatattgtaatgtaggtgttaacattctttaagagtcttaacaagaaaattattagtttctcggtaagctttcattccccaaatatgtagtgaatacctattctgtataagaggacaagagcaatatgaaatgattggctatgccattctgggatggttttatcataatactaagaaaaaaatactctcctggcattccactacagtccaatccaggcttgaaccctcagaagaaattatgaattgtggaacacagcaaactacctcctctgtgcagggctaaccacttctcccttaagatcctctcctagcgtggaacagcgtggtatctgcagccatcaccccagatagtggttcttgagtttgcattgttgatatgtcttctggatagtgctgccctacagagaacccatcttgttttgttcccattcacatttccaggacagagcactgcccagatacatgttaggtgcacaaatatatctcttgaattacattaagtgccctattacagtgatctgccatagatatttggtatagcaacagcattgaacatttaaccactggtaaaattaatatgaaacacattgtattttagaaagtatatatgcattaaatatcacaccacacatacaaacacatattatgtatcccctaatgtatgatttatatgtatataatatttgacatcacagatacacacaatcctttatatacctttatgtatatagattgttctgtaattcataacatttaaggcttttgggattttgtttttaaacaagtattacagcttaaaacatttcctggggtttgaattctcattccagcattttatggaaccataaaatatgaccagtttacctcttctaccttttctaaacttctccctgctttatgacactgaaaacaaacacacatatgaaatgaattatgtttaaatttctgggcaacattttcttagcaagcaacaaaaatatataattctatttttcagaaagtaatttagttctaggaagctgagctgacacataaccaattaatagttgaaaaaaaaaactaccatttgttgtcaagctcttttaattttgctaaaactgggtttgcaaaaggatattgagaaaacattgactgtaaatccttaattcccattttcaaaaccttgtgataatgaataattctttatgatttcttcaacaagtaacatactcatcgtctttatgcttcctatcttttttttttttcaatccagaagtgtgatcatgacaaaagtctatgccaggaatatgtcgatctgacttaatgctttctgagactgttgtttctctccctgatttttgatacttttacagagataatagctacttcctaatctgttttttacttccttgtttccattttatgtttcaatgaaacagcagaatacattacttcatcttaattttcctacttacctgtgtttgttgttgttgttttaatgtgatagaatgtgggatttttactgtttggaatagcaagagagctacagatgaacaaatggaggctaatagataataaaagacttttccaaagacatggactaattggtgcccaggttcagcttgcaggatttcagaaacagcggtgagttaagtcagcaagtcctatggactcttgagagcaagctctttttttttttttttacatttttttattatttttttaaaaatcaatcacttactagaaggcagtagaggctattggttaagagcacagactttggactcaaacaagctatccttggaatttaattctgctgcctcccttcttagctatgtgatactggggtaagtcacttaacttcccagtgtgcttcctgtttccatctgataagttatggtgacattactgagctcttagagtttaggtaaagattgtatgtagtacagcctggctcatactaagcaatgaataaagggtggctaatgctggtttttattactatattttcttcttatactttgacaagcattaatagagtaagtaagcatggctatatggaactcaataacttggaaagcatgatgatggatgacactttttatgcttctattttagccaaaacaactgtttacatatcctgtggattatttaagcacatgccacattgctacaactcatggagtggccttattctatacctaatgatagctggcctggccatgcctcatttcactgccgatttccttctagatactcctagaatccacttattctccatttttactgccactaatctagttcagagtttttatcatttttcactggttctactacaccatcttattgaatatctttttgtttagcaaggatattaaatctattacctttattttgaaccagagaatttttttgaagcacaattcaaatgatgtaatgctcttggtaaatctctttcacagaaccccaaactccctcagagaagagtgatagtctcaccatgatgggtctttttctgtccttctctgtgtctgtaagatagggcagaggaggaaagtgagggtcaggaaagttagataattagcctgaaattacacaactagtgagtgacagaacaaggaccccatgccagatgtgtctgttccacagtccagatctgcacagttattaccacagttattacatagatcaaggatcagccaactaaagcctgtgggccaaaggaatcccactccctgttttgttaataaaggttgattgacattcagccacacccattcactttcatattgcctatggcttcttttatgcttcaacagagttgagtggtcatgacagagaccatctggttcacagtcaaaaatatttactatatggtcctttatagaaaaaacattgctggcacttgacatagaacatacttggattcaaaagagtaaaagtgatagattcctggatgttcaccgtgaggaactctgtgatcagagtcgtctgaaactttaatgaggtggatgaaatgtcgctttaacaaccagaagaattactcaagtagtaagacctaaatatactaagagattttaattacctagatatctattgggaaaacatcttgacaggatgcagattgtccaatcagttatttttaaagggttgctgacagtgcttaatgtggaagaggtaggaagctaaagagatggcagggctcctccacctgactgtgccccagaaagaaaagacgattgcaaacaaaatgggatatgtcatttgtagaggcaggtactgtgaaataaatggcagaattcacagtgctaaggtaggggattagaaaaagcagctgaacaaataaaacgaatcttaagaaagtaaccttgagtacaaaatgttctgagcccaaaacaactgcatatatgcataaatacgtgcacaatcacctgttgaatgcgctcaggaactttgcagttgacctacttggaggggaaaaatcggcatactcaatcattcagaaaagtcaagcatttgtttaaatcaaatatgccaaaattccaaaaagaatttagcatgaataatatttttcacaaaggcgaaaagccttctcgttctctgggagccgttttgtatttgggagattggagagcaaaaaggcaagtgccgtttgtgataataggttctcggagggcagaaataaattatgttcagaatgtacaaggaacatgatgatggttaagcccttagactgtatgtagttgtcctgctagagaactcaaagtatggaaaattacaaaataccattctaagtggtctagtgagtgagtgcagcttccaagtgctatcatttaatttactttcagggagtaatgtgtgtgccctgggtttgtcttgtcaatgctcctgtgcagtggtgcccaaggagaggccagaaagaacttgaggagatctgttggttcctttggatgaagaaatgaaatagaccattttttccttggtttcctcaatcatgtttaattaacttttgtcaagggcctgccgggtgccctgcactggaattggggacatcaagatgagtaaagatctatgtgcgggagaaaaggcaaaatcaaattattgtcatacaatttgatgaattaattctaatactagaggcaatacttgggccagaggctgggtgaagggagagagaagatgaaagacagaagcaggaaggagaggtttagaaatagggcaaagtcacagcatctgtgtgaccagactcctgtcctcaaagtaagtgtttgtgaatactgggctatttatatttccatatattttgtggaaaaccaaaaagtatgatggcagtcttgtggcatgttcttgcccttcacgcagtacatgcaacagaaggaaatatgaggacataacatgtggccagattctccttctgcgagggactatgcgtgtctctgaacatggagaggagaggcctccatcaaccctcctgtgcactttccagcagcttgtagttgggtttgagtgacaaatgcacctccctaggtctgagagccagttacattgctgccaccaatactcaaactccattggctttcttagtagcatataccatttttctaagaaaacaaccaccatttattgattacttactatgtgctggacactgtgctcagcacctgcatccaatacttatttaatcctcacaattattctgtgaagtaagagtcattttacccatttttgagaatatgaagtcacagagccacagagtattgaaataactttctcaaagtcacttggcaatgtatctgactcacacatataatcaatcttaagtctgctgtatttcagatattttttacttccgtagtgttttttgtttgtttgtttttgtttgtttttttttttttgcgacggagtctcactctgttgcccaggttggggtgcagtggcgcaatctcggctcactgcaaactctgccacctgggttcaagtgattctcctgccttagcctcccaagcagctgggattacaggtgcctgccactgcacctggctaattgttgtagttttagtagagatgggtttcaccatgttggccaggctggtcttgatctcttgacctcatgatccacccaccttggcctcccaaagtgctgggattacaggggtgagccactgcgcctggccctctagtgtgttttctattattatttttaaatatagtacttaaaacttatttaaaagttctatggttgaggcaaatccataataactactgcagagtttgaatgctggaatattagaatattagaatattctgggtctagaatatgtttggtcctttccaggcctgaagggaagacagtttccattttcattatgcactttggaagatgccagagaaattaggtgggcatcacatacaagtatcactgttttcactgtagcttttgttttagagaggacaacttgtaaaactttcagtgaacttaggcaaggagcaagccaaccctggcagggcaggccctctctgcaggaaacccctaactgggaggtgcccagctctggcaagtctttgaactgtcagatgccaggtgctgttagggcacctccactcagcccctgcctaatgcaagctcttgaaaactcagagatagcttcctccttcattagcatttgtgctctgtactgaacacaggtcaaagggagatgttaaaatacaccccagagttcacagggccaggatttgaccctattgaaacctgataaataccacccctctattgttctctgggtggaatctggcaccagggtgagaactgggatatgactgaaagattttgttttattgctatcttagtctattcattgttgcagagaccctgacaggatttctcttatctgtgatttgacaaaatatatcttcttaatcattgcacggttgatgttaagagggttcagaagtataaaaggaaggaacttggcttagaaataaagcattgagggactttaaaattaggccactggatagacctattagcctttaaagaggctgagaaattttgatgaaggctgggcctctgaaacgggcaactcttctaattttaataatgcatttgaaattattcttatcacttagtgaattcttatttgattgccttgaggcctttttcaagtttcagattttaattcctcactactccattaggaaggttggtcattttatgttcattttactgttaagaaagaaaaaaatgcagtgagatcgtacaactaagaaatggtaaaacccagactggaactcagtaaatttgatatcaagccctgtgatcttaaaaaaagttactgtggttaaacacgtataacaaaaatttcccattttattcaattttaagtgtgcagtttgtggcatcaagtacattcacacggtagtgcggccaccaccatctgtctctagaacttctgtcttcctaaactaaaattctgtactcattaagcagtaactcttccttaatctctccacctatcccctggatactaccattctgctttctgtctctatgaatttaactgttctaggtatgtcatataagtggaatcattatatctgtccatgttgtagcatgtgtcagaatttccttttttttccaggctggataatatttcactgtgtgtgtgtgtgtgtgtgtgtgtgtgtgtttgtgtgtgtatttatatcacattttgcttatccattcatctatcaatgaacacttcagttgttccttctggctattgccagtgtttctatgaacatgagtgtacagatatctgtttgagctcctgctttcaattcttttgagtatatgcccagaagtggaattgatgaatcatataataactctatttttaactttttgaggaaatgcaatacattttttttcccaaagcagcaacaccttttacatttctgtgctttttttgtccatatctaagttgccttggaatgatgaactagctgagaaaatagcactgctggtgtaacaatgccatatgtagctgatctgatgcttttattgtgtattggtttaacacacatgtatgtcatatggttcatgagcatttacaaatgatatgcttcctctgctgcttaaaagtcatattgaataaaggggcatgtttaactttttcagaacacttgaaatatgatgaaatgtcagtgtttttgaggcgtcaaaacaaatgacataatgtcagtatttagaaactcaactatgtgtaaaacaagttgcttttgttttccaccaggcacaccacagcatgtttaatgatggatattattgttgtgaattgtatctaatctgctccagactcagaaagcctccaacacaaagtgtcatttgttcatcactttgtgggttttgcctgtttcttacatacaaaggttcactaggagttgaacaaaaaacttaaagataggtatggggttgtgtagtcttgaagtgtgtgtgtgtgtgtgtgtgtgtgtgtgtgtgtgtgctggaggggtttttcagctgttctttttatttttatggaacaggatatctccagatgatttcatttgaagggggaaagctccaaattattccaaatgggatgattccatttggagatctttcctcttgcttcaggactgctagtataattcccagagaagcataagaaggccacagctatgcctaaaggagttaaagctggtgcctaatctttgaagtctggcaggcctacctccaccccaaagtcagtggtcaccgctatccaaggattcatcaaattgtgactcacagggtggagaaggctggctttgagagaggtgaatgtgcatcttcctcaggaccacagttgtggggttagctgtcctgcatcagacctctgtctcattttcatgatgaacatcaatgtggtagacacaccgtaacctgacccagaatgagcagggctcttttgtagtcccctcctcttgagtttgggcaaaacccatgacttgctgctagttaatagaatatggcaaaggtcatgggatagtcactcttgattaggttatgttgcataagacttcatcttagccagctggaagagagattcttttgttggtcttgaagctgccatattatgagagggggatgccaaggaatgggccacctaaggaggtgagagtagttcttggttggtagccaacaagaaagtgaggacatcagtcagtcttaacaaccacaaaggactcttattgacagtcatgtgagcctggaagagaactccaagctccaaaaaggaacacagcttggctgacactttgattgaatccaattaagccatgcccagacttctgatccatggaaaccaagacatacaaaatgtatttttctaagtttctatatttgtggtcatttgtcacctagcaatagaaaactaatacaatcaagcacacctttaatgttaccttctctttccctgcttgttcctttcatttttattttgcctttttacctgttttcttgttctgtggattctgtctgatgagaccatcaatcaagatgccctggtttcccccagtgaggagaaaaacacatgacccaaactaggccaatcagatctttctctccaggaatccaaatcttaagaagaatgaaaaagaggctgtatgtgtttggagctgactgatcccagcagtgttgccctgaaacactcttgctaccaattctcctagagagttcctgccacctatctttgccaattcctattccctaacttccttttttattctgtgagctccactagattcttcaaatgaattcctcttctgctgaaattaatcagaatctattctatttgttgcagtcaaaaaattcctattgatacatagagccctgttgtaatcacctcatacatttttttgtctctctgggttgtattatggtcttttttctttctttttaaacttcttttgacggggtctcactttgttgcccaggctggagtgcagtggcactatcttggctcactgctgtctccctcccttgggttcaagtgattctcctgcctcagactcccaagtagctgggacaacaggtgtgcaccaccatgcccagctaattttttttgtagagatggggtcttcctatgttgccaaggctagtcttgaactcctggcctcaagtgatcctcccaactcagcctcccaaaacactgtgattacaggtattagccactatatccagcctattgtcttctttctaaaagatttttctcatcactaagtgttacccaaacatgcagggtttcaaggtaattcttgataggattttagaatcagaatcctgattctaaagataggattttagaatcagaagtctggaaatgatacatgaaaattgtcaagttaccttcttaattttaatttaaagaccacagtttttggttaagtctcataaaaacatctttagacttaggataaatcagaagatgtatactgtatgtagcgatgaaaacataattttttaaactaggaaaataaagagtacagaatggctcccagcagtaaattttctagtttcttaggaggaaaagaaagatcagttggtggtgcaggttttcttgatcttcaaagtgagtgtgtaaagacttctatttcctggctggaaacatcaaagacaaaggaggaatcttaaaagaaataaaaactctagaataaaattaaaaataagaattgaaaagtagagagaagtacaattccactgttagaattaaaattttttgactcacttcttgatatacagaccttctttccttcctggtaaaagcctatttgaaaagtgttacgaagtttctccctcttgtatcttgtcagaatatacaaaaattcagattacagttgacccttgaataacacctgttcacactgtgtgtgtccacttatatgtggactttctcctgcctgttcacctctgagatggtaagaccaatccctcctgttcctcctcctcagcctactcaacatgaagaccatgaggatgaagacctttttgctcactcacttccactttagaaattgtaattaggccagtcacggtggcccacgcctgtaatcccagcactttaggaggccaaggcaggtggatcacttgaggttgggagttcgacaccagcctgatcaacatagagaaaccccatctctactaaaaatacaaaaaaattagctgggcctggtgacgtgtgcctgtaatcccagctacttgggaggctgagacaggagaatcgcttaaacctgggaggcggaggttgcagtgagccaagatcgtgccaatgcactccagactgggcaataagaacggaaattctgtctcaaaaaggtagtaaatgtattttctattccttatgattttcttaataacatcttcttttatctagctgactttattataagaatacagtatataatacataactgtatacagtatgcattaattgaaagtttatgttatccataaagcttctggtcaacagcaggctattagtagctaagtttttgggaagtcaaaacttatacttggattgctgactgtacagggtatcggtgtccttaacccctgtgttgttcaagggtcaattgtatattctttttaaagaagttaaaataagactgttaatacttttattgcactgttcatgacagcatgtcaagtatgataaagcattttttttcttagtttaatttattgaattgtaattaaggtatttttcactgtagtcctaagaatgaccatgctaaaactgtcttgacaagtcctttgctaatgccttaataaacaacattcaacactgttaaagttgggaacaagtttgaggtaaaatttgtgtccatgagagtggacgaatcatggtaaagaaaataatgtggagaaaatatataagaaaaaagtcaacaactgaagagtagatttttgaaagttcagtgggttttgctttgttctagggccaattttagcttccttattaagcattattttgtcaattttcctattagaaaaacataattgagattttgttttgggatttctagaagaaatgagttggtgtttttatggtgtttccttcgaaacccaaaactgaacatggaactgaacatggtcctttacaagatttccctctcttttacatacattctagagtagataaaaatgaaatgaatcttagagctcaggaaatatcgcgatttcaaatggacaatccttgacttttttgtcacattgtttcttcgtggaaaaactcattctctctcccattccaattttccagtagagatttgattgagtcttgagcatgcgttgaccatcttcatatcatgtattatgactgaagtattaaggatctaaaaggtacagagatagattgcacttagcttaggattgttacatgcactctcattcaatgtttggacaacttgatggaataccctggaaagtttgccattatctttccctgtgcattggctccatagacttaatgcacctatcttatggatggaatgacgatactttgtgcttggagacctgaaattgttgctttgtagccctttgctcttatttagccccagaaccagaacttctagaatgaaactctagtaaagaatcagtcaatgttttttgtttgtttgttttttccccactccaaagagaatgtgttttacttttttgtggctctgaaagatatgccaactcaaactcctaggtctctcaggattgatgggtacccttttatgttgcatcaaaattgaagatatactagtgtaaggtctagctacctttctagaattaccatccaaaaaagctgttaatttaaaccctacttcttaagccaagcagtgcatctaaagtgagctttttttaattttaaatttttttttttttttgagccagggtctcgccctgttaccaggctggagtgcagtgttgtgatctcggctcactgcaacctccacctaccaggttgaagcgactctccttcctcagcctcctgagtagctaggactacaggcatgcgccaccacacccagctaatttttgtatttttagtagagacggggtttcaccatgttggtcaggatggtcttgatctcttgacctcatgatccgcccgccttggcctcccaaagtggtgggagtgcaagcatgagccaccatgcccagcctaaagtgagctcttgactgaacctattactgattggactttcttggaagcactgaatcctgactgtatccagcatttcctaaaccaatgagaattctccttaaagcatttgtcctcagtttcaaaggaaatcagttctgagatactctttttctcttataggatactattatggtcttcagacattcactgtatgaagggtttaggttgtagaacaaatcaaatatacttgaaatgcattttgctttctgagggactatggtgtgcttttcttcaagacttgacaaaatttacttttttaaaaattaacttcctcctgtgtttacaccagcttttatactttgttggaaatacagccacttccagagagaatttggcattgcacttatcaaacaggataacttaattattggcacagattattttttatttgagcagtgtgcactgccatgagagagcatccacattttcattctgggcatggaaacaatgtaaaacaggtttggcatgaagcatgtatgtatgtgtgtatgtgcatcaaactctaccctatgtgaaaggctgccaatttttaaaatccttgggaactagagtaattaatctcttctgttgcctataacaatcggaagacctgggaatatttcatccatttgtaccatttggaaaccattattggcccatagagattgatacttcaagaggagtggtctcttgccagcttacttcgtaagttttgcctatctagtttcaatatttcccacccttctctactttatgttgtatcttttccttgggttaaaggtttttgtcagcttcttctgctttgtgcttatatttttcttcctatttacaaaagctcatcttccctcgccaatgaaacaagttatggagtgtgtacatctacacctagctggctctgctgttgtacagaggtgcaaacagggctgtgattttagacatagtagtgtcaatagacatagtagtgaggatgacacagcatcccacgggacaagattgcagtgatgttatcctcacttcaattcaactgcatgactaacaagaacattacagagaaaaaaagaaagaaaaaagattaaagattaatgcttccagtcagtcatgtcccatggggagacatcttagaacccattctacccattgtgaccacacatatatagcagtttttgagaaggaatcaaaactcaagaataaatgacatgttctgatatgttaggcaaatgtcagacaatgacacagagccctaagttaatatttgggaaactaaacttttgaagtacttttatacaaagcatatgctaatatatgcagactaatgcaaattatccataaccttgaggtttctcacaggttgacagtggggtccttggtgtcacagaaggtgaccattgctggtatagattctgacaattacttggattatatcatgacttcatatttaatgtgaattttatctacttagtctgagcagttgctcatttgccaacagttttgcttgtgtatataagtaaacaaacatatttatcacccctaggatcagtaaacgctaataaagttgctgctgcttgcactttagatttgttttaatgacagacacatcctaaattaactaagaatggtttgcttgctttagagcttagcaagaaaggtaaagatattagcatgattcgttgtcaccaatcaggttgaaatgatggtacatgttattctttgtcatcagcatactctatcttagactgtatttttaagggggagtgtgtgtgtgtgtgtgtgcattcatgcatgtgtgcatgtctgtgcatatgcgcacacattttctttcatgggagttctgatgtcactttttgacaaaattcattgtgaactttatctcagactgcagtgaggaaaaccaacagactgaacaaatgaacaaatacacagactcttctcccctactttatgtaatattttatatgcgttttatttaaagccagcactctacatgcagccatcatgaattatcttgtgtgatgtgcaatatttgttaaggtgtgctttgcaaatgctctcttattcaactagttccctgaatgggctgaaacatggtcatttttgttctatacacagacagtatattaaaataaggattaaaaccatgtttaatcaattgttagacttttatcccttcatgttactgttccatctttctttctgccctttgctgatcatctaaaaataaatttgtattctctgaccaatgaactcactccattcatttattaactcttttacagtcttgtttctttctgaagtggtagaaacacttaatagcctactctagtgaactttcttcagaccatgtcttctttaacacctgtcacactcaacaatgttgactaccctctcttaggtggtctttgctgcgtcgtttgctgtcaaccattaacaccatacctgtatccagaagcgctgtcggaaagccaggtctgctgatattgattcttttggtctttttctgtctccactttggcctctcttttccatttctccattgcctgcatgttttcttctttttctgtttgtcaattccatttgatacagctattctatgaagaaaataaaagatattgtttaaaactaaaaccagttatatctacttctatcttttggaaaagatataatgcgtgaagtacaggataggtagtgcttacaatttatttttgttttaagaaaatgcccaggctgggctcagtggctcacgcctgtaatcccagcactttgggaagccaaggcaggtggatcatctgaggtcaggaattcgagaccagcctggccaacacggtgaaaccctgtcgctacaaaaaaatacaaaagtgagctgggcatggtgatggatacctgtaatcccagctatttgggaggctgagagaggagaatcgcttgaacccaggaggcagaggttgcagtgagccgagatcgagccattgcactccagcctaggcaacaagagtgaaactctgcctcaaaaaaaaaaaaaaaaagaaaaaagaaagaaaatgccctaaggagacgggtaggtcagctcagctgaacaagtgtagtcccctggagtctactctatgtctaggctaagttttcttaggtgtttcgcatctattatctttttaaatccttaccacagcctgtttgttatttatcttcattttaaacataaaattactttattttttcattccattgagaaagtcttctaggtgaatttgaaagccaggaggagttgaacatgtttggcattcctcaaaagagaaaagaaatgagggttcagaatggtgaaatttctgaaactaggatgatgacttcaaaagatgatttatgatacttaggttaggatgttgctacatcaggttaaatgctgtcattggtttttgttttccttacaaagaagaaataaatttgtgggtgggggtagggagttactcaaacatacctaatttctaatactctaagctacatatttaaatacactattatttgtatttctcagtttcccattgtttttaatgtgcttttcttaacacattaatgatagcttaaaattaatattttcttcatgctaaaacaaacaaaatgatgagagaaaatttaggtatccttgtaagctagttctcctcttttctttcaatgtaataagcttctttgtgaccctggcattaaaatgttttgaaatggttattggttcacggacattaggctctgtaataccattttccctatcatctggatgtattgctatttgtttgaaggcacattccaccattattggtgccctcactagcagtgagggatgagcctgagtgaacattgggaataaagccagttgtttcctctgctgcattacaaggaaagttattcaggaacatgcccactgtggcaaatttaccaagtggaatatttgttgccttgacattttggactatctactggcatgaaaagtcaacagagaggtatttctacacttgcttaggaattatttgattaaatagcattggaggatagaaataactgttttgttttattttttacttaaggtgtaatcctcttagtcaaccgaagcttacagtggcagtggtattcattattttactcagatttttattctttttcattaatgtagagctttgtacccaaatgcattctatacatgtctctcattacttctctggcagcaagatagcacttcactccacccccaaactaaacagaatttaatgatgggcactccttgcctcatgagggggaaaaacacagtttcctggtcgtggtctctgaactgcaaagacacacttgaggtttatccactgagtaaataactagggtgaaaaagtctttgcctctgcagcatgaactaatatgacccagccaaattatgacccacctgttgatactcttaacaagtgtgagtaggtaatatcatgtttatggtgagtccatgtctctgagtaatttagggctgtgctgctcaatagggtagcccaagccatatggttctgtaagtttacatttaaattgatgaaaaatttagtttttcagtagcgataactacttttttagtgctcagtagccacatatgacccagtttagaccaaagagacttgaaatgttttctggggctcatagttgaagagattttcctttcctgctagacatggacaacaagctgcagctcttggaagctgtaggctgccatcttggggacatggaaagctgccttaggaagaaggaaacactaagggtagcaaagagaccagaaggaagaaattttgtttttggtgatagcatagagctgccacatcaacacttgcccaagacctgttctatttctagacctattatgttcaatactgtggccactagcctcctgtggaaactgagcaagtaaaattcggctagttcaaagtgagatgcattgtaagtgcacaatacacattggattttgaagacttagtatataataataatgtagattgtctcattaatccttttttgtattgattgcatgtttaaaggttaatattttggatatattatgataagtaaagtatgtgaaattcattgcacttattttttaagtatggctactaaaaaaattgaaatcacgtgtgtggctcacattatatttctattggacagtgtgacttcagacatttcagttaccttaacaataaattcctttcattgctcaagtcagtttgaatcaaattttctgctgcttgcaacataaagatttctaatcaatgcttggcataacatttctatttaaactttatttctgcccatttatgcttgcaaccatgacacacatacaaatgtatatgtgtgtgcactggcactcacacatgcgataaaaagtgctttcctgtgttcctaaatatccatctgagatgctagctcattacataaaactttctgactctcagcttttcacatctgaaacgtaaaaaaaagatttgtaacttagatatttccatgactatattcattctactgattattttctgtgtttgattcacttttatttatacactgaattgtcattaaattgtcttcttatttcagttttggggtacttttcttctctctttgattttttttgatgccactaaaattacaaccatttacttagctagtaagactgcatgtaagtggcagtgaagaatgaaaaagaaaactatccagtcaaaagaagtaattttaaaaatgttggagtgtgagattttatactataggaaagtaagtcactaccagatatgttatttaaagattttctttaaacttttaagcctatatatttaatttcctagtttttttttttttctaaaaaaaaggcaaagataaaattacaagctttaagataggaataaaagtcatttggtcatctgtttatgactagaaaacctttatgttctatgaaatgcatatagattaagggaaactatatatagccaaccaaaataaaacagccatgctgtgtgttttatcaaattacttcttaaaataggaaaacactcaataataagctgcatatagctccctaattactacagttttactttatatgatgtttaagggaatttttgagatatctccttaccattttttctatgaaagtgataatttaaatataattttatagcatatgtttttatttttatatttcttccagttctttaggacattaatcattattgaaattttgtccttcccccatctcatttctttgctttttacctccctggctttctttgtattgaaaaagctaggttccttctaggagagaagtgtcctatgtatattctgatttcttttttgtggagaaatgagtgactgttgagtaaagtcatgatggaagtgccatttgaaaaaaacacaagttcattatatttcgttattcatcctaattttcaagtagaattgcagtaagctaatcattgattagggtgctgttagagttggcagttaggaaggtaattctgtgagtgaggtggaaattatttggctaaataatgtggttttccacctttcactattataccgcttttgtgaaatatttttaattttgattatagaaagttttaaaattaaatagttgtgtataaacttattgaatgtaatccctatatatatattaagttctcatcgactgcatggcactatgaaagactatgatttggaaaacctttcattttcctttggggcaagtaccaatgactgtgttaaacaaagtaattcctaaatatggccttaaactctcttccccaaaacaaacacattcctcaaagtaaccctgagtgagcagaaaagcagtagtttactaggtatctctaaaccatatgcccatatcctaaacgtaggggttaagatgaagattttatgtgattagattggacaaatatgggaaatccactcattcatttattcattcattcaaccaacatttatcaaatacttatcatagtgaatctatatcaccaagaagaaagtttgggaacgtttctgctgaggaaagtaggggttatattagcaatgttttattttatgtatttgataccttgaatggatcatttttaccatactttcctctacaagataaaataatttactgtagtaatcagtaataaccggtattttctcttttcttcttgagatgtaatttacatatagtaatactcaccattttaaagtgtataattcagtgtttttttacattaaaaaggttatgaaactgttaccactattgaattccagaacttgcatcattctccaaaataaaccttagacccattcatattcattcctcatttctcttcccccctgtcttctggcagactactttctgtctctctaaatttgcctatcctggacatttcatataaatacagtcctacattatgtggcctctgtgtctgttttctttaacttaatgttttcaagattcatctatgttgtagcatgtatcagtacttcattcctttttatgagtgaattaaaaatattccatagtatggatatagtacattttgtatatccatttatcaattgttggacatttggattgtttcaactttttttttttttttttttttgctcttatgaatagttctgttataaacatttgtgtacaagtttttgtatgaacatatgttttcagttatcctgcatatacacctaggaatagaattgctgggtcacatagtaattttatgtttaattttacaaggaaccactaaacagcttttcacagtaggtgcatcagcagcagcgacgtatgcaagttccaatttgcccgcatggttgccaacacttgtagtttttgcttgtttgattatagccaccctagtaggtgtgatgtgtttgatttattctttagtttagaaagagtgaacaactttttaataaatcataaatttaaaattatataaattattttgatttaataaaatttgcatttttatcaaaattattaaaatcttgcagcttacagtagttcactcaaatattgagcactatttaaaaatgcaagaattcaaatagagtaacataattgaaatagctcaaagtctacttgtctgtaaattcagaggctattattgttcattaagagtcttctgattacaagagaagatatgtagtaccacatagacaaaaactatgcctgaaacaagtttgaataattacaaagaattgtgaacttactctcaaaacaaatgcatgtatctgagtcctcatgtcccttgggccagctgtataattgggacttctgtgaattaacttgtaaaataaaaggataatttaaaaaaaatctaagttgaagcttagtatctgctacagttgtttagaaattaggtcagcaaaatattttggtaagaggaatagtctataactgacattttgaattacagcacatgttgacaataaaaagcagaccaaatttttttagttttattattgtttctaaattttctatatacaacaaattcccttattatgtacacctagggcagaacacttccactgccacactcttggttttaaagcctttttgtttccaaagggaatgctttatgtattacatggaaaacatcttggtaaagcagaaaacttttctgatttggtttccaatcaggaaataactcttcaaccaaagatcctagcccaccctttcatcagagtgcagtagaagtgactggtgcaaaataaataaatgctagaaagaagacagtaaagcttacatagataacctcagggtcaacccaaactattccagagtaataagaaaaacattatctaaaacatattctagagagcaaattgcattagttatctactgctgcataacaaattactctcaaacttagttgctgaaaataataaatatttattatctcatacagtttttggcattcatgagtttaagaacaccttaggtgagagattctggctcagaacctctcttatgagattgccgttaacctgttgatgcagcagtcatgtgaatgtttggttggagctggaggctctatttcaaggcttactgatgtggttgtttataggaggcttcagttcttctccttatggtcctctaagtgaggctgctcaccacttggcaactggcttcttcccaataagtgaagaggtaaagggaggtggatgggagagggcacacaaccaatatggcagctacaatgtctcttacaactttttctcacaggtaacataccatgacttcttgcaatattctattggtcacccagaccaatgctggtgcattgtgggaggaaactacatagaggtgtgaattacagagggtggggataattaggggtcatcttagaggacaactaacccaccaacctccctctacttacattaatttataaatttagatgtttattattagaacacactgcttcttctagaatgttgcttattcttgtcttctctatagttttctgagtaaagtattaaagtctttaggaattgctttacttgggctggatgggctctgcttagtgattagagtcacctactcaccgtatcttttaactgaagttgggtgtccaacaattaaccttccaatttttatttcaagggtagttttaaaaagaggcaggtgttttagctctaagaatacctgtatgtttttagaacagagaaagtgggaacaatggagaatgaagtcacatatattttttaatcttgtttttacagtaggtggttttaagtcctaccatatgatggctggtattttcgagaattgtttctttctatcagtagaaaatgtgtcccttccaacgttccattacttgaatgtctgtgttaacctagaaagacagtaggagactaaaacttgtaatattttcattacttgaaagattaaattatgttttattgtatgagttctttagtattttccctggataggccttttcttcccatcacacaaacaatagagacaactttatgaaatatgagagaattgtattttaatactctgaggtaggatcaagctactttcatcagttgatacaattttcccctaaagaaattctagctgtgagggccaatggacttgggttacatataagaattatatatacattatcatttgcttttgaaagtaattattctaaggctaagttaggtttgaatttgattctgaacaatgatgatgcatttgaactgttagggtaattaggactatatcccattcacccacacactctttttcatgtgtagtcctttaaactgcacagcctttgaaggatggttagtttgtatctggggtttgtgttttgtttttttttttcatctactttttgattgctatgtcattgaaaagtgcttaatcacagagaggattacaaaataaaatcaccattagcataaatcatttatactcattttaatgcttccttcttgtttgtggagttgggtatttggaagagtggagaatatataaccttcttttttagtgtattttgtgaaacagtttttctctcctattttgttttaacatttaaaataagagacaaagtcatcagagtcaaattatgtatttacatttttattagaaaaataattggttagatgaactggcttattaatgtaacataatttattttggaaaattttttaaaagctaaaatctgtatttaatatatggattgaagaaactggaaatatatgaagatatactttgtattatacttttcatccttagaaatgcactgttatattgtttagggagacttcattcagttcctaagtaatttgtttttaattctggaatccttagaaataccatttcagtggtataactaatgggcaaactggaactaacggaaaggaattttatttctttattcctcccaccaaccccaattccttgcacagatttacatggcatggctcatgtaacacaatagaaagattcctgaaaattgtatccaacttttctatccctattttaaatgcactgaagaatagactacttaaattaatctaaaggtaatttttcttgtataactgtggcttgaaaacatttagtttatatatcaactgtgtttaatcattccaagttgtttttattcagaataaatccctaaagcaagctttgctgagtgtcaaccctttgctctctcttacgactgattactatggttgcttctttgcttgtaactttaatttacggaaaacaggctcttggtgtccagaaggcagaatgggcttggtgaaacagatgctagacctaaatggcttttagcatttctgcctctgcctcctggttgcttttgttgtatttctatgggtgccttgaataatgtgagtcactcaggtgggcagagttcatagagattaatttctggcgtgtgaagaggaacagaaagcagtagaggggtagatgttcttaggatgatccacatctgttcttctcttgtccctgtgcttcctggtcacccacctccagtttcagttttattcccattttacgatgaacattaaacagtgtaattaagttatgcaggacccatattgtgttttaaataacacttccaaaagtatatcatgggtcagttcataattgtgaacaagattctcttgtttaacatagcaaagtgaagctgaatctcaaaatattgttccctcttaacccaatggtatgaacaatataaaattaaaaatcagcactgaccattcaccattcatccatccacccatccatccatctagtccaaggaggaaaaaactcccgatcgtcaatgagaagaaaatactactatctagcaaaggaagcagatctaagccccagagactgcatgtctggctttggtaataggcaatgtgcatctagttgctctctgcataaaccaaataggggagaaataaacaaaataaaatcctgaaaacaccctactctcatcccaactgtggagaagctaatgaggcaggctgagagaagaaacagggacatttccctaagggtggcagtcttcttgctcacaagagagtaatattttttccaccttgatgtctccatgatggcatgaaattaggggataaaaaacagaatgaccaaaaacagtcaaagctaattaacttttgcaataaacaaggttgtaattgatcagtaaacaaaagaggagaatgggacaaaggagttggaatgagtagggaagtgtatactagaatccctgggagttgacttcaacctgcctattgccttaatgccttatctctgttatatctgaggaagagagcagctaattgggttaaataaatctcctgaggtactcctgatggaagtagaggctcagaggccctgaggtgagtaagggaaactctctgaagccataggcactgaattgattcccaataaagtgaagcagaccttggcataaaataattacaaaaccagagaggagatggcaaaactccaaaacactaaccaagaccctgccaaagcccaaacactcccccttgacaaatgacccctggtataagcagaactcaaattgtagtttatacgggaagctaaatctcagctaaggtaagaagggaatcaaaaagaattgacccgtattctaatcatgcacatagaggttctagattaacctgcccaagtttatcatggttgacatggagactaataacaggcaaattaagaaaataaaatgtagggaatcaatgaagaactaaatctgtagaaacaaggacacattatgtttcaggggagaaaaatgtgggtataaatgagtaacactaaaacacacctttattaagccattaagtttcaagtattaatggcaaaaaccgcaattacttttgcaccaaattaatataaagatgaaatttttcaggatttggtgagaaaaataaacaagtcacttacaccacaagctcaaaagcagaaacagattatttaatgataaaacaggggattacatggggaaattgtggtaaagggtagaataatcattgatatcatttaagtatagatggaaattaaacgatcatgagattgaggattacaggaagtaaatattgtaaattttgacaacatacaaaattattattaaaaatgttgagagaatcttgataatggaagattgaattgctcaactctctttttagacattgaactagaaggctgtgtagaatagaatgactaaaaacagactttaaaacttacaaatcaccaaggggaaaacatgtatgtaacacataaagaggcaatccatgtagaagcttaaaaacaaaagaaacattacatttagaatgtaaaacataagaagttgattgcatttgttatatcaatgaatatgaatgtttagtacttgttaagataatgatatatatgtaatataaatgagaacaatactcatatattgagttactacatgaaaaaagaaatcccatctatatactatatacaagaaataattctaaagatgttactcattgaattaaaagtgaacaataaggtaaacagttaaatgctaacaaaaataaaactaaaattcataatactactttcagactattaaatccaagccaagaaaagggctaagtgagatgaaaaaactcagtgtatgataaaagttgcaattcacaatgtgactataattgtataaatctttatggtctaaataacatatctaaaatgaagtaaaataaaaagttttcagctgcaggaaatgcaaagagaatttaacaaaatatggtggtggtaagagatgttaattcatcatgtcagccattaaaagattacgtagaaaaaaaattagttgcaatttaaagggtctgaataaaatcgataaaaagttaaagcaaatgtagatgtagaaatagataacttgatagccagttggttggatggattgatgaaagaatgaattatggctatttctagagaatcactttattgcaataccttaggccatacacggaaatgaaacatatattagacctcaaagaaaacttttatatagcccaaaaaggtaaaataatatgaactacctcactggccaatatataataaaactagagcttaatagaaggacaacaaaatccaatcacttaaaaaaaactttcaaataattcttgagttacagaagaaatcaaaagaaaaattataaaagatgaagaaaacaacaaatatttgacaaaatgcaagaccattttgctattacaattgacctagaaaataatattcacggcaattttgaaaaagaaaagtaatgagggatgaactaactttatcagattttaaaatacatcaggaagttgcaataattaaaataaattggtactggagaagagcaaaataaaggggccacccatagatttgcatatttgtaacattaatttgtgataatagtattattttttaaataactgagaaaagagaaccttcagtaaataatgtggaatagctggctaattgttgcagaaaaggataaacctgtatccctatcttaatttctaccttaaaataaattccagatggaagaaagtattaaatatatttttaaaagcctgaaacaattgttcttcaaaagttttgctaaatgtacttagaatcttggcagagggaagtgctataaaaaggatttaagactcaaaatttataaagaaaagatcaataaacttcacaacattaaacatattagaaaacaaactttgaggagaaaacagtatgagaaaggacaaaagactaatgatagactggagaaaattatttgcataaatatcaacattaatttttcttaatttttaaatctcatagacaaaaacaaccaacctcctagaaaaatatgaacagttcatttgtaaacaaagaaaaatcactgggtatttaaacataaattgttggtaagtctcatacagaaatagaagaaaaacacataaatataaatcatagggaaaatctaatatttatacccacattgtttggcaaataattaaacctggaaatttccagagtggatatattgataaaggactctcaattctgaggatataaaatatggtgaactatcttgtgaagtttcagaatatttatcagaaattttggtcatactgtttgaccaaaaatgttttcactgagaggaatttaccctcagcaaatacttggagaagttcaccaacatgtttgtacaatgatgttcattccagctttatttatacaccctctccttctgacacacaattgaaaacaatggtaggattcgttaatatgagactgtttaaataacacaatatgatgaagaattatgaaaatcttttaaaattaactgtttttactgaaagggaaatagctgtagtatatacaattatattaatacttttaaataatcttttttttttttttttttttttgagacagagtctcgctgtcgcagaggctggagtgcagtggtgccatctcagctcactgcaagctctgcctcccgggtcacgccattctcctgcctcagcctcccgcgtagctgggaatacaggtgcccgccacctcacctggctaattttttgcatttttagtagagatggtgtttcaccgtgttagctaggatggtctcgatctcctgacctcgtgatcctcccgcctcgcctcccaaagtgctgagattacaggcgtgagccaccgtgcccggctcttttaaataatcttaaaggtcttccaaccttgcccgagccgggcagggtggctcacacctgtaatctcagcactttgggaggccgaggcgggcggatcacgaggtcaggagataaagctctcctcagcaaatgtaaaagaacagaaattataacaaactgtctctcagaccacagtgcaatcaaactagaactcaggattaagaaactcactcaaagccgctcaactacatggaaactgaacaacctgctcctgaatcactactgggtacataacgaaatgaaggcagaaataaagatgttctttgaaaccaatgagaacacagacacaacataccagaatctctgggacacattcaaagcagtgtgtagagggaaatttatagcactaaatgcccacaagagaaagcaggaaagatccaaaattaacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccagttgctggttttttgaaaggatcaacaaaattgatagaccgctagcaagactaataaaaaaagagagaagaatcaaatagacacaataaaaaatgataaaggggatatcaccaccgatcccacagaaatacaaactaccatcagagaatactacaagcacctctacgcaaataaactagaaaatctagaagaaatggataaattcctcgacacatacaccctcccaagactaaagcaggaagaagttgaatctctgaatagaccaataacaggctctgaaattgtggcaataatcaataacttaccaaccaaaaagagtccaggaccagatggattcacagccgaattctaccagaggtacaaggaggagctggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaagcgaatccagcagcacatgaaaaagcttatccaccatgatcaagtgggcttcatccctgggatgcaaggctggttcaatatacgcaaatcaataaatgtaatccagcatataaacagaaccaaagacaaaagccacgtgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtaccaaaatcacaagcattcttatacaccaaaaacagacaaacagccaaatcatgagtgaactcccattcacaattgcttcaaagagaataacatacctaggaatccaacttacaagggatgtgaaggacctcttcaaggagaactaccaaccactgctcaatgaaataaaagaggatacaaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcatgctacctgacttcaaactatactacaaggctacagtaaccaaaacagcatggtactggtaccaaaacagacatatagatcagtggaacagaacagagccctcagaaataatgccgcatatctacaactatctgatctttgacaaacctgagaaaaacgagcaatggggaaaggattccctttttaataaatggtgctgggaaaactggctagccatatgtagaaagctgaaactggatcccttctttacaccttttacaaaaattaattcaagatggattaaagacttaaatgttagacctaaaaccataaaaaccctggaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccgtcagaatgaacaggcaacctacagaatgggagaaaattttcgcaacctactcatctttcaaagggctaatatccagaatctacaatgaactcaaacaaatttacaagaaaaaaacaaccccatcaaaaagtgggcaaagaatatgaacagacaattctcaaaagaagacatttatgcagccaaaagacacatgaaaaaatgctcatcatcactggccatcagagaaatacaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactgtaaatcatgctgctataaagacacatgcacacgtatgtttattgcggcactattcacgatagcaaagacttggaaccaacccagatgtccaacaatgatagactgcattaagaaaatgtggcacatatacaccatggaatactatgcagccataaaaaatgatgagttcatgtcttttgtagggacatggatgaaattggaaatcatcattctcagtaaactatcgcaaggacaaaaaaccaaacaccgcatgttctcactcataggtgggaattgaacaatgagaacacatggacacaggaaagggaacatcacactctggggactgttgtggggtggggggaggggggagggatagcattaggagatatacctaatgctacatgatgagttaatgggtgcagcacaccagcatgtcacatgtatacatatgtaactaacctgcactttgtgcacatgtaccctaaaacttaaagtataataataataaaaaaaaataataatcttaaaggtaaggtacagaagtgttaagtttttaaaaatatgcacatttagatagatttattgctacattaatcaatctttttctccccctttccagaaggaaacagaagtaaaattaaatagtgcctgcctttggaaaaagatggggttagttgagtgagagagaattctactcttcattttgctcctttctgtagtgttccagttatctaatccttccacatatcagctgaagttttctaagcagtagttatttttagtttacttccatatatttttaaataccaaactaatcaatattgactgacaatatcaatcagttagtaaaataattgagtaacccctgtttttatatattctgatatgagatgaaaatttaggaactctatcaattttaatacttctgtagagagtttttgcatatgtatattcactattaatacacagaagattcctaagttcaggctgattcctttaaagtgtctgttttacccccacaagaattgaaatagtttcagtatattttgttttataaatatttaacttctgtttgctgaggttgagaaaggcaatattccacaagggtccattttctaaatctaaggcatgaatgattttttcatagttacagtatttatgaaatattgagaatttatgcatgtgaaatgtctcataatggactattttagatttaagctattctttttttaggtctccagtgtaaaattcaaagagtagaagctatagcaaatgaatatgctgcgtttcttgtgctataggctccttaatctttacagaagtcttatttgctcagctagattggtctaaaagaaatggtttaattttctctcaaataattcaaccttcaaaaagaaaccttccatgttgttatttttgcacttgtagtgcatactgggggtgctctgccagcttggcattgaatgtgtttgttttatgtagagtgtggtattaaagtagtggctgaattacttgacataatttgcataaagtcatatctcagtgataaaaattaatgtgttgagggctgtgagtgagttggaatgagtcatttatttcttaatagaaaaaagctttatcttcagtttctatcacacttgaacttcaattacctggaatattttcatttgtttgtttattcgcatttacttaagtgttaatgattattcagtggtttcagcaggagagtgttttaggtctgtctttaacctgagtctaatcatagaaggagttggcacgtatcagaattgtaccgtaaaagcacccctaaagcttgacaatgttctagtgattccattagcagctattaaatggaggtttaatgtctttgccatttggggatctgacagactgaaacttagtattcgttttggcccctgtgaatatcatctgctcatccatgcttataaaaatgaaataaaaagtcagtctttgttcttgctcttgcagaagcaattgtagatttttatgaggaaaacaatgaacatgtcaccctggatttggcagcagggaagagcagggagtatataaattgtctttttgggtgccaactgttttgcaccagcattgtttatattagtgaaatggttgtaagtcgtgtaaattgtatttttttccttagctatgttttatggtgggggggtgtcgtaggggaatgtgcattaaatctgaaatggtctcatgcttaaataccgcagtgtggtagacagttaatcttcagaacaaatagtgaacatgcgtaactgctttattgccgtcaacatatgtcactctgtaattatcctggcttataccttgggatgggctaaggatgcaggagctgtctcagctcagagaattttgttttcattttttgggttccaaacagaatgtattgggagaaaaaaaaatcatgtggatttgcccaatattggtgctcgtaaaaacaattaccctgaaattattagtgctgtatgttcaggacctaggagagcaggtgttgggtaagtctgactaaacagatgtgtcaatacaccttggctcatctgagactgtttgggaaaattcttgaggaggctcacgacaccacacatagtcatttccagttacctggtggtgacatgcacaagtggcatatagagactgggttgcagctgaccttctggtgaccagggaatacctccagagagactgcgatgcagttcgcaactgaaaaaagagccacttgaatactgatccttgatgatgggtatcgccattgaggcagcaagcccaactgtttatcttttttcttatttggtaactaggtgggatggttgtatagaaaaatgtgggtgggaatgaccacagaccgcaaactcacgtttgcaagaaatgtagctgtaattttctgtagattttacccatgtcgtcctctatacatagagagatcatacatccaggtttgcccagaagagtccagggttatgacttgtcctgaccctcctttttccctcccaagagtttcccagtcatgccagcataagaacttttccctgagttcgttatgatggaagaaccttgctgcttcaacggagagagccatggggatttaaaatacacagagaaaggcctatcagtacattataatatcatttccttcaaagtattcaaaatttccttagtctgtctctagttctccaaagggtgtatgtaatattataatatgtataaccgagatgaaaattgttggccagtggagcagcaagcatatttcttggataatgtagtgctttatttgggaggacttgatatcctttggggaggctcattgattttatgagatcattagtttacttattattcaataaatttaactcctctacactcaaacctgtagtaaaatatgttttgtgactgtgatgttctcttttcagaagtgaggctgggctggcaatagctggctggaacatggtctgggaaggaaatgggtgaggtcaaaagtggtgagacaagttgctgaagaacaggaatctgctatgcgaaagaatcagagtgctcccttagggaccttaatttaggggtcttgaaatatatcacactctcccaaaactaattcatgcttcaactgccctcattaatcataagtcagttgtgaaagaccataatgacagtaactgcctacgtggatcacattttgtaaaccaggttttagtcgcagtatgcaccatactgaccaaatttgtgtccatgtaaatcactgttcacatccatccagattccatttacatgcattcaggcactagcatacatacatatagatatacatgtgtttgcataaggagtgcatatagttatatatctgcatatagaatttacatgcatacaggcactagcatacatacatatagatatacatgtgtttgcataaggagtgcatgtggttatatatctgcatatagaatttacatgcatacaggcactagcatacatccatatagatatacatgtgtttgcataaggagtgcatatagttatatatctgcatgtagaatttacatgcattcaggcactagcatacatacatatagatatacacgtgtttgcataaggagtgcatatagttatatatctgcatatagaatttacatgcattcaggtactcgcatacatacatatagatatacacgtgtttgcataaggagtgcatatagctacgtatctgcatgtagagaagtatctttgaaatcaagtgatctggctccataactgtccttccatgcacacagcttgcctcctctcctgcccttaaattggggctgggaagggactacctgcctctctctgattccaagtgacctcagaaagtacacctgctcttcacattcacatgtttaattcgtacctttctaatgcctggaggtgatttggatatctggatgattttttccctttttctttcctacttcttcagaataaaccacttcttaatattctttgccacttttgtttcaatgctgccagaaggattttcttaaatcacaggcctaatacttttatttcagtttcccagaaacttttgctagatccttactgtgtgaaaaatgaatgcctcatagcatggcattcaagggccactctgatctgacctgcagtttcttgcctcccttttgcatcatctctgccaggaaacccagatcgagcttgtgcttcccaagtcttgatgcttctccatggtcttcttgtgttctccgcttctttaaggttcacctgaaatgcagcgttctaccaagcattggccagttctcataatcagtttttcttttctgtgagcatagtggatttttatcatttgagcataaccctatcaatgtcttgaattatgactgtgtgcatacctgtagtacctgttaattataaactcctagaaggcagaagacatgtctttttattctttgtgtctctcctagcatctaacgcaatacctggtaactactaagactcaataaatacatgcaaagtgaagacaaaaattaattccaagctaaaaaatgttgctaaaactttgaaaagactccttgttgaggatcaaaggtttttgataatggcaaatgcctagataaccagtatttctcaaagtaaagccccaaaattaccaaccaatcgttctgtccacaggttacctatcatttaaaagaaaaatatttgttcatatatatacattcaaaatttttggaagtttgaaatgtaagtttagttatggttttcataggcatttttttgttattttccatttttactacttttatttttttattattatactttaagttctagggtacatgtgcacaacgtgcagatttgttacatatgtatacatgtgccatgttggtgtgctgcacccattaactcgtcatttacattaggtgtatctcctaatgctatccctcctccctccccccaccccatgacaggccccggtgtgtgatgttccccaccctgtgcccgagtgttctcattgttcagttcccacctatgagtgagaacacgtggtgtttggtattctgtccttgtgatagtttgctgagaatgatggtttccagcttcatccatgtccctacaaacgacatgaactcatcattttttatggctgcatagtattccatggtatatatgtgccacattttcttaatccagtctatcattgatggccatttgggttggttccaagtctttgctattgtgaatactgctgcaataaacatatgtgtgcatgtgtctttatagcagcatgatttataatcctttgggtatatacccagtaatgggatggctgggtcaaatggtatttctagttctagatccctgtgaggaatctacactgtcttccacaatggttgaactggtttacagtcccaccaacagtgtaaaagtgttcccacttctccacatcctctccagcacctgttgtttcctgactttttaatgattgccattctaactggtgtgagatggtatctcattttggttttgatttatatttctctgatggccagtgatgatgagcatttttttcatgtgtgttggctgcataaatgtcttcttttgagaagtgtctgttcatatcctttgcccaagttttgatggggttgtttgatttttttcttgtaaatttgcttaagttctttgtagattctggatattagccctttgtcagatgagtagattgtaaaaatttgttcccattctgtaggttgcctgttcactctgatggtagtttcttttgctgtgcagaagctctttagtttaattagatcccatttgtctattttggcttttgttgccattgcttttggtgttttagacatgaagtccttgcccatgccttcataggcatttttttttaatcttgttaagtactattatgctctccaaggctatgaaaacattgcaaagtgttggccatgctgtctcagcaaatattcagttaatggtgcacttcccccaaaatatatgatttcctgtagttttttctaattatttatatctgttaatttttttcttttttattgttagtattttgatgaatcatattctcgattcacaataagcagatcaccagcacaaaaacattcactagagaaggggtgttcaatcttttggcttccctgggccacgtagaaagaactctcttgagccacacataaaataccctaacactaacgatcgctgatgagctaaaaaaaaaaaaatcgcaaaaaaaaaaaaacctcataatattttaagaaagtttacaaatttgtgttgtgctgcattaaaagccatcctgggcctcatgtgggtcgtgggccgcgggttggacggtgccaaagcatgaatgttgtgattacagtagtaatataaatactacaattcatgtatatatttttaattttaatatagagacatcatgttgtccaggctggtctcaaacttctgggctcaagcaatcctcctccctcgacctcccaaactgttagaattaaatgaaccactgcacctggcctacaattcaaattaatgtaaaaactgcaagtggttggtgatcaaaactccaatgcacatgtagactataatttgttcatgtcaggatagtgtgatgggtttactcaagcagccacaaaagaaaagtttgaatcagaaataagatgtgaatgatttttatattttattttatattttttaccccttatccaattataatacatttgtcacatagtgactttgaaactttgaaacgttcttccagttttcaaacaaaacacaatgacctttttgttgaactgattaagtttctctggaaagtaagataatactttccccatcaacattaatgtattttgttgcaaaaggtggggaaatcaccaaagtcataagagcataattcaactttgcactctttgttaaaaataatcaggtaaatgtcacactatgactgagatggtggtaaaataagccaaaagtttaatgacaaatgttatgtccagcggggaaacatgatgaacttttggcaacatttctgaaccaaatggacacccctggaatctgccagcactggaaaagcggttgctgtcctggaagagtggttctatattctgttctatagtacttactatgcttactatagtactatatactatacttactatatactatataccatacttactatagtacttactatagagcacagtacagaagaacgggctgtataaatcagcatttggcacttgtgtggtacatatatgagggagtggtgcctggcaactgtttgccttacttgttattggaaatccaaactctagcaatgaaagttatttttaactcagtaaatggttatcttggagtctgtgatgtagcctagaaaacataccccggggtgaaggctgatggagcacagccatatgtgcaacaaggaaattctcacactgctgtattcacagatgacatttggtggtcaacgctatgcttcctcatactgatttggtggtgaaagaaatactcaaaaaattatagccatagatgtaagtctttgggatttattttctgggtttcaaggataaatttctgcttttccaaattgaagttcatcagggagtagagaaaaaatgaattactctatttttttttgaaaaaggcatgtttttcatacgacaccaataatacaaataaaggccacttttatttgtatcagttattcaagtgacaccctcagcaatgtatttgatgtctgaataatctgaacccttcttttctgggcagaaacattttattccaaagacatctaaatatttgaaagaaataccaaacatttgccactgttcttaatgacaattaattttaaatagggcttctctagtacagtacaaataaagactaagaaaagaaacaagttgggatgtgaaactggaagcctctgggagtaaccattaccacgacatttaaattgtgactgaaaatgtgcaaataacaggttctctttaactgataagaaatgatttttaatttaaaaaaattttatataaatttgtttttaatgtttaaaaattttacctaaaagatgatgtttgcatttctgcctaatgttcattaagtgggttttaagtagtgaaaaattgaagaaacaccaccattgatatgaaagtggtgactagttttgaaaaatttcaaaaaaattgtttataataaatgctttcaggcataaacatattaatagtataaatatgtacaaatatgtactcactagcaacaatgtaattaagtacagataatataatttatgatttaaaacatttaaaatttatttgttacatttattcccaatctttgagctttcaatctcatacagctttgatacattctgcaacttgcaaaaataattttcggttgtttcataaattgataatgtcttctatataagtattttctgctctttgtttaatctttctcttgaggcatctattttgatttttcctattttctcatgaagaatgaaatgctttagtgatacggaatataggatttctagaaatcttggtaattactgaaatctttgcatcatacggagtatctgtgttgagtgttctgatccttatttatttacttttggtaactatcattgtagtagtgaaaatggaaatcagggccttgttttcttgtcttaattcttggcttctcagttttacagacagtaaagagatcaaataaagtaacatactatttgtccaatgtaaagctaattttatcatattttgcttctagaaattcagaattcacccaaagtagcacaattagagcagggcgtagtagagcaagatctcctcaactttcctcatatttcgttgactgagacatgttgtgatcaaagaatagatttcatcaaagaagtctttttgttttttacattttccatctcttttcctgactcctttatatgacgaacttcatctgtacacctgacttttcattcctatattttagaaaagtaatagcttctgggagagaagagaggaaaggaaaatgatcttttgttttggaaccatgaaagaccaagatgaggcattctgagatgccaatttcatgaatttgtctttgagaagacaagcaaaaagtgatagtaagctgttctttagcatagaaatttgtttctggttttgtcatcatgattaatcattctgatttgcagccttacttgtttcaatcattgaggccccattttaatgtgattaacatttttgttccatttatggagcagtactggcccctaatttttgagaacaggataacccttgattggccttatgtaaataaatcgtaacttaatgcccttgaaattggagtatcccccaggagaacaagctgtaaatcagagtagaaaaaagtgagccttaccctgggggcgggagctccacatggcatattcaagatgaaccaaatgcctttatttcagaattttaattcatggtactttttccttttcaaatggtgctgtcatcttgaaatgacagagattgagtgctaaattgctattgcataattttccttatctctcatctatagactggatttgattgaaagttcagattttgtgaagaatgttttacataggaaattttgaaatatggggaaacattatttttacataaaggaaaggagaactctgtgtgtgtaaaacggagttagcattttttttttttttttacccagccagggtctttgtgtaattataagcaaatagctattatcattccaacagattttttttcctctttgattctttctagcaatctctctctctatgtagcttcttatccctttttgtgccttaaaattattatgctattttttaatagtaaagaggctgaaacaatgtcctggaatccatatccagtggtgacaggagactaatcattgcctctgtctgagttatttgaaaatgggtccacactttcatgtgcgtccgtgtgaacagaccaccaaacaggctttgtgtgagcaacaagactgtttatttcacctgggtgcaggcgggctgagtctgaaaagagagtcagtgaagggagctaggggtggggccattttataggatttgggtaggtaaaggaaaaaggggggttgttctctggcaggcaggagtaggggtcacaaggtgctcagtaggggagcttttgagccaggatgagccaggataaggaatttcacaagataatgtcatcagttaaggcaggaaccggccatctctatgtgtatgtgcaggtcacaggggatatgatggcttagcttgggctcagaggcctgacattcctgtcttcttatattaataagaaaaataaaatgaaatagtggtaaagtgttgggatggtgaaaatttttggggggtggtatggagagagaatgggcgatgtttctcagggctgcttcgagcgggattaggggcggtgtgggagcctagagtgggagagattaagctgaaggaagattttgtggtaagggatgacattgtggggggttgttagaagaaacatttgtcatgtagaattattggtgatggcctggataccgttttgtatgaattgaaaaactaaacggaataagagaaggagaaaaacaggtattaaaggactaagaattgggaggacctaggacatctaattagagagtgcttaaggaggttcagcatagccttgccagcaaagattatttatttactttaagagttaggagtggcggtttggggatagcatcaggaggtatcagctgtgatggcttggaaaaacagtgtaaactggcactgtaaacaagagcagggcatgtatgagtagttgagaatggtgaataggagtatgactagacagaaaacagcacagatgacaagttttttggggcgcagtccaagttggtctggtgtctgggatgagactggggcctgataaaaaggagtgtctatacaggagctcaaatgggccgtaccctgtagcattctgaggacaggcctgacttctgagaagggaaagtggtaaaagtattgtccagtcctttttaagttggtggctgagcttggtgaggtgtgtttttaaaagacttttagtctgttctactttccctgaagactgaggaccgtaagggatgtaaaggtttcactgaatactaagagcctgaaaaactgcgtggctgttttgactaataaaggctggtctgttatcagactgtatagaggtgggaaggctaaactgaggaattacgtctgacagaagggaagaagtgattgcagtggccttctcagaccctgtaggaaaggcctctacctatctagtgaaagtgtctacctagactaagaggtattttagttatttgacttggggcatgttgagtaaagctaatttgccagtcctgggtggaggcaaatccttgagcttggtgtgtagggaagggagggggcctgaataatccctgaggagtagtagaatagcagatggaacactgagaagttatttccttgaggatagatttccacgatgcaaaggaaatgagaggttctaagaggtgggctagtggcttgtactatagcatagcctgcctttgctggtgtgtggcgattaggcctggtggagctgccatcagtaaaccaagtgtgatcagggtgaggaacaggaaagaaggaaatgtggggaaatggagtaaatgtcaggtggatcagagagatgcagtcataggggtcaggtgtggtatctggaataatgtgggaggtcggattgaagtccgggccaggaacaatggtaattatgggagactcaacaaagagtgagtacagctgaaggagccagggagcagaaagtatatgcgtcaggtgtgaggaagaaaatagattttggaagttatgagagctgtagagagtgagttgagcgtagtttgtgattttaagggcctctaaaagtattagggcggcagcagctgctgcacggagacatgatggccagcctaaaacagtaaggtcaagttgtttggacaaagaagctacaggacgcaatcccggtccttgtgtaagaattctgactgcacagccctgcacttcggctgtgtgtaatgaaaagggttgggatgagtcaggaagagctagggtggggacagtctctaaagctgtcttcaaggaatggaaagatgagtggggaaaggatttaggatctatggggtcagctaggtttccttttgtgagtttatgtaatggttttgttaggatggcaaaaccaggtatccaaaggcaaaagtatccaaccatgcccaggaaggaaaggagttgttgttttgtagaaggtgctgtagtttgagagatcagttggacactatcggcagggagagcacatgtgtttttatgagaattatgccaagataggtaacagatgaggaagaaatttgggcttgactgaagtgatggaggctatctgtgagggcttgcagcagtacagcccaggtaatttgctgagcctgatgggtgtcagggtcagtacaagtgaaagcgaagagaggctgggacgaggggtgtaggggaatagtgaaaaaagcatttttaagatcaagaacagaatagtgagttgtggaggaaggtattgaggacaaaagagtgtacaggttgggcaccacagggtggataggcaaagcaatttggttgataaggcacagatcctgaactaatctgtaagacttgtccggtttttggacaggtaaaatgggggaattgtaaggagaatttataggttttagaagcccatgctgtagcaggcgagtgataacaggctttaatccttttaaagcatgctgtgggatggggtattggcattgagcgaggtaagggtgattaggttttaatgggatggtaagggatgcatgatcagttgccaaggagggagtagaggtatcctatacttgtgggttaaggtggggggatacaagaggaggatgcaaaggaggctttggattgggaagaagggcggcaatgagatgtggctgtagtccaggaatagtcagggaagcagaatgtttagttaaagtgtctcggcctaataagggaactgagcaggtggggataactaaaaaggagtgcttaaaagagtgttgtctaagttggcaccagagttggggagttttaagaggtttagaagcctggctgtcaatacccacaacagttatggaggcaagggaaacaggcccttgaaaagaaggtaatgtggcgtgggtagcctccatattgattaagaaggggacggacttaccctccactgtgagagttacctaaagctcggcgtccacgatggtctacagggcttccgaggcgatcaggcagtgtcagtcttcagctgctaagccgagaagatctgggaaggagtcagtcagagagccttgggccagagttccagggggctctgggagtggctgccaggtgagttggacagtccaattttcagtggggtcccacagagatgggacgcggcttacgaggaatcccaggctgcaggcattccttggcccgatggccagatttccagcacttgtagcaagctcctgggggaggaggttctggaggaatgcctggctgctgcggttcaggcgtttggaagttcttgtgtgctggagatgtggctggggtttgtctcacagtggaggcaaggaattgcaactcagaaatatattgctacttggctgtctctactctattattgtacaccttgaaggtgaggttaattaagtctggttgtggggtttgagggccggaatttaatttttggagttttatttaatgtcgggagcagattgggtaataaaatgtatattaagaataagacggccttttcaccttttagggtctagggctgtaaagcatctcagagttgctgccaaatgagccatgaactgggctggatttttatatttgatgaaaaagagcctaaacactctctgatttgggataaaggaaaaggagcattaaccttgactatgtctttagctctagccacctttttaagagtaaattgctgggcaggttggggagggctagtcatggaacgaaactgtaagctggaccgggtgtgaggagggaaggtgataaaagtattatagggtggaggagtggaggctaaggaagaattgggacctagctctgcctggcgaggaggggaggggtcagatgggtctgtagaagaggaagattagaaagactcagcgacgcttggggttgggactgaggggacaggtgggagggaaagaaggaagatttgggatgagttgcattgggaacagagactagggagggaccgatgtgtaaaagaatgcctggacgtcaggcatctcagaccatttgtccattttacgacaagaattatttagatcttgtaggatggaaaaattgaaagtgccgttttccggctatttggaaccactgtcaagtttgtattggggtcaagcggcattgcaggagaaaataagatgcttagattttagatcaggtgagagttgaagaggttttaagttcttaagaacgcaggctaagggagaaggaggaatggaaggtgaaagcttgcccatagtgaaggaggcaagcccagagaaaagagagtagagacacggagaagaggtgggggttcttgccctccagaaaagcagagaaggggtttggggcatggaaataaggggttggggcacagagataagaggttgggggcgtggaaataagggattggggcacagagataagaggttagggcatggaaataagggatcggggcacagagataagaggtcagggttcctgcccctcccctagaaaagtgggacttgccactaagggtgaaggtgaaggggttgaggggttcttgcctctcccccagaaaagcggagaaggggtagagacacagagaaggggttggggttcttgcccctcccccagaaaagtgggacttgccgctaagggtgaaggaccaaagcaggcgtccctgcgtggactgacacctctgaaacctgggtgaataatcagagaggcatccctgcaatgattaaacaccaagggaaggctgccttccctagtccatgactggcactggagttttgggtccacggataaaacgtgtctcctttgtctctaccagaaaatgaaaggaattgaaattaagagaagggagagattgaagtgtggtgccaagattgaaaggagaaagaggttgagggatagtgagagaggttggagaagagagtaaaaagaggccgcttaccggatttgaaattggtaagatgtttcttgggctggtcagtctgaggacctgaggtcgtaggtggatctttctcatggagcaaagagcaggaggacaggggattgatctcccaagggaggtcccccagttcgagtcacggcaccaaatttcatgtgtgtccatgtgaagagaccaccaaacaggctttgtgtgagcaacgaggctatttatttcacctgggtgcaggcgggctgagtctgaaaagagagtcagtgaagggagctaggggtggggctattttataggatttgggtaggtaaatgaaaaaggggggttgttctctggcaggcaggagtaggggtcacaaggtgctcagtaggggagcttttgagccaggatgagccaggataaggaatttcacaagataatgtcatcagctaaggcaggaactggccatctggatgtgtatgtgcaggtcacaggggatatgatggcttagcttgggctcagaggcctgacacacactatagcagttcccatgaaaattagtgtaacttcctagataaataaggtatgaactcacaaggaattgtcatagaacaataagatgattccacatgacaacatggacctgtctcataagcataatgttgaatgaatgaagccagatatggaatacatactgaatgattccaattatgtgaagccttaaaacaaagaaaaataatctatgtagtcagaaatcagaattttagggtagtgtctctattgggtgagtagggcctggaaagcatatggagggcttctggggcattggtcacatcttgtttctttatctgtgtgctggttgcaagaatgtgttcagtttgtggaaacccatggagctgtatacttaagtgtatttttccagaaggattttttatactttgacagaatgttcaaaggatgtcctcttactgtgaacaacacaaatgattggagttataatgacacccttgctgtttgagggtgcatttttcaaaggattttagtcacagattcccatgttcactgaagctcaatagactatcccctacctgatgacaagtaatttgcttctttctttagtcctgcttttacctctggccatgaagaatcctgctttccactggtgagttcagaaatttctagcagcgatatttcttcagcccaaagtaaatatcctaggacatggaagaagcagtatagcccctgccacactctgactcatcttatccctgcaactcagttttctcattcctcaccgtcacttgcaggtatgaactggcaggaacctttccacagattttccagtgtctaatacaccatctaagaggtaaatagcctgactggagagaagctgacagtgggcagaaaggtctggcttatccaactggatgaaagctctctacctactttgggcagatgagtcacatgacattagcactttaaagacagagttagctatgccacttgtcttggttagctcgggctactataacaaagtaccataaactgggtgacttataaacaacaggcatttattcctcacagttctggagtctgttagtttgagatcaaggtgccagcaagctcaagttctagtgaccccctcttccactttacagatcccgtcttgttgcatcctcacaaggtgagaagagagtgagagagttctctagggctctctgttactggagcactaagcccattcataagggctccaccctcagggctcgatcacttcccaaaggctccacctcctaatatcacattggggcttaggattgcagcacatgaattttgggggaacacaaacattcagtccattgcatcactctcaaaagtaaagaggcttcttatataggaaagcattttcagtctttagaaatcataaagtaaatggttcacttgagtgaggcaagatgatcagtggggaaaagagtgagatctgtagccagactccctaggttcttattatggctgaaatctaggctgaatgggttaaaagtttatgtccttgtgtttcttcaatttaaaaaaaatgaaataagaaaaataatagcaacagataataaggatatagaagaactcaccttgtttaggttactgggggttatattaagaactcaaaatggtaactgttgctagtatatagtgtagagtcctctattcatggtagataatcaatagatgttgcctaatgagtataatttgtcagatgattctgatcttgtgggcacccctctttccctacagaaaactcttcaaactcacatagactttaggctgcaatcctgtctgccatgcagtttgctctcatctggcccttgcctcccttccagcctcatttctcactgctctctcttgccctttatactctagtgggacccacaggcttggagcatccctaacaatctgtctgattctccatgactttccttagcctgccccctccacctgaactgcccaccctgctactctttacttgagaaacttctctcttcctttcctttcttcagattcatcttcttcaggaacttactgactcttcctagtgatgtcaggctgagtgaggtgagccccttttgagattccattgtgctggagcataatctctgagcctatcatgtatctctctttcttcattagaacaggagctccctgagtgtaggaacagtggttttatcaccatgggatccctaatacttaaaagagttcttgttattaatctatcgaatgaataactgaaccaacaaataaatgacaaaaaagagacataggtggtgatcttccttagaactataatctctgtatttatatctagcattttcatttagaacatgaggaatagaaaaaaaaaaacataaaatgacccaatggcttttagtgtgtctcagttttaattttgcaaatctggtgctttgcttctatgagttaccagcaatgctagtcaactctgagtcagacatcctggtgtgtgggttttaaataatgcatttcctttacccttaggtggtaaggtgtgacatttgctgctttgataaaatctccagatgatggtacttacacaggtgcaataaggtccaagttgttaaccttatctcacttgcaaatctgcaatttcctttttcctcaccttctttttgagatgtgactaaagaagtgatggcaaggatgtgaaggattaggcaagagacatcctgggttgggagactgcattctatagtaaaaatcctttgtcctttatttcccaggttgaccatcagggtaatactactagctcattgctcagcttttcactttgctttgattggaagtcatcagtgacttagaaaaaaaagctttaaaaatgcaaaattattacttttcatcttagtaatagaagcagtagctttcttaatggtaatccactttttttccccctttggttttctttttagcaaagattggtcactgttgacttatctctcatttacttataataggtatcatgtatccccttgactcaccccaatttaagacactctctgataaaacctgtagtgctttgcaccttcaagttaattacccaagtatccctttctaccagatctcctaccctaagctcatcctatacagtatttctggaacaaccaccctaggcctgggtgattcatttcagctttcttcctccctttccaggagaggggaatagagtgcctgggggagagaatgggaagtcaagggtcttcagaggaaataagtggtttcctgatctgcttcttttccttctcattccttcctcttagcagaccctcagaaaacctggatttgactcaatagaaatacctgtattagccaagccatttatacaaatgatttttccccatgcttttctctggaccctggcagcaaaattaaactttaaaagtaaaaagttttaaatttcatcattaaatctgtatcacattaactttttcctgttgtgagcttttatgtgatttcagcgctaagctggtcaaatatgttacaatttcctagtccattactgttatctttcaccactatttagtcacattttgaaaaagttgacttagtcagatctggcttctctaataaaatgccacagactgggtggcttaaacaatggacatttatttttcagggttctggaggctgggaagtccaagactaagatgccaacagtctcagcggcttgtgaggaacggctctctggaattggagacagcctccttctctttgtgcactcacaatgccttttctctgatgcatgctctcagagagaagggcactaatcctatcatgagggtcatgctttcatgacctcatctaaatctaattaaccacccccccccacctcccccccccccggccacccaggcttcacctctaaataccatcacatcaggggctggagctttgacatatgaatttagggaagacacaggcattcagccataaaaatggttatgtgaacctgttgtgtttctgctgttaacattgcatggtcctttcatttagtaagtgtgttttgattagttgcttcttttgcaggtgtgtgttttgattatttgttctctttctataagctcaacagctagtgttgactaatagcatttaagttagtgtcctgaatagtttccaactgacccctaatccacacttcatcccttgacacactgacctctatgaattgtatcacctgggctaccccagccaatggtgggcactggcaggaaatctgagtacaggacaagagagaggtcaaggtgtttattattgtacctgcagatgctggttagtggtggctgtatccctcttcagaagtagccctctttcccagccatatttctcactgggctctaatcaccactttctcccattgccctgtcaggcccacaggtggccaaggctccccattgctgtgaacctcagggtgctttatcattttacaactttgaaaatagccccttcattaaattctcttcagttaccccttggagtgtggcaactctccctgtgcccccaccacccctcccattagcaacacataatgtgtagttcccattatgaaataaatggaggtgttttatcactttattttgaatcacgccaagctcccttggcagtgacacataataggggatattctccacctttgtggaaatggcttcaaatggatatgtttttgaaacgtggctttcaacttgcaggtttcttttctaaaactcttcaaataggcatctcttcctctttgttaaaagtaattcaaatgataagacagtaattatgattgtaataataccaatagcagtagtaataataatagcaatcagcattcgcagtttagaaaatgtttttgcatatgtgtttcccatcttatccccacaaaatcctccagtgatagttaacatttttttcctgattttacaggtgagaaaattgaataccacagagaaactctgttcttttcacacacctcaaaatttagtaaaaggcaggctaaattcaaatagggtctttcaagtacaaatcttttaactctaccacagcagaagtgtgtagtgaaaatagagagattaggaggtcaatgacattatcttcaatttgtgtttgtgctgagttcatttcaatagatgtccttggccctttgtcacctgtttgcaaagcaaatgaaaatctcatactcagttccggcaatattagtcattttcttgaaggatagctactggtttgtctgttttcctgagtccataattcagaaatcctatgaaaagatcattaacttgttgagtagactgcaaaatagacactaatggaatataaagtaattcaagagctttgacgtctcagttacaggatgacaaggagttatgtattgaatacacatttatcaccaggaaatctgaagatgttgaccatggttctgttcttttcctttaatctccatttcttgccaatccaatgtatttttctccctcaaatgcataggccagtatctgcaatacattgtgtttctacccacaaagttaaagaggaaatttcttcttcctttttaatatatgtatatagagagattgaatgcaatattcaaactgtacttgtaacataattttattacgtttcaaaccctattaatcatagaatacaaaaaaattcttttctagaatctcatttttctcttatttttcataaaacaaaaagggtaaagccactgggggaaaaatgtgtcttttgttgtataacgaaagtatgacctttaggaaaactcttctcccctattttcttctgatttaggttcattctctgcctttttttccctctctttgtgtgtagtcagttttgtcaaacatatgactctctggaaattttgcagaaataagagttcaatcaagactcttggaattttctatcttggtttttcaaaaatatgcaactctatatgttgatgtagaactagagtgattgaaatatactctttgacagagggtaaagttaagggtaatccactttttttggaagataagaataaaaatatggtttgctttattttgaggaagaccaaatggaaggagcagacaatcatttatttcacaaactctaattatgtaaggagattgattgattggtttttggttgatatgggagaatgattttttttcctgccatgcacagcactgggcagtctagttcccttatcctaagggagtttataatctagtagaggtggtataacacacatacacatgggcacacacacacacgcatgggcacacacacacaataaaaatatgcactattagcctagtaaagtacaagcaaggcactgttggagagcaggagaggaagatgctaaattctcagcgcagtgggagaggttggatcttggggcgtttgagttgactttcccaggaaaatactgaggaaggagaggtatttcaggaaaataaaataaatgagaactgcttagagtgttctcagagactaagcccaatggcttaataggaacaaaatgttcatgacaggtgcaggtaagagttatgttagaaatgtaaatggagacagggcatggaaagtcactgatacccttgtaaagttcaaactgtatttcagagacaattggaaccccttaatatttggccagggtgtgttgaaggtggttgaaaaagatgggacggtgacgataaggaggctcttacaattatccaggagagcattaagaagagaaacccccaagcttgggcactggcagtggaatggagaaagaggatgaatgtaagagagattctggaacaagaaatggtgaactatcatagcgatttgatatgagggcaaaggagctgtagacaacaattccaaagtttcaactaaaaacattgtagaaaccactctattgcaatttcggcaacttttcaagtttgatttatttggagagtatagtagagaacacacattttctgaagaagtactagtcatatttgtcctttgaccctactttttataagacctcctttagtgtcacacctatgaatcatttatttattcaaaaaattaatgacctcctattctatggcaggcataaacaggagaaaaatagacacgatcccatttaccttcacccttccacccatatcctctccccactatctgcccccagtgcttttcagtttggataaggagaaaatatcagtagaaaaactgacttaacccattatatcccttgatctaatagtattttttaaatatgtatttgaaattgggtccatttttttctggatacataaattattagttcctaatctgatctgcaacaatttcaggaaacaattactgaattatctgtgcttaatttgagcagatgatagctaattccatgtgcccagaacctatctttgtaaattattttgattattttttttactagagagatagaagttttgcaggaagttaacatggatcaaggagtggatgacacacacatatgcatgtgcatgcacactgttatacaattgatgaaaatgtcataaggtgtaaggagcagtagaagtttttattagatagttcacctttaaatcctggttttgcctcattgccatgtggattggacatgtcagttcacctctctgagtctcagtttctacatatatacaatgggactaatcttcagctggctgtaacaagaattaaattagataaatctgaaaatgattaacacaactgaggacataatatgctcaataaaaaaatcatttgcaggtcttttgggaatggtacaaactggacctaaatcaagttatattattatagtacgataatttgagttatatttatataatatgaaaattattaataaataattgtaataacatataataatgtaatataatatagtataattaataaaatattacctcctacacactggttaaaagtgttcatgtactattaactctagttaaaatcttcgtgtgtttcttctgatcttagatcaagaggaatctcataatatttgtacatactgcccattctaagtgggctactagtaaatatacaaagaagctgtaataagcatatggcttagtatagaagagaagaaaaaatccagtaaattacgattttcttctaaaaaacaccatctggatgctggttcagctgcattatctcactaatttacattttattttctcaagagacaaaggtatattcaataaaagaagaaaatccagtttagaatgcttgtctctggaacctgtcagctacacttaatttctacgtagatgcagaaatgaggagtttcctcatcaatgtttaaacaaagcatagaattaatcactcaacattcagaagaatcaaagtcaaaatcaaaataagatactttattgaatttatctctccctgcagtttggaatttaatcctgactagaagtcaaaacaaatgcactttttagatgttgataagatgaaaatcaatcaatcgatataggtgttgtattgtattaaaatggcttaatggggttaattaaaaaccatcttagaaataaagaagataaaatacagattactattctaacagtagaagggactaaatatcgtgaagagtcttacagctgaaaactacctagaagctgagtaataacggacatttgaatgacttgctgcgctttcaagaaagtaaaggagatccccaagtttttgtttttgttttgtattgtattgttttttaaaaaggactaggagcagaaagaggagtggtaggagtggtaagtaagagctgaggctcaggatgacttgaaggcattgtgaaaattaatagccataagagaaaatggaagactagaccttgaacctggacaaagatacgtttgaatctgagatgtttgcataaagttagacactaagaaggttatattcgtggtgaaagggtggtccaggaaaaaaatccacctgccagcaaagagagatgtcataaaacctggctatgtccatgactactacaaatggaaaatgaaagtagaactaaaactcagaattcttcttgaggatttgtaactatcgacattgcttctgtggctttgtggttcaaacccttagcacagaaataaaaatgatttcttttttggaactaccctctggcaactgacagaagcaacagtaaatgctgtgtggaggaaacatgcttagataaaataactctcaatacgtatttgtgtatgtagaaaagttatcttttaagagcaagaataaaatagcatgatttcagattaacaaaaactgggtaagtttataatcaacaagttcttcctaatatagcatgcattcagggagaaacacaataattgaaataatatcaaagaggtttataagacaagaaagcttggtgataacaaaggagaaatcaagtgtaaataaacatgactgtataaaataatatgcattaaacattaaatttggcattaaacaaattagatacaacaaataaacagaataccatggcaggtaagctgaaaggtagatgatctaagttaaagcattttaaagcccttatattgtttacaaggagattaaaataatctgtaaagtctagtaaacactgaaactataacatgaattttaagtttgaattgaacagaatagggtcagggataatcagtgaatccaaagaaaagacataagactggaaaaaagagaaaataaaaatgaaaagacatatagtttagctacctcaattatcaccataagcataaaaagactaatttccctggttaaaatacagagattatcagaagattaaactattcaggaaaaaaaaagaactttatactatttacaagatttgtcagaaatactatttaaaaagatatgatgttattagacaatcaaagattgatatgactgttagaagaaatgaacaagtctataattttagtaggagatttagaaatagcattctcactaattaagaggtaaatctaatacaacaaattagaagctttgaatagtacaattaacaagcttgtaatttacataagtatagaaacctgatcttcaaaattagaaattaatattttctgggatttattgaatagtcataagagttgaccatattctaggccaaggatcagcaaattatggctgacagacctaatccagctcatgtcctgtttgagtatgaccctcaaattaaaacctttttttttttaacatttttaatggattgtaaatttttttcaaaaagacaatgtatgacagaaaccacatgtggtccacaaagcctgatatatttactatgtaaacctttacagaaaaagctgactcatgttataggccatagagaaaagtccaatgtatttcatatgtcatcattcaataaatatttatcaaaacccattatatgctgggcaattctttaggcactgaaaatgatagcacagtgaatgaaacagacaaaaatccttctgaggacacttgcattctactgggggaggcagacaaaaagtaaagtaaataaataaaatacatagtgtgtctgatggcaatcaatgttaagaaaaaaaatcagagaaaataacaattgttatttcgcaaaatttaatactcaaaggacatacagtgagccctccatatctgtgggttccacatctgtggatttaatcaactgtggatagaaaatattttaaaaaaataaaacaaaagttacaataagaaataattcaaataaaaatacagcataacagctatttaaataacatttacattgtattaggtattataagaaatctagagacgatttaaagtatacaggaagatgtgtgtacattattttctaatatgccattttttataagggacttcagcatttgtggactttggtatgagaaggtgggaaggagagaggccttgaaccaaccccacaaagacaggaacaactgtaatttattggttaaaaatcataataaaaatttaaaaacacttagaactgaatcataataaaatcagtacatattaaaatccttgagatgcaatcaaggtgtatgtttaattttacatgctatattagaaaaaataaagattgaatattaatgaggtgtaaggctaattgaagaagtaacaggctgggtatggtggctcatgcctgtaatgctggtactttggaaggccaagacaggaggaccacttgaggccaggagttcaaaaccagccagggcaacatagcaagaccttgtctctacaaaaaataatttaaaaaagttagccaggcatggtggcttgtgcctgtagtttcagttactttgtaggctaaggtaggaggatcacttggtcccaagagttaggggctgcagtgaactgtggtcaggccactacactccagcctgggcaaaagagcaagactgtctctaaaaaaataaataagccgtaaaaatatcaatatcagcataaatgagctagaaggaagaaagaataagaggtagaaattactgaagtcataacaaactatagagaaaattgcagaggccacaattcaacaaaaaagttgtttccttagaaatagcaatgaaatatctgctgagattgatcaacaaatatatatataataggagtgaaaattaaaatataaatgaaaacaagcgacaaaaacatttcacatataaaggtaagaaagacttgacaccggctgggtacggtggcttacgcctgtaatcccagaactttgggaggttgagacaggtgaatcatctgaggtcaggagttcgagaccagcctggccaacgtggtaaaaccccatctctactaaaaatacaaaaattagccaggtgttgtggtgtgcagttgtaatcccagctacttgggcagctgaggcaggagaatggcttgaacctggaaggcagaggttgcagtgagccaagattgtgccactgcactctagcttgggtgacagagcaaaactgcatctaaaaaagaacaactagacacaaataaattcggaaacttagatatgatgaacaaataggatccttggggaaaaaagtgtaatttaccaattgtgacttagaattattgtatctggttttgtaaccataaaacaaattaattcagtagtacaaaaactttccccaaacaaagtgacacttattatgcgcaggcaatttctaccaaactttcaaaatcatttcaggattatttcataaaatcattccaaaaatatgcacgtttccaaacttatgttaagaggccaatataatcttcatgcccaaacccaacaaaggcagtgcaagaaatgaaaagtgtaagaatataagggtttttttaacattaagaaatatattaaataattttaccgtatcaaaaattcaaaataatatgctcaaactagaagcagtccaaatgtctatcaatcaactggtaaatgcaatgaaaaggaagaaactatggatacatattacaacatagatgaacctcaaggatattacgctaagtgaaagaagccagatgcaaaaggctacatattgcatgattctattgatgcgaaatatttataaacgacgtatccaaagcagaatagtggtttcttgcatgcagctgggggtaggaacaggtattgactgcaaatgggcacggaggatctttctggagtgataaaatgttctaaaaccagattggttggacaaccctgtaaatttcctaaaaaatcactggattttactacagtggactgaatgtgtacttccaaaatttatgtgttgaaaccttaagccccaatgtaatggtattaggaattaaagcctttgggaggtgattaggttatgagggtggaggcttcatgagtgagatgaatgcccttatgaaagagaccacagaaggctctctcttttctgaaatgtgaatatgcaagaagttaggccttcaagagggcctagaagagggccctcactagaacccaagcagcctggcatcttaatctcttccagcctgaagaatgtaaaaaataaatttccattgtttataagtcaccagtttatgctactttgttataatagcctgaacagactgagagatttatgcttaaaataatttaaaggagacaaagtataagatcatctcaatagaaacaaaaaaaaagtataaaatacaacaatctatgcatttttttaagaatttcaaacaaattacagataaaagagaacttctttaactagattaagggtatttatttagtcttaaatatttactgttgaaacattacaagactttcctttaaaaatcagaaaaaaagccattcaagattatgatgtgggtcttagctagcaaataatttcaagaaacagaaatgaaggttttaagttaatacttaaattattaaatttaagtattaacttattaaatttaagtattaagtattaatttaagtatttaatttaagtattaaatttaagtatttaatttaagtattaaattatttaagtattaaatttaagtatttaatttaagtatgaaattattaaatttaagtatttaaatttaggggaaaaatactaaaattattctctgatgaacttattgtctacatagagcaaaaagaatcttcagaaaaattactggaattattaagaaagttcaacagagtttctgggttaaaacacaaaaaatacattgagtttctatacattaccaaaaaaagtgtaaacagtcttttaaagatacaagaagtgtgtaaaagtgaagtaaacgttataacacttctgaatataaccaaagtattgtatatctcaggcaactacttacttctcttaatagtgctcttttaatcatcctagctttatctgtatttgtgaaaactcataacccctacttagcattagttggtaaatgttgaaatttaagataaccttgtttcctgcaaagcactgttaagtggaatgctctggttccagaacattttattcttcctcctcctcgctgtattcagtcatacatcccagaagagatcagcaaaaaattaggaagttagaggtttacatttgtctttaaaacctactcaaaaaaatatgctttttacaattgctcttcagaggcctcccctgctctcattatctactataattacattataccttctgaaattctatatcaaaggtcagagcagaccctttaggcatgaaatgattcccagctcttcacggactagaagttcaaagtgcaaaaaatataattcactcagtttatcctcatggctccacccacccaggttttttcttacaaacacaccagttctgacaacctgatgttctttaaaccgtgagtagagatattgaagtaaatgagtctaccaggaacagaatttcacattcagaaatattaggttgtattcttcttgagagcaggacatctttttacctttgcagagaccacaaaatctggaaaaataagcactggcagaatgtatgtggaatatgtaaaattagatacgaagtatacaaggtctttcctctgtccccacacctctctcaatcataaaacaaaagtagaaataataaatagcatgactaggtaaactggcatttgaaatacataattcttataaaagccagcatgaccgtggggtgtgtaagagtggtgtttatgttactagcaaagctccttgctcaaagcctggagggactaaacaataatacttcacatcagcgtgatgtggtggagcgatcactgggctaaaaatcaagagattctgggcagttctgaccttggagacggcactgactatttctctgtcacctcaggtaagtcacttactttccctgggcctcttgattttaatacatataaatcgagggcattctaggatcctaggatcctatgccaaggatgaatacactttctgtgctgccaaaagtttgccgacatggtcagctaaaagcctcttcctctctccacattgtgggatgtgtgtgtgtgtgtgtgtgtgtgtgtgtgtgtgtgtgtgtgtgtgtgttgacatgaattatttccatcatttaaaaactcagaaagatggaattgaaagcagggactcgaacagatgcttgtacaccagcgatcatggcagcattattcacaaaggccaaaaggtggaaacaactgctatgtccattggcagatgaatggataaacaaaatgtggtagatacattcaatgaaatattacttagccataaaaagaatgagccaggtgtgatagtgagttcctgtagtcccagatacttgggaggcagaggtgggaggattgcttgagcttaggaatttgagaccagcctaggcaacatagcaagactccatctcttgaacaaaagaaaaaaatgaaattctgatatatgctagaacatgaatgaaccttgaaaacattatgttttgtgaaataaaccaaatccagaaggacaaatatcatatgattctactaatatgagatatctagagtagtcaaattaatagaggtagaaggtagaatggtggtttaaaaaggctggagagacagaataatgggaagttattatttatgggtatgagttcaatttgggaagatgaaaaagttctggagacagatggtgatgattgttgtacaataatagtgatatacttaatgccactaaactgtatacctaaaattggttaaaagggtacattttatgttatgtatatttcaccacagttaaaaaagcagctcaggaagatgaacaaaagtagcttgtgtttgtatttcatgctaagaatgcattctatttctcttttcccaacttttttaagaataaagttcttcagcatgacatcagatggaggggaagaggagtggaggactatttcttgagctactcaagtgaaaggaagtgcaatacttttcagtaagctgaaaataagctggagattttcagtttttatagtcttttttggcctctggattgctagagttcattaacagagccacgttcttggctaaggggccaccgtttttcttgaaggaagtaactgcaccagccactatcagggtacaagacatttatttgcaagaattaaaagaattagcacatctctgggatgacccagttattgcagagggatttaagcaaggaaattgtctagttttctctaagaagaaaaaaatcaagttgtctttacttaatgaccactgatgtagttttagtcatatgtcctgttccagtatatctgtctttttattgctatgcacttttagcaaaattacaagatgctttattgatgataggcacaaatgacctgaaagcttttttttttccttttatcagatgtgggcatttccctcagagacaattctggtcttttaatgaagatgaatgtatcagtgaactttgttatttattgatgactttcctattttctatgatggttttgttgtcactgtattttacttaggttagttatatccatcaacataatcttctttgttggaatactgggattaagatcaatctatctctctgttagttttatgcttttgctgcccaaagaaagcaacatgcaaaacacggccatgttgccttacaagccagatggtaatcagtagttaatagaattggaagtacagttaaggtttattcttgtaatttattcaaaactcaacaactctttaggttagcttgctaatttataactatctagtttttcctaaattcctaaattgaagataaagctgaattcttttttcaggataatagagcatgtattgttcagggttcaatttaggaagaaaaaccacatgaatattatgcaataagggacttactagtgacctaagaagtcatacaatatttgagaaggtagagaagtagagattaaagcatagcatagggagatcagagaaaagtcactacctacccttctgaagcactgaagcctacaaggataaatgagaagtcaggtaggaccagcttctggagagaaactgcagaggaactgttgtgcttgcatctgatgatgggtctggtgggcctggtagtcagcagccctagaggtctggaagaagagctggctgtgcacagggagagttaggacatgctggctcctcaccatctctgaccaggaccatgaccacctgaagagagcaagggcagctgcaccaattcatcctcagagctcccacagattcatactctggccaactcaaaccagagccatttaagttgggggactctgggaaatgcaattcctgcacagccatgtgacacagtacaagccccaaagaacagtgttttcagttgtcacagggaagaaactttagggttagcaaaggcttttcagcttccccagagaaaagctgctgaagagttgaaaataccaagtgttccagcattaacatggtgctgaacacctagacaccaacccactgctggctgcccagcttagagagagagattggcagggctgttgagcaccaggcagttagcctgggtggaaagttttactcagtatggcagggcggtcgctgtcatctaagaccatggaaaatttcagagaccctaagctagagtaaagtaggaccctaagacgacagccagagagaggaggagagccaagcaaaatccccctgggggacctagcgtggaggaggatcctaagaatcttcttcccaaatcacttaagttcgaggtttctgtttattggcagtacttagactggcctatttcatcatcatggtctctgtaacctcttcctccatcactttccctccatctccccctctattactcctccatcacttcccctctatctctctccctttgtctttccctccatctctcctcctccaccactgtctctctagctccctatccaaatttgcccctccatctcctcccctccatccttcccccacctttctccttgtgtctctctttctccatttctccccttccatctctccttcaccattgctctcctaccttcccccatcactctccttatcaccccctgaccccatagtcacttttacatagtaacaagattcaataagctctttgtagtattagaatcttcacaagttgcttcctgatctgcaaaaacttaacttgtactttctttagcccttacatcccaccatcccactcagtctctcttctctctctctctcccctctctttctctcaattgtttatacttcaggtctcagctaaaagtcacctctccaaagagactttctttgaaaacactttaaatgaaatatgttctcctccttctatcccattattctctatcactgtgttttgttctgaaatccttcctgacattcccacaacttaaatgatgtagttgtattttcatggctcctttgtcccacacactacactctaagttccctgaagactggaccaggtccctttatcagcagtgtctacccagcagctagcacaataccttgcacatggaaggtgcttattaaattcttcctgaataaataaatgagtgaatgaataaaaaatgaatgaatgaatacagtcaaattttagagctttccagaagggaaatattaaataagcatattctaattaatttttttcttaaaagacctaagctcaagatggtttcccattttgatttttgagatcaatcataggagtcagagaagcattcataagacagtgagaagcttctaagattctgtcatagttaccagggatcccaaaatgtgtacaacagtggaggaagaggcaaaaaggaaaaatctgcaaatcttgtagcctcagggactccagtggaaaaaaaaatggaggttggtgggagtcagttaaagaaggccaaaaatctggagaccggacaaaacaagttggggaaggaatattgagatctaccaagagaaattccacttgcctttataaaattggtaaatatttctttccttctctttccttttttattttagagagagggtctcaacatccagttgtgcagtcatagctcattgcagccttgaactcctgggctcgagctatcctcctgcctcagcctcctgagtggctgggactattggcgcctgccacaatatttggctactgttttgtttttttttcttttgttttgttttaattttgtagagatgggatctcactatatttccctggctggtcttgaagtcctaggctcaagccatcctctagacttggccttccaaagttcttacattagaggcgtgagcccctcacttggcaaaacttgtaaatctttatggagtgcctctcttgaaaaagatctgaacattgactagtcaagtgcagattaataattatcagcaatttattagcaacctgccagtagagccatactaaaatgaaaatacaattaattggggaagcattactgtgtatgtggcttgctgaaaatttactattttactaatctgtaagagaaaatgcttgaaagctttcatgcatgttatgaataagtttgcccccatatttcaagtgacataaaaaccattcaaaatgaacagaaacttaaaagaatattaattaaaaaatataacgtgaacatatataaactgtgtgtgtgcctgtgtgcgtgtgtgtttgtgtgggtctgtgtgttaaactttttttatctttttcagggactcaaatattttgcaaattttaaataataaatctatgaaaattaatttaaccctagactcaaagaaattatccattactattcaactttatctaatatataattaattttgcacattgtttctaaatagttgcaggtttggattatgatttcctgaaaatgcttcctttgatatttgcttggatgagaaagtgagaactcactcactgtatgtttgctaaacagacctatgtagttaaagagaagctgtccaaaaagattctctatttcagcccaatggagcatattcattatcagatcaaagtgataggattttttttatcttctcctaattgggggtaggcaatttccttactcactttggcaaatcgaaggaatgtcttattgtagagaaagaggctgtgatccctaaatgtcaatgcaaaaaccttcatcacatcactcttgtcccatgtagcacagagaatccattccattaaggtgaattctggaagctggctgaatttcaagctgtgttttaattcaatttttttttggcagacagttttaaagggaagtcaaaggttatagcttgataattgggtataaatacagtcatttcagtgggcctcagattcagtcatgcagaaccaatttttagcatggtgatatcacggttgcatatttttaattgaagcactcataaggagtcctactgtaatctgagtattactacatttttacccctcatgaactcaaagtataagttaatggtatacaatgaaatgttgcattgttgactttatctttcttacctacatgtctcctgaagcatagacttcgagataaaatgttttgttcattggttaaaaaagtgtctgtattctctaagctactaatcaataatagaagtttcttttataagtctgagtgcagcataatttatcactgaaaacttacttcattgctaaagcccaaacatatacacccaagacttttaaatcatgattttcctaatgcttattgtgcatttaaatggtaattttagactatgtagattattatataaatgacaaatttttattatttttacactcaagtgcaatgtctcgtcttaatataaaatctttaaatgtatggtttcttcatatctgttctgctttcttctatttgtaacaaaatgttacttgtggcctttattatttaggagaagaattttaaattgattaagataataatccagcacatattttttaagtaaaatatatgagcataaaagatttgcatggccacattttcttaatccagtctatcattgttggacatttgggttggttccaagtctttgctattgtgaatagtgccgcaataaacatatgtgtgcatgtgtctttatagcagcatgatttatagtcctttgggtatatgcccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtgtcctgactttttaatgatcaccattctaactggtgtgagatggtatctcactgtggttttgatttgcatttctctgatagccagtgatggtgagcattttttcatgtgtttttttggctgcataaatgtcttcttttgagaagtgtctgttcatgtgctttgcccactttttgatggggttgtttgtttttttcttgtaaatttgtttgagttcattgtagattctggatattagccctttgtcagatgagtaggttgtgaaaattttctcccattttgtaggttgcctgtttactctgatggtagtttcttttgctgtgcagaagctctttagtttaattagatcccatttgtcaattttggcttttgttgccattgctggattaagaaaatgtggcacatatacaccatggaatactatgcagccataaaaaatgatgagttcatgtcctttgtaggaacacggatgaaattggaaatcatcattctcagtaaactatcgcaagaacaaaaaaccaaacaccgcatattgtcactcataggtgggaattgaacaatgagaacacatggatacaagaaggggaacatcacactctggggactgttgtggggtggggggaggggggagggatagctttaggagatatacctaatgctaaatgatgagttaatgggtgcagcacaccagcatggcacatgtatacatatgtaactaacctgcacattgtgcacatgcaccctaaaacttaaagtataataataataaaaataaaatttaaaaaaagatatgcatggcaaacttttacaatgaatatagaaaccatgaatagtcattttaccacccaggtttcttgtataattacactacttaaaatgtttagttgctgaatgctaatggtagacttagtcatattgacttagctattggaaaattcatgaaatataagatgactttgtgcctgccatttgggggatgaaatagaaatttcagagagagaattcaagcaaagagacattacaataatttatgataggagttttcatgtttagttttttatactgatggcagtggcggcccatctggaggagccactgcaaagacactggctgcaatggctaggtgcaaccatggctgtgtgctccatagagccagtgggggccaggaacaggcgggagccccagcccctaccaagttgatggggcaggagcccagtgttcctgggtgcaacagcagctgcccgactgtggctccagacctgggaatctctgcactctcggaggcctgggaagccctcctgccccaacaggcttagaagtgcctgcttctgccccctggcctctccctgctcccagtaccctctctgctgcagagcaaagttgtggctgaggctgggtgctgttgcaatgtggccaggtatgtgtattctcagaggtgctgacacgccagccccctgctgccttggccccctctagactttgggaacccaggagcatgggagggaagcaaaggaggggctgagggcagcttagtgtgggcctgcaggtaccccttggcaggaacagcctgggcgttgtggatggcatgttgatggcagcagaaggcagacaggctcctggacaaaaaggggcaggtccctggtgaaatcccaccttcaagcctgaagcctgtgggctgggctgccagttcctgatgaagtctgcagcccagagtgagaacttatggtgctttttctggccctgcccatggccacctatggactaatcagcatgcacttcctcccttatgagcccataaaaaccccagactcagccagacttgaacagacctcaggactaccagctgcaggaaggagctactgcctacgagtctcctctctgctgagagctggacactcttagggatgacctgcttgtggaaatgagcttcccacttcgggtctcctgagggctgttctgtcactcaatggagctcctctccacattgctcatcccccaattgtccatctatctcattcttcctggatgtggaacaagaactcaggacatgccaaatggctgtaacccaagcagaactgtaacaaacagggctgaaacatgctccccctccttccatgttgcaggcaatgagaaggagagaagagctgcatcccttcagggagtccagacctagggaatcccctagccagagctgtgacaccctctttggggctctgtggttcctggcatctccaaggttccagatgccactatattcccctcatctagacatgggtacacacagcagaagctgtgtgcagtacatctggtccagttacagccttgaatggagctggcacctgtgccagtgtctggagctgcccaccctactgccacagcctgcatgcctggctgtgcacagtgaccagaccctgcactcacttgcccacacacctctcacttctctgtgcctggctcacctttggtaggtgtgggatccaggacagtagcgtgagctgagtgcagcctgctgggccgagtgggtggaatgagcccagtgggcgtgaacaatactcaggcagaaaggtttctggctggcaaagagacactccatagatcccatgacaatactatttgaattgtgaggaaacaccagattgttctagaaggttgaatacgcactggtccaaacagatttcttgccttcctccctgcctgttgggggtggagtggaaaggggaaggtgaagattgtcattgtgtatgcatttgttttaaacctctgtagcctgactttccaaattgaaaaatacaactctgccattctgtgttcacacatgtcagagctgctgcagaaaactcctctttgactcattcatcgccattgaatctgaatttattttcagtggtatcctgacaggaactttaagactgaactctgcattttttctgttttcccagtcatctgcctcattctatgttgagggtttcactaatgaatgtgatgtttgctggtaaataagtaaataaatgcacctgtacaatttacttccttttctggaaagacagaaagaacagaatactagcacaagaaaactttttttttccctcctcttgcttggttctacttcagctcagttacttttgacaaagaaaatgaaaatttaaatttccattgaatgaattggtgtcatggctattatttaagagtatagaaattaaagctgcaattgggtcgtgtatcatttgcttaccctagatgcacattatatcctggtataatgaaaaatggcatgcttttttttttttctttctctgtagtgaaccataactgaaagcaggaagcattggtttacactttgcatcagagttgtgggatttctatatgggtacagtagtcagaatccattctaactgtgaatgccagaaacttaatttctataaaatgtaagaaaaatatgagagtgaatgtactgcctcaggttacttaaaagccgaagcagtgattgtgacttcaggtaaggcttcatccaggcataaaatgattgtcttcaggtctccagttctttctctccttccttctcttgatattgtattactttatggggactgtctcatgcaggtacttctcagctggcaggaaagatgcctctaccactccactctaaagtaaccttagtagtggctaccactctgtaagtgcatcttatgggcatccttcttcaaactttaatgactatgaggtatttacttaatcctcacaattattctgtgtggttatgacatttgtccaaagtcacagaattataaagattggaagtggatttgcctagctagtttggctccagcacctatgcatgcatataacccttgctctaagttgttacgctagagcttgagatctacagaggagaaagatgctttctctcttttaacctccctatcaatcctgaaaatgggatctgatgtctctgcatgagtccttgctcaacctgcaccaatctctgtgtcctgcacctcctcccatcagcatatgatattcatccacaacagctgaggggcaggttcagaagggaaaatgtgcatggcagaataaaatgttacaaatgaccactacagcaggccaagctgccaattttccagaaaggtccctggcattgcaatgttccatatggaaagcagctcatctgggtaagcatgcttttccatggctctctatgctttgtggtaatgggtagtgaccacagtatagcaggggcaaattgaacagctgaagaagaggatggaagagaagacaggactatgaggaagcataagggaggattgggcaagatggaggcagacatggtgtggttacctgagcaaatactgtagctgctaaaattcttagataagcctgaggttactttaggctcctatataacctagattgagctaatcagaatttcacacaaaaatccagaatagtgattagttacctttcgtgagagtattgactggtaggtggcatgaaggggctctctggaaatattttgtatcttgcctagggtggtggttacctccatgtaaatatataggaagttatcaaatggtacttaaaatttgtgcactttacctcatgcttgtgctagcttatttttttattgacagatataaacaattctacctgtgcagagacaagccagattgtttagtaaattaccatccagatttcctggattgcctagttaacaagctacttggaatcaaagccccccactcctcccaccctctcccggaggagtgtctgcacctgaacccaagtttcacaaattgccagatgctagcagctaacactcccagacatcagccctaaaaaggtggcatctgggtgcagactgttttgcactcacccccagactgtttttaccctgcttacaagacagctctcttctcattctaaataaaggaaagtggcccttctccaagaacagcctacggtgcatccagctggcccagccccaaggataccagtccacaggatgctgagagcacagggactctgggtactctttttccctcctacctatgaattacagcatgctgcaagtgatgctattaatgtgtttttggcattgccaaggtcattcttactaaccaacacctaggccttcttgcattttgatattattggacaatttaaagattcccaaattgcatctctgcgttaatgtgttagggatgccatgacaaaataccacagaccagatggcttaaacaataggaatttattttcttacagttctgtagtctggaagtccaagatgaaagtgttggcaggtttggcttcctctccttggcttgccgatggccaccctcttgcttactcttcatatggtcctccctttgtgcacctgtgcccctggtttctctcgcttttgtgtctagttcttataaagacaccagtcagattgcattagggttcatccaccctaatagcctcattttaacttaaccccctctttgaaggccctatctccatatacatttatattcagaggtactggggcttggggcttcaacatgaatttggggtgggacacaatttaatccataacagtctgttttgctggaatcaactacaatgactgttgattacaaggaacctgaaaatacttttttttatccgtttagctttttgctcagtctaattgaattcgtagaaatttagatggggtatagttcaagctaattatggtgcctgtgcacccagacaaattgtggtacaaaatctaaacttctatctggtgaattaaggataagtagaaaattaatatcatgtaatgtttgagaatttcagaaatgaattcccctttatttcatttgcagctgttagcctggaggaatttctagttcaacagacacaccatgcacgatcatgtcactgggcctttgcatgcaccgtgccctctctgggaacacttttccccctatagctaattacccagcttttctcttctctagaagctagttttgtccttacatctaaatatctacgctccgtggttacaggccagactggtgtcaaactcctgacctcaagtgatccacccgccttggcctcccaaagttctgggattacaggcgtgagccactgcacatggccagcatacagttttaattcaacacctcaaaatggacagcatcataaaattaagaaaatgtgatatgttttttctagttataatcatcatgttctaagtgcaattttatattccaattttttattaattatgtcgtaaacattttctgtgttactacagtgacttcttaatgattttatatgcagtggtcccattaatttagtagaataaaagttacacatgtttttattgtgcatttgggctgtttttcattacagttgtccctctatatacagggggaccttgaccacaccaaaatcagagcagattcaagtcctacagctggccctgcagaacccgagtatagaaaattcagctctccatatctacaggtttcacatcctacacagactgtattttcgattcacgtttggcggtggatgcagaatctgcagatacagtgcattgattatatttattgaaaaaagaaacctcgtataaagtgggccttgccatttaaacctgtgttattcaagggtcaactgtatttgcaattatagctaatgctgcaataggtatcttcttcctaataatagctattaattaatagaataaaatatcaggattcaggttgagagacaggaccatattgattactctggattaatattgtcattaatgcttgtccaaagtactcaactgccaaaggccaacagcagtgtgttggggttatatgtctatccttttggattaaatgttaagcaatgaattttagaaagtgtgtgtgtgttttccttccttttacatatactatgttatataacctttttttgctaattctaagaccggcccgttagaactattttgttgttgtatttggatagcatgcttggattactatagatggtgttccttattttagtactttctaggaatgcattttgatgtgaattttcacattcaagtctgagaaacattcctcttcctgttgccttatatttttacacatctcaccatgtccatcccttgactttgctttttattgctaaattcaattcctcttggaaatgacgggcctctgcatttgcagttagttatgcctttgaagaagattatttgcctcccttgagtttgtgatttcctaaatccagtgaatgctctgctcaaagaaagtttccttttgttgagaatcaattcatcactttgaaaaaaaaaaaaacttatgacaaaataggtggtcagatcatacccctagagtacaggaccttcacatctgttctgctgtagaattgagtagaatgaaaatctgaaaccagatttgtggttagcaaaagaacagaccctaaaaggcaatagtctaagtaaaactctgcatccaatttttattgcttctgctgttttgcttcagatatcttttcatattcctaagctgtcttcccatagtaacaaaactataaattcatttagtgggggataagaatagtggagagagggaggggaataaaaaatcaaatgggttgttggagcaataaagctattggtaagtttaatgctgactttaatctccagggtaaatgattgtgcaattgtgtcttacatttacaatctagtgagctgtgaataaaggtggtggggaaatatgtaaaaatgtgggccaggaaaccagctaacaaggtcataagctcagacacaaagaacctagttgattttcctggggcggaagaccctgaatccaggatattctaatcttggctcattagaccttaatgagggaagaataatttatatcaataagccaaaaatttatcttttctggcactcagagcacaggagcattatttataacttagaggcatgcaggtgtgttcccctaggcatctctttctatcaatattttaggagacttcctgatttgccgtggagaaaaactggagacatctggtattgtgtaggatggttgatacttttacaaaattcattcattcacatagcatttctttactcattcatttaatcttctggcgctgacatggaggtactctatttaggatgtgttcaccgtaagggtacatcttaaacatacctatgctttcattgatgtgacgtctataaacatgtacagacaggtacctgcaggtaaatggacaaattaaaatatcattatgagctacatggtcaattcatcattttttccagtcagaagctttacttggtttactttgttgtaaaattgtaactgcttttgtacaagctgccttctgtcctcccattctcatttccaccaccatctatagaggtatttggttgcatttcttgcctttattagcccacatggaatggtggccagatcccagaacttcagaatacacttacactgcttgtgttaagtaagagggaagataatgcagtgaatgggaacttgttgtcataaaaataatcacagaaattctacattcccattcctcagcagttaaaaattggatcttgccaggtatgatggctcactcctataatcctagaactttgggaggctgacgcaggaggatcgcttggggccagaagttcaagaccagcctgggcaacataatgagatgccatctcaataaaataaaataaaataaaatagttaggcatggtggcatgcacctgtagtcccacctacatgggaggattgcttgatcccaggagtctgaggctgcacactagcctgggcaatagaacaagaccctgtctcttaaaaaaaaaaatagatcttatttactatattgcactcggatagttattctggattatcctttccccatgccccatacctctagtatatactcaaataaagctattctttctgaaataattatcttttatgcagaagtgaagagagcagagagtaaaacctcctgatgtccattgcaatggctagaccagcaacattgtcttaagcccaaaacagtaggcagcatccagaatgataggcttgtggtgttcccaatcacatcctgaacaaaagcccttgttttatcacaccacaaacattttcacaagtgtgcatcttcccctggaacagatacagccactacctggaacaagatgaggataacctatcaaataaacacacagtcactgcatgggcctggagccccaattcttaatggcttaaaacgaaggagtgtcaaactcaactatctgctggaactagactgggtgtgaggcaggagggagtgggggatgctgcataaagttaaagaacccaggccttatttaaagggatcagatgctactcagtctgaatcattccggatagcgaatgtttcaaggaaccctccccttttaaaaattattagcaacaaaaaattcaactgtttataatactgtgcggaccaacactgccttagacaaatataacatccaaaggaatagattgggcccatgagcttactgcccctgcttcatgatatcctaactaaaagtaagctaagagaacaattctatctttaggggaaatactggggttgggtgccttcccatggatttgtaaatctaactcatgtcatccccttcaaaaggaatgacctgctctgtccactgccccctgtttttacctatcaatattttacccacatgtgtcagtcagaacagggtagttgctataataaacaaccccagcatctcagtgacctgataaaggtttatttctcattcacacaaaggccaatgtcatcctcctagttgagtgagtctcctgtaagcagtaaacttggggatttagggtccttcaaacatgtggttctaccctcccaagtcctccacttctagacatgtggacaaaagagagaaaataaaggataacgtggaatatttcatggctggacctgagagtggccttcacagctttcatcaacattggccagcactcagccacctgatctcagccaggtgcgacaattctgggaaatgcggtcttcccagttccccaggaggaaagtatcaagttagttttcacaggccagcttaaaaacctcactgatccaagagcactctctgataatgctaattagaaatacgcttgcccttccattcaattaatatatgtttaaaatacacctgcaagtcatattgttggccctagagacaaaatgataagatgacctccatatctttcgggagctgttgtttcagtagggaggcaggcattcaaacaactctatgataatatgatgggagctttaatggactactaaatacagtgggggcagatttgaagaaatgctctttaaccatgtggagcttgacactttgttgattgcatgcacatcttgtcttgttactgtatcataggatccttaagtacatagatcatactctatttatctttgtatcctccctattaccagacatctaggggttcccataaacatttgtcaaattgatgaatgaatgagtttctgatgaaaagggaataaacacagactcaccatttgagaagaaaataattagtctgtcagcttttaatagtttaaacttttggtacatgagataatataatattcttttgaattcttttctttctgatgcctcgaaatgtctatggtggctcattctatgatttccaaatagattatcttcaaataattcacaacatttagccctaaattacagtttcctgagtgtgtaacaagtggtgatttcatttaagcaacatgctgtatcatttatctgggctaaagtggatcagattaagtttcaaggcaattatgtcatatttttggtgagtatagtcattattagcttaggaactctttaaaggaagtcagtttcaaatgtcttctgcctattattaaatttactacataattaatttataaatataacgacttagatggtctgataacaaagttaaaattaactaggctgtcccttctttgtattgttggacgtattcaataaaagcaaaagaaatctcagtttctaaactatgaaccagaggccatcctcctgcttagttcagagtcgactaatctgttgtttgctaaataagtcttattctaacagcaatactagaaggaaatgagtttccaccatttatcatcaagtttcaaagtggatattcaaactcctgtcgggaatttgggggagaaaacgtttaggaatgcagtattatatatcactcactcatgagaaatgactccttgtttgccagcctaggaatcaaacttggagccatttatgtcaacaaaagactggggtatgtgtatgttttcacagatggatggagagtgaatgtaaaccaaagacaatggggtctttgcctgaaaacctgcctttatgcttatcatgcagtgaaaacaccttttttttctggagcgccctgaactttgtctatttagtctgggcctttttgatatattgcttcacattttgggggtatctgctttggctgtgtggctctctatctagatttgaaagttatttgttccacttgttctttctctccttcatcatacctggtggattaggcagtcagcagacgaactagcacccaggttctgttcacctgcacacctgctttaatgcatttagcattcagttggcaccagattctagacaaccttgccctccaatgatctgaagtctacttttttcttttatggaatattttaaaatatcagtgtgtgtgggtcttgtcttcataattgaattctaggctccataaaacaggaactgttcactgtatttcttccggacttaagacagcagcaaggaaacaggaagtgctaaataagtatttgttggagatggtatacccaaatatacaatagtatatgtatgaatgcattattgggttaaatctggtaaatctggggtctgggattcaaaatcctggacccatgaagtagaataggaaaaaaaaatttttattgttcactaactactaactgaaatttatatgtccttcaatgatgaatgtagtccttgaactccaaaagttaacagcagtgcctgaaacttggcctcccatggaagtctcaggtatttttgtgtcacactccacttgcggatatcttagaagtctcatttgtgttcctaactgcttcaaaagtatgctagctattaaaacttcaactaaattttattcatgtgctaatcatgacgcatattttaacatctgataagtttttaaaatatctatgcctattttttaagaagcatattttagtataaatcattttctttgtaatcctatatattgtattttattcatttggaaacactactatgtgaacagtccatagcaccaccaaactgccaaagagccagcgacatgattgatggttgagagccactgcttcagatctcactggcacataagctagttttaggaggctgctttggagtccagtgaactggttttagaagccaggattttcattttactgactgtgtgactttaggcaaatgacatttcccctttatgatgacccgaggtcttttccagctgtgaattctgtgatacttgttttcagacatgttaaaatatgccttacatcaaactcaataattttattaagcacttgaacacacaaaaaagtaaaaaagattcacaatataaataagttttaaaatggtttagataaatccttggctaatagatctattatggatcaactaaagtcagcctaggaggaaaggaaccttgtatgcacacccagcatttaaggttactggacaatgagacagctgtccccatgcacaacagggaccatttcaatatatactggaacatctctcaatgataaccaacagcttttccatggacattcagtgtagttaaggagaaaattagccatattttccttcagtgcctttgattaaactctgatgatgttttctgaaaaggaacatcaaaaactaggacctctggagacagacatgttgtaattattattacaaatacttagcatttttatcatcatcattaattacatttctcctttaagggtttatcataatctccaagcctgctatttgttcatttgttcataattatccatgagtaagcaatttgttctgtgttctcagaaattggttgtttaatatttggttcatttttaaaaattgtttcacaagggaggttcaaaaaagttgtgtttttcttcctttttcttctggtattaaggatacttctgatgtccttaattatcctggattctccctccatccatcccctacacacgaatgtaatgggggctttcagaaacacaatcgtaggatttttataaaattcggcacatcaatctaggaaaagaacattcaatggtaagacagccatcatctttgatatattaatatatttttgcataaagtcctcactttctcatataaattattccagtcttatttgacctttgttgtcgaggctgtctatcattgacaaagcagaactgaccacttgcctcaattccgtatcaaagtttattttccttcacctccctctgcccccagttcaatgctgaaaaggagccaggggagaaagaagtagcagatcaaaatagaaaatacctactttgtgctcaaataacaataaaatatccataatggcgtgtgttcaaacctctgtatctccaaagagtcgagcaacatggttagtatattaacctattagggttagccgattctaatcaggttcagtgtctgggcagggccctctgttttttgtgctagcagtttcccttgaagccagactatttagtggattcagcactgttcattttgtgtgaaagcccgtattcttctcttcatacttttcaaagatatgcttttctcattgtaagcccaggtcataagatgatgcctcaagtgcattgcgaaacatttattattctgagagactcaggtgatgaaaactctatgtgtttggtgtgtgattccttaaatgagttgtcatttatgacaatgactttatttataaggcactgttcctaagggaatatgagttttttgaccttgaaatacatgtagccaatctgcttggcaatttgtaattgtcccccctaaaatagtaagaacttactcttgctctttttttggaactatattcagccttgggcagtaaactataactcagctaaagttacataaaccctgaagggaaataaatttcaccactgttgattggtaaatgtcacagacatcagtgctatttatcaaacatttctggtttcctgccatttagcccaaagataagattttaatttcctatcccctttagggttcagcatggtcatatggctggatttggccaatgacatgtgggtaacagtgatatatttcacttctgagtgaagggattgagagctaatccatgatttatcatgccacctttttcataaggtaataatgaaagcacctagccaacttggagcctccatcaggctgagtccctgcatgactaccatgaacagggcagaaaccaggacttattttttttttttttccatgaccaacatagtgcttggcatattattaaaattctagaaatacttataagtgtatgggggtatatatgtatgtgtgtaaatatatgtgtgtatgtgtatatgtatgtacacgcacatacacagagagagaaagagagaagctgaataatttttctgagaatcaaccggaattcgggcaatctagcatgaaaaatttcacttgtagctgtgtttgtttcccttggtttcacttggttaactcagcatgttttataataacatcataactgctattattgactttattctaaaataggctattacaatttctgagtaactactttaagctagtgtgtccctcctttttgatgcctccctggctgcacttcggtcaggctggaatatgagaattcagtaggtgaaggaaaatatataaagagaaatataaaaatatcctggtgttcaagaaataacttaagtacttatatcttgaggagaaaatacagatcctcttcagtgcattagtcatgtaggtataataaatgagaaagatggaattcaggggacctgagatcattacagtgttatctcaccgagatgattttttttttccaacggtagaacctcctggcctgatcctattgaagaagaggagataaattgctctcttttgaaggtgcattaaccttaggttcatttaatgaattacctctcccaatgcactaacagataccctggggcctgagatgaaaaatggcctctcttctcactgagaggctcaaatacatactacttccttctttctcttcaacttgttttgactttcattctttatcctcttgtgatgtatatttaacatataactataatgtactctcagtttaaaaataagaatgggaaatctatcccctaacaagggcagtatgtgtttcttattttaaatagattctcttaacttaatttcttgattttcttaacctcattttctcctctggcatcttatggtgcaagctacctgccattcatgattctccaagacaccttaaggaaaggagtgctgggtgataatacagtaggtgctgcaaggatgtgagacgtgtagttaaatggctcagcagatgagctcagtgctcatcccatattcatagtcccctcagtagaggccattcaactgaatgctcttcctcttcctcctctgtagaattacctctcgagcatcattggatcgtgcattcgtttagaaaatatgtataggtaatcatcagtctttgagttcctctgaaatcagagcctgagataagaatctgggactattttaaagcatagatttcattattcaggtattatgaggccaacaggtcaggaggtaaccagcattgaaaagatagtttgttactcacagttcctaagaagagggggcagccatgccctgtggggccacacaggatagcaccaggcccagtcagcaggcaaaaggagtgaggggaaagggtgcacaggaggccttagagtggtttctgcaggaaaagccaggcaaggcaggatacgcaggtttagaattggcatttagggaccatctctagtggtctggtaccttgccctgggataattatgggaaagaactattgacccctcatgtttaagagtcatatagttcagagtatgcggtctggatgggttggtttggatatgaaaagcatgctccccagggctcatttgctatctctaagaactgactaaccctgatagaggccatccctccttggtcagcaaggccgcagtgccaaattatcaaaaatatagaaaactgtatacatagttaatccagggcacatatagtttatttgggaagtgatccccagaaaacaaaaatgaagaagtggggagagtgagacagtgaagcctggggctcatttccactgaggttcctctgggcaactatgtagaatgtacctcagaattgtccctacagagaacaggaggcagaagtatttattcactgactcccagcccccagtggttgagggttgtctgcagggacattcacatctatgcacttctgggatgagctcacacacacaggctgtgcataaggcttcagagaaagccctgagatagaagatttgattgccctgaaggcatttgaggtgggaagccattaggatgccaggaacagttcacctcttgactgcagttatagtgaagaggtgggccaaagggtgtggcgtggggcagccaaaactgtgtgctgcagcacaagtccccgaacccagcccttcactgaggaacatcaaagaagcctgctctttgagatgtaaaccataagatgatcaacacaaaaggggtcagagcagccacatacaaagtcaccttaaacgacaaatgaatcccaggctgcagggcataagccattccacctgcctaaagaaaaaaccctctgccaatcagaaatattttctgtcggctatgaaaacagagaaagaaaaaaataaatgtgataaatgttattatgcctttctgagcattgcacagggaagataaaaccccagctcaaggattaggcaggaggtagggatatcttcattttgaaggtgaaattttgcctgattcatgaagcatttaagttatataacaacaaccaaatcatcaaaaatttagaaaactacacatatgtgtatatatatatatatagagagagagagagttaatacatatatacaactttatatagttaaataaattatataactatatgtgccctctattaactatgtatctatctatctatctatctatctatctatctatctatctatctatctaaaactctctctctctccatatatattagtttatttgggaattgatcccagaaaatattaatcctctcttccctttccttcccacctttctcattcttccccttttccgtctcctctgtcttcactccttcctctccgcctcttcctttctgttcataactctcattgtttgtacatgtaacttggatcaccttctgggttggctttccaacactgccagcaagccataacatcaagatagtagctctctgtcaattacattttaattcacaaccttttcataattttcacaagaacaagtacaacggaacatcaaatctttcaaatcaaactgttgttcctttctagttggatttacattaaaattgtactgtgagagtgatgtagacctttaacaggcaaatgaactagaagacataggcaaaaagtgaggcaaacgtgctcctaccagcaccacctctgccacctcatatgtccacacacctgggcttcaagctaagaagcctccagtgccaggcatcctgctaatactcagggatcccattatcacttagccataaactaaattattagtgacatacatcctggattactctgtctgtatctcactccatacatccagacactgacacttaattatgttgttccacagtagatcaagttttacagcagcaacaaagattaaaactgttttatattggggacatttagaggataaacagcagagggttctaggagagaactatagtcagctttgtggccatctgggagaaaaccattcaagtgctattaatatttaaaaaccttttagatttttatagtttgcaatgttcctaacaaactgatctctaactccgcagtgaatttttggtgtcaaaacacactgctaagctatttctgagtctttattaacagagacagagctgtcagctttgtgctgtcctggtggcctggttgaaagttggtgtcattgaagaagcaaatctgagttttcggttgtgcatgagaatacgtccactggtcatcagcaggctctaggtctgcatgtttgtgtagttacctcccatcttctttctcttctctctcctttattctttttctttacttctttctttatcttgttttcttataagttttctgagtctatagaaatatgtattagagtattactttaaaagaagttcttccaaaatctatatcaaattaacttggcagaaagagccatagttgcttcttcccaaatagctctttctgcttgaactgtagtatagtatcaagacagacttcagagaaaagaatggtagctaacatacagttgatagaactgggagatgcttggaaggctgaggtgggaggatgacgtgaggccaggagtttgagactagcctgggcaacatagcaagaccccatgcctacaaatataaaaataaaaaacttagccaagtgtagtggcacacacctgtagtcccagctacttgagaggctgaggtcggaggaactcttgagcctagaagtttgagactgcagtgagccctatcactgcactctagccagcctgagtgacagaacaaaaccctgactcaaggaaagaaagaaagaaatgggagatgaatgatgaataaatagcctgccgtcttgcacgctggctcccaccctcatcctctcatttccccagccccgctgtcactccttcattctcctactctcacagccctctcttggtggttatgtacaaaggagcgggtgagaaaatctccaacctggtgtctatagtaaaaagcagcatcaggtattggcagaatcaccagattagtaatgagatgatggttgctgaatctttccatgcttcaattgggggagaaaattgtttatactgtgaaagtttaaaagaaatcaggtaggccaggtgtggtggctcacacctgtaatcccagcactttgggaggccaaggcaggcagatcacctgaggtcaggagttcaagaccagcctggcaaacatagtgaaaccctgtctctaccaaatatacaaaaattagccaggcatgatggtgggtgcctgtaatccctgctacttgggaggctgaggcaggagaattgcttgaacccaggaggcagaggttacagtgagctgagattgagccactgaacttcagcctgggtgacagagcgacactctgtctcaaaaaaaaaaaaaaaaaaaaaaaaagcttcttccagaaatcagtcaggtaaagctagataataaagggaaggaaaagaattgtatcaaccatacagtgttaaatcagagtttattagtgttgttatggatgaccttgattacatgatttcatgcatgctttaactgattcttatttgtgtagcattatttttaatcttctactttgaaaacttctagacttacagaagggttgtaaaaataacgcaaacaattctagtacacccttcactgatttctcagtgaaatctatctttaccatgttttttaatcattccataacatcaataatatgtatatattattaactcctgaattatttgaggtaacttgcagagttggtgctctttacccttaaatattttagagaatatttcttaaaaacaattatattacataatgacagtaccatgaaattaacattgattaaatgctattatctaacctttagatcttagtattccttatttttttcactaatttctgttacagtggaaggaagaaaaacacttttctagtccaggatccactccagagttactgtttgcatttagctgtcatgttcttccagcctcgtggttcctaatccttttttctttcataatcttgaaatttttaagagtataggcaaattattttgtaagaagtctttcagttttaacttttgtggtattaaagaatcgttttctaagcaatggggaaaggattccctatttaataagtggtgctgggagaactggctagccatatgcagaaaatttaaagtggaccccttctttacatcttatacaaaaattaactcaatattgattaaagacttaaatgtaaaacccaaaactgtgaaatccctagaagaaaacctaggtgataccattcaggacataggcataggcaaagattttgtggcaaaaacaccagaagcaatttcagcaaaagcaaaaattgacaaatggggtctaagtaaactaaagagcttctgcacagcaaaagaaactatgatcagagtgaacagacaacctgcagaatggacgaaaatttttgcaatttatccatatgacaaagttctaatatccagattctataagaaacttaaacaaatttacaggaaataaaacaactccattaaaaagtgggcaaaggacatgaacagacacctctcaaaagaagacatacttgcagccaacaaacatgaaaaaaaagttcaacatgactggtcattagaaaaatgcaaatcaaaaccacagtgagataccatctgatgccagtcagaatggtcattgttaaaaagtcaaaaaacaacagatgttggtaaggttgcagagaaaaaggaacgctgttacactgttggtcggagtataaattagttcaaccattgtggaagacagtgtggcgatcctttaaagattagatgcagaaataccatttggccgagcaaacccattactggatatatacccaaaggaatgtaaattattctattataaagatgcatgcatgcatatgttcattgcatcactattcacaacagcaaagatatggaatcaacccaaatggccatcaatgatagactggataaagaaaatgtggtacatatacaccatggaatatgacacagccataaaaaggaacgagatcttgtctgttgcagggatatagatggagctggaaactgttatcttcaacaaactaatgcaagaacagaaaaccaaacactgcatgttctcacttataagtgggagctgaataatgaaaacacatggacacacgggggaacgacacacactggggcccttaagagtggagcagggaaagggagagcatcaggaggaatagctaatggatgccgagtttaatagctaggtgattaggtgattggatgatctgtgcagcaaaaccatcatcgcacatgtttacctatgtaacaaacctgcatatcctgcatgtgtacccctgaacttaaaatagaagttgaagattaaaaaatgaaaaaaaaaagaattgatttcaaaaaaactaaaaatataacatacaaatataacaagaacatacaacaaatgcattatttaattcattaattaataaggaaactagtaagatgttaaaatcagtcttaaggagcatttgaggagctaagatatatggcaattttacccgagatgttagaataagatttctggcttagatacaaaattggtgaatgtcttagaggaccataaaccataatccttgggattataccttccattgaaaagaaataatttacatctctactggacaaaaatctatgggttaacgtctgcattctaagagttgtaaagtagtccaatcagtagtaagccaagccaaacactactctgcaaaaacactttcacctgttccaggttttggatatgtttttgacagtggtttttaaattatgtttcattgttggccaggactgagcagagggaaaactgtgaagaaggtacaatatgtacttgaaatcaggaagtacccacttcagccaccccataatatttctctacccctcccttctgccttgaagtgcctgagtcttatccataccagatatgccactatcgagaagcagatgacaggctcaggccttaccagggatgcacttgccacattttggaaagactacataaaaaacctttaaaaattggagccctttgggcctcaggtatccaaagagcacattttttggaaactcaacactcaggaaggtcgcatagagccagtttatgcaggtgagtattttgctcactcttataaggtccttataaggtcctcttcatgtctggtttggttctccttttcatgccctggtgagtttccctgttccccatatatgagtgactcttttttaaggtacctttaatcttttcttcatttagtttgtcagttaaccatgaagggctttttgctcaaagtttggtttcaatgttcatcataaaaatgacatcccaaaggagaaaatttacttttctatattttacacaaaaagagaatactagtaaatattgctaataattaaaatagtatatatatatatgtgttttcatagttttatagatttttaaacattgaatgatattcttagcgttttaaacagattatatctcattattgtgtgttaccattaggcaacaatgaaatgtttaaaatatttttaaagtattgtattttagttgtatcgagacatataagcctttcttaatttaggggaacaggaataagactacccactagacaattgaatctctggcctacagccaaattttacagagtttagatttaatgcttatcactttttttaagtgattattctttttaatttccctaagtcccccaaattagttttttgatatttactttttctgtgattattttgagaagtttccaatctttattttattttactttatttttgagacagggtctttctctattgcccaggctggagtgcagtggcatgatcatggcttattgcagcctctgccttctgggctcaagtaatcctcccatctcaccctcctgagtagctgggactagaggtgcacaccatcacatctggctaatttttatattttttgtagagacgggtttttgccatgttgcccagcctggtcttgaactcctggactcaagcaattttcctgccttggcctggcctcctttttttttttttttttttgagacggagtcttgctctgtcacccaggctggagtgcaatggttcagtctcagcttactgtaaactccacctcccaggttcaagcgattctcctgcttcagcctcctgagtagctgagactacaggcgtgtaccaccacaccggctaatttctgtattttcagtagagacggggtttcactatgttggccagacaggtctcgaactcctgacctcgtgatccacccgcctcagcctcccagagtgtttgaattacaggcatgagccaacgcacccagcctctcagcctccttaagtgctgggattacaaggtgtgagccactgtgcctggccagaagtttccaatttttaaaagttaaggtagttcttaattttctaattataagcattgccaacgcgtcagttctaagtgaatatgtttattagaaggcataataaaaagcaaaaattcgtcataaatttactgctcagagataattattgcttacatttgacacttggcatttttattattttttatacctatttatttacatttgtatactagagatcactggatatacaactgagcgtcttcatgttttcaataaaatactatatcattagtattatcctgtgtaaactttctcataattattatttaataatggtataatattcctttgggttaatggactataattcatttcactgctcccttgtggttggcagtttattttttcccaatttctcttttgtatagaatcctgtgagggcaatttttatgaaccccacaatttacatttacaaagttatttccatagaagagactccgtagagtgtagcaatctgctgggaactagaagcatatcaaaggctcttgacatgtgactccaccagtgcttatgtgtgcttatctcatggcctcctgactgggttcgagtttcatagattgttcagtcttttctaatagttgttttaaatttaatgtcattgaatagtggcttcattgagcattttttttcaaatgtgaattagcatctggacttctttttttttttttttttgtacgtgatctacatccttttagatagtggcaactggacagatgtaacattaatctgcactgtaggccaagtgcagtggctgatgcctgcaatcctagcactttgggaggctgaggtgagaggattacttgagtccaacccggccaatatagagacctcatgtctacaaaaagttaaaaaagttagccaggcatggttgtgcatgcctatagtcccagctacttgggggactgaggtgggaggatcactctgagcctgggaggtcgaagctgcagtgagctgtgatcgcaccaatgcactccagcctaggcaacagaaaaagatcctgtctcaaaaaaacaaaaaacaaacaacaacaacaaaaacactgtgtaaatgtatgtatgtgtgactccaggtgacttatttaacctctttgaatttccattctttcatttgcaaaatgacgataataatgaagacttcacagagtagtaagaattaaatgagatattataagcataatacttagcacaattcctggcagtggtaaagagccgttaaatgactttgttataattgttactaaaattataattaacattttttcaagtatctattggggaaatagatattttctattggcgtacatgagctttttatggattaaatacattattcatttgtcatatttgcttatggaaatattttccagtttgttcatgctgttttaaagtttgttaaattattttacctctgtttctgtgttttgtcaaaatgaggaccaaataagttgttacagcacttaacagaaacaaaaagtagccacaaccctttgggcatcctctaagcatttggtcattactatcattagcatcaggggacaggaatataaagagcatacagcacctactattcaataatgaggcagaagtcaagttgaaaagttcagttctgaagatgtcattcataatgataccaactcagattgtagttattttcaagtctaaacacttaaacatttattagagtaaataaccgttaaaaataagaggagaaaaattatcttctttcaagaacctgcctccaaatttatcttaacctctgaaatgcggccttcgtagtttcagctaaggccttgtttcatcagcatactgggtcataagttgaagaagaaaaaaactggagtaaaaaacttgaggtttcagatagtctcccccaccctctgggaattcactggtgactgatttaaatactgaaacttcacatgctactttgatgactatatattcagtcaccttcctttggattaaattgccatactcttattttttcaatctggttttctttgcaatgtttgaccctgtcacccaattacctcatttttggtggggtaaaggtgagaaaagatcaaatcactgttagtagctgcagaggctttaaaagactcatttaccagtatggttgtatcatgtttaaatttctaaatggctaagcaacatgtgccactctctgagtagacttaaaatgatgaaactaagtgaaaccatattaactacgtaaggggatcactaggatcccaggttgtgctatttgctagcaatcattacagtttatttaaactccgtgtgctagaaagttataaaatggcacaaggcatgatcccgatttgtagttcagagactaaatctatgagatttcactataggtaatctaactggtatttgtttaagttacagatacaatcagagcagcccttctcaaactttaatgtttatacagatcctctatacatctttttaacatgcagattctgattcagtgggcctgagattctgcatttgtaacaagctctcaggagatgcccctgttgctagaccatggaccacactttgagtaacaaggggttagaagcaaattatcaactgggagtacataaataattcactaggaagctcattaaacacagatttccaatgctactcccagagactgatttagcaggtttagggtggggccccaagatttcgaattcccaaccacctcccaggtgctgctgctgctgctgatctgcaaaccataatttgggtagctttaatttagaagtactcaaactccctgcatctcggacataaagcaaaagttaattatggtgagatgaaacatgggttagtggaaagtctcttaggttgtctagaaggaaactgggttctttgacacagagcttctctacagatctcagtttcctcacctgtaaaataagccaaatgatgagtgcccccctccccagatatctaacataccaagcagatgaatacacttttaatttgacacataagttttaactattttggccatgtctcctctaacattcgcaggacccaggacaagagtacaaatggacacctaatgccatatggataaacatttagtagttatacattaagccaacaagtacatgagacaatgatacaaattgcttattattgcaataggtgacttagccaatacgtgcaactgtcacacattcaactctaattcatgaatactgcccaagaccacagtttgttacatgaaagaaattgagatggatagttgtttctcctaggaaacaacactttattatttgagaatcttttgcacttaaggtattttagagaaaggatttgacaggttaattaattatttttccccttacctaagcacttctattgctaagtcctccctccactctgaaagggtgtccatctctgatgtctgcatttgcacaatccacaaccctttgtgacattcaaatgcagtctccttttattctgagatacaggaaaagagatgtaagcacctccctggggtctgaacagtgttaatgatgagatcagatgtttaggattatacatcacattctgccagagctgaacactgaatcccagtgaccaaagtaaattggcatgtgtataaaatacaggacccacggaaggggcacctatttattggatctagggcagtattattttggtggtcataagggaactgatacctgaacctgaatatcactcaaagatcactcatggtgcctgatatttggaagagacatttgaaggaccagacgaaccacttattcttttagatgctctaaaattgaaccgtataaaaagtagactatgccgaagtcatatcattttagctacatggagaaatcttgttccaaatcaagagataatgatataccctctggttctttgatgacagtgtggtggctatatgcagaatgtttctgcaccatttgcataactactgcttaagatatccactatgtcattcaatatcccttatatgagagttcaatgaggtagacgtccttaaatttactatcaggttaagaaaagagcagattgtctctttggacaacttcgtgtatttctttctttagctgcctggaagctcaacactaaatttagtattcatctgcaatacttgactcagcccatggtttttacacattaatatttcttttctctaaatgccttgttggaattgtacttttaagttcatctattttttaaaatgatttaaaataatcacattaacccaggaagaagcagcatataaaagaaaggaaagaaacaaactgtttaatgacctatcttgctgggttcctacaactcaagtgggaaaatatgtgcatggtagaattatgcaaattactgtgtaaaacttcctataatttgaaaggtattatgatattttatctacctcatgacccaagatggctgctggagttccagccatcatcaggttagagtatgtcagtgtagacagaaagaaaaaggaaagtcagaagagcaaaatgaaatcattttgatgtttttagcttttccagaagctctatgagacacttggtcacatgaccacatctactggcatggactactgaaaaatgtaacattttattcctggcaacagtgaacttagctaaatattaagtttctgttactttgaagaaagaagaaaaaatagatatagaaaatttcaatccctgccacaattctttgttcatattgggatgggaacttgttaattttttgttgtagaaatcacacatttggtttttcaaattgtcataaagttttaaaatatctgatgccacattggatagatttttattcaaatattttccacattttagacattcaaatcttacatcgcaaattagtataatttttaacaacaaagtaaatgagacggacaagacaagagacagataacttccagaattgttcatgtacaatttggctttgtttggggattgaatcaatggtttattttcataaatattgatttcttttcctggttgttttatgaaccgagtgggaagggccattgtattcagtctttgttttgttttcatttagtcacagagtgcagcagtgattgtggataattccttgactatttgtactttagattcacatcagatgataaattgagcatgagaaatatgttattaaattgactgcattgtaaattggcactttacattttttatttataaacatggtaccttttactcaatatccaggaaactttggataaatatgaatttccattaacttatgtgttaactgccaaaagctattatttatatctgaaatgaactaaactaagataatttaatcttctagtccaaggtcaagtgcattacaataaaacatgtttcatgaataaacatcattaaaaacacacagccattacatagcagtttttcataacacaaaaatctgcaaattgagtaagcaaaatctccactcactgaacttttaaaaatcctatgttaaattaataatctcacttcttctaagattatatactttattttttacacacagatagtaatgaatagatattcattgattctgatgtaggtggtgtataagtgactacgtttgtgtgtatgtgagtgtgaatggtataaaatattgtgctttgggaaagtcaaaattgggaatggatttaatgtctgtgtatcaatcaaccatgatatcaatgatgcacttataactcccttccccaataataggttttactttattaatcataattttttggtgggggtcactattagaaatttccattgtccaattttctcaccatgaccagccaagcatctatcacttgtttttaacttctcaactagttttcacaatttgttgtcctgtaaagtaataaatggcccaaattttccacacgctaattaaaattccatttctcatgaattctttaatcgagtgcaagtcattatgtgctttgttgatatcttaagtgcaaagataattgcaatgggcagcgtgaaaagggtttgattattgcctgtcgacgcttgtgaattctaataggtctaattgcatagcatcaattcatcatctcagcatcacttctttttattattagctctctgaattgtaatgtgctcataaagaagtgttgtagtatatcagagatgacatggtacctggcctattataattttcagcccttaccttgtgcaactcttgaaattaaaagtttattatggagtgccctttttctgaaactaattttaaaatgctcctgtatgatgaaatgaatactgtccaataatctacatattaatttgcctttgtaataattccattaaatgactgccaagacctttttcgctcagattgtgcctataaattcagaacataatgcattagttggaaaacatttgttaggctttttaatgggaattcctggtagcatttctcagagaatttctatactagagtgactatcctaaggctaaagaaagaaaaagattccactgcataatgatgtagaatcttccacgcaccccaataatatgactaaaggaccaccagcaattgagttgccaaacaccctatcatttgcatgtagggaatagaacagccctagtgtagagaaggaaagtaaacctttaattactctacagataaaataatgttctatatatgtgaggaagtgtgtctaataataatagacacaaatggggacttacaccctgtgtcaaacactgtactttaatcgttatctcaaataatctcagggattcttatgaataaagtttcagtgtgataattttacaggcaagtctcaaaatatcaccgaagatcaccagatggtatgtggcaaagctggaatttaaacatctagacagaagactcccatagcttgtctgctattttcaacacacactatggcatgactcagtcaaattaatgccatcagaatcagtaacagtgaactttggaagaaggatgatcatactgttaaagtgtgagtccaagtaaacccaaaaactaaatcacacttcaggggcttctatttttttttttaggataatatggtcagaagtaattataatccatgttaaggaatgagtcaagttcctagaaggagcatccatacagcaaatattccaagagatcaaggcaaaaccggtgaggcttatcaccttctgttggaagtctgacaacagccaacttagctaaatactaagtttctgttacttcaaagaaagaagagaaaatagatacaggtctgttggaagtctggcaacagccaacttagctaaatactaagtttctgttacttcaaagaaagaagagaaaatagatagaggtagagaatttaaatccctgccacaaattctttgttggtgttgggatggaaacttgttaattttttgctatagtaacaatatatttgattttacagaatcacttcaagatattttattggttttaagtattgggaagggatttatactccagcttttgttaaaggagtggcaaggccacattgccaaaaagcaaatgagctgagacatattgttttgggcatctctgggtaatacagcctgccacagggaatgagtcaacttggtgttactgcttgttgggcagtaaagcaatttgcaaggaagcagtcccccagcaggtataaattattgtttcaaacatctctctgaaaattactgtaatgagaaggtacccctttgccttgtgtgtgtgtgtgtgatgacaagcaaaagtaaaacttaattcattttctacagatcaaatgtttggttcttttttaaaaaaactttcaaactacgtggtttaggtataaatattttattgaatatattggttcatttccaaatataaaaaaaatcaagaagcaaatatggattctaaatttgctgtaccataagtaatttgcaatgaaacctacatctgaatagagaaataaattaccactcaaaaatttccattacttatgttctactttgaaaatcataggttggaacttacatggagctattgcttattctgtttaaaaagtatatagtcattctggttttaagaatttgagtaaaatttacagaataaaatgcaaaaatcttaaatataccatctggagttttgattacgtacatacatcaatcaatgtggagaatatttccatcacatcagaaagcattttatattaagtaatttttattgttctattttccctcatggccaatccagtgaatctttacctctcaaaggcactgctctgacctctatcaccatgaattatttttttcttttcttaatgtaaatggaaccatacacaatgtactctttgtgtctattttgttcagcatgaagtctttcatattatctatgttttttttttttttttttttttttttgagacggagtctcgctctgtcgcccaggccggactgcggactgcagtggcgcaatctcggctcactgcaagctccacctcccgggttcacgccattctcctgcctcagcctcccgagtagctgggactacaggcgcccgccaccgcgcccggctaattttttgtatttttagtagagacggggtttcaccttgttagccaggatggcctcgatctcctgacctcatgatccacccgcctcggcctcccaaagtgctgggattacaggcgtgagccaccgcgcccggcccatattatctatgttgtcacatgtatcaatgttcattattcttcattggtcagtagtatttcattgtatgaagcacaattagttcttccattctcccatatttttgctttttctgctattttttctagtttcctgatgcctcaaaattatttccttcatcacaccctctctgtttcaagaactttagccattcttgtagggtaggtctggtctgctcatgacaaattattttagttttcctttgtctgagaatgtcttcatttcccccttcattcctgaaggataagtttgctggatataggattctgggtttgacagagttttaattttatcatttgaaacatattttgccacttctttctggcccccattacttcttttgtttgtttgtttgtttctggtttttttttttttttttttttcagagatggagtctctgctctgttggccaggctgcagtgcagtggcatgatctcagcttactgcaacctctgcctcccaggttcaagtgactctcctgactcagcctcccgagtagctgggactacaggtgtgtgccaccacgcctggctaatttttgtattttcagtagagacggggtttcaccgtgttagccaggatggtctcaaactcctgacctcgtgatctgcccacctcggcctgccaaagtggtgggattacaggtgtgagccacatcacctgacccctctggcccccattacttctgatgaggaatccactgtaatttaaatggtttttctccaatatagataaggattcatttctgttttgctgcattcaagattttttctttgtttttagttttcagatgtttatattttgtcttagcatgaattcctttttgttgtattcagttaagttcactaaactttttgaatctataggttatatcattggccaaatgtgggaaatttgcagtcattatttctttgaatactattttagccccactttctttctgttcttctgagatttcagtgatatgattttagatcttttgtaatagtttcacaggtccctgaaactctattttttttgacgtttgtttagcctattttctattttctccttgttttccactttaaataatttctattgtcctgtcttcaagttcactgattcttccctctgtcctctccattatgctattgagtccagccactgagttttttatttcagttattgtattttttggttctaaaattttcatttggttcttctttacatcttctcttctttgctgagactttctatctgtttgtttgtttcaagcatgtacataactgtttattggagcatttttaaaaatgatggttcctttaaaatcttagttttaacacctgtgtcatctctttgttgggtctgttgattgcctattctaattcaagttgagattttcctggttcttggtataatgagtgattttatataataccctgtatgttataagactctggatctttttaaaatcttgacttagcagactttctctgaaactgtatcacactcacagggaaaggggattctgcctcattacaactgccatgttgtaggggtgaaggtccagttcctctttcggcttcctttgacactccagggaggcaggggtgttttctttctgctgagaagagttgggatttcagaccctgctgggcttcagctagtgccaccttggctgggaggggaaacattgtcttgttactactccccagttagcttccactgacccagtagtgaggaggcctgctgggtggtagtaaaagtgccagcttcctatgtggtctgctctgacattatatggggaggggggttgttaccaccagcaagggctgaaattggcttcctaaccagcctcctctgataccactcaggacaggaagtgcctcggtacagtgaggtgcaggtagaaatctcagctccccactggacctttgatgacaggggaagggatgaagccttggctttgtctgtgctgtatggttggaataggatagtttttatctttctgttttgttaggtcatccctttcctgtggtggtggtggtggtggtggtggtggtatttatttatttatttatttatttatttattttttagtctgctcttgttagcatttctgggttgctggcttctttgggacccaggctgaaatctgttaggcaaaaagaaaacccagaaaactcatcaccgtgttggtcctatgggctgccttcttctgttcacctttcagagtcttcttatatttgttttatgtatactgtccagggtttttagttatagttagcaggaggaatagggagaagtccatctgttcaatcctagtccagagctagatattttttgcttttctgtgagtattttaaatactaggtcttggtgagtgctaaagttaggaaaagatgaaaataaccttaggcttagaacagtgcttgccacatgttaagcactcagtgaggatcatcttattctctttgtacaatcctagtgtctctgaaattctaatcttcttttgtaggacaggttacgcccaggtttggaagaggggtgcaaagggagacatatccaaaatcctcacctcactagtggatgcagaaaccttcccagcatttcttaatacacatcacagaggtagctgttcctggcctgttcatgcttgtggctgacagtacatgcatatgtataaacacacataaaacctccaacttttacatattgatgaagacaaacaaacctaaggccaagacatacagactctgaaaatctttccagaaggacataggaagggatctacttcagttcctaagaggatggtaacttttgcctatgaatgtttgacctaatgttttctaatgccaggatggttctccatagagtttatttgtaaaataaaacattgtgctttctatggagactctttgtaattctattcctaaagaaatccctgtgatcagctaacataaccacatctgagggcttcagatcttctgatggacttgtgtcttttccaagcatcactgtagttcatctctctctcactatttatgaactccacgtacattttcactgctgtcaattgactagtttgcactgaaatatccaagcaagctttgtgaaaaaatggaagtggctctcagtccttagatttgtaggcagttgtgtatggcacatagttttctttactatatgttctttccagttattggtaagaaaggcagtcacagaggatttgtccagtgggactccagtggcaaaggtttatctgactctttccagtagcactaaaaacacccctggacagatttcatggagttaacagactctgttttcctggtcttatttagaagtattgccttccgtgttttgcatattctgggcacagtcaatatcaaataattaaccatttcatctgttcaagcagccatccaccatctactaactgtcatgctcctgaatttacaggcacgtccagcaccgtttcttttattcttttcttctgtttttttttttttttttggtttattttgtttagcttttgttatggtttagacttgtgtctctgcccaaattttatatcgaattgtaatccccagtgttagaggaagggcctggtgagagctgtttagatcatgggggcagatttcccccttgctcttcctgtgatagtgagttctcatgagatcgttgtttaaaagtgtgtagcacctccatactctctctcttttctcctgctccagccatgtaagatgtacctgcttccccttagccttccactatgattataagtttctggagccctccaagccatgctgcctgtacagcctgtgaagccatgagccaattaaaccacttttctttataagttacccagtctcaggtatttctttatagcagtacgagaatggactaatacagcttttttcaaacgtacaattcagtggtgttggcacattcacagagttgtacaactgtcaacaccactatctaattccagaatatttttgttgccttaaaaaagattctatacccattagtagtcagtgttcattcccccttccccactccttgacaaccattaatctacattctgcctctgtggatttgcctattctggacatcttatataaatggaattatatactatattctcttttgtctctgttttccttaacttagcataagatttccatggttcactcatattgtagcatttatcagtactgctttcctttttatggctaaataatattccattagatggatatacatttggttattcattcatcagttgatggacattgagttgtttccattttgagctattataaataacgcagctgatgtggtttagatctttgtcccctccagatctcatattgaaatgtaatccccaatgttggaggtgtggcctggtgggaggtgttttggtcatgcaggtggatcctttataaatggcttggtgccgtcctcacagtaatgagtgagttatcactctatgagtccacgtgagagctggttgtttaaaagatgctggaatttcttcctcactctcttgctctgtctctcgtctcttaccatgtggcatactagctcccctttgccttccaccatgatcgtaagcgtcctgagtccctcaccagaagcagatgctggtgtcgtgcttcctgtacagcctgcagaactgggaaccaaaataaacctcttttctttttaaattacccagcctcaggtgttcctttatagcaatgcagatggactcataaaacagctatgaatatttgcatataagtttttgtgtggacatgtgttgtcagttctcttgggtagatcctagcagtggaattgttgagtgatatggtaactctgtgtttaacattttgaggaactaactgttttccaaagtggcatttccattcctatcactgatgtatgagggttttaatttctccacatactaacacttattaatatctgcctttttgttgatagccttcctaatgagtgtgaaatgtcatctcattgtagttttgatttgcatttccggaagaactaaggatattgagcactatttcatgtacttattggccatttgtgtatcttctttacaaccatttctcaaacccttctttgactcctccttaaatctattaaaagacaaattacatgcttagcttttttccttcattttggcctgttcactttttggcttattttagaagtatgctttctttaaacttcctttcttctcacaattagtgcacatgcacaccctgatctttttataatttaaattatttcaactaatgtctcaattaatgtcatcaatgctctgttgacatttaatccagaatgagctcttcctactgcaaaatgagctctttttttggcgctttgttataatttatgagaactaaagtagagagtagacaagttttacttttggacaagttttgcttccacatggaaggatttaaaatgatagcttgtcattagtgtgtgcgacaacagggcaaggcaagccaggagaggcaacacaggtcaaggtcattaacacaatataatgaatgaaagatcatagctgtgggtgcagttggtgtgagtctggtggacaaaaacaaggtcagagtcttgggtgccaagctgacactcaaatatcagtgatgggtaaaattttggtaagagagctgtacactgccatatagtacaactctacatttgacattttgagtctagtctagactggtagttttcaacctgtggttcctaggccagcagcatcagcagcatctgggaacttgttaaaaatgcaaatcctttttctccacccctactccattccagacctactactgaaatagaaatactgagagtgtgacctagaaactcatgttttgttttaccagaacctttagatggttttgatcgccctcaagtttgaaaactactgaccaagacttttaaggaggtgcaaaaagaaaaggtggttggagatgtcgccagagtttaggattaagtgagaacacacaacaacaagggtatggctgtagccaaaagcaagttaagcatagcccatgctacactgctaccatggaattaggcaacattcacttagccagaatttacttagtgactggttgttggaataggagagtgggccctagaatgaaggagacctgattattctggtgcagggaggttcaaggagagcaacccacgtccttacttgtcttcaatttgttatccctagtgtatcaggcattctgcttgttaaagggatctgttatattttcttctttggacttaaattactcagtataaataatcagcctcattctgcatgcattaatgaactccattagaaggagggaccattttttttttcctatgttggttaaggaggcctcttagcaaaatctaaagggaggtcttctccccaaagaattgtttttgtaggccttttccagtcaagaactgtgacagagattgagtttatgctgggtgcagggaaacatggagtaagtcacgtccataaaggtgaaggaaggccaatgttttggcatgggtaagttgctaagtacagtgtgggtgcatctggctctcacccttattccttgagtgaagtcattcatccaagttggcaagagcaggtcataggaaaaatgaggacatctggaagagtaaatggtttgtgagaggggccatctctcagataggcccataggctttctctggaaggatgtcagaaagccacatttatcagaagctgcaaacacagccagccatgtcctaggaaggacagtgctctttctatcacaagagaattccaagggcaattttctgttttctttttttttttattttttgtttttttgtggagacacggtctccataaaagaaaccagattggtcttaaattcctggcctcaactgatccttctgccttgtcctcccaaagttccgggattacaggtgtgagccatggctcccacccccttcttttctgacagtaggaaaaataaaaacacttttatttcatttccagcttctgtgctttctccagctctttttcctatctgaagaagtacacaaaaaatatctatgtgacaaagctcccaagccaggatccagtatgactttatttttctctggctgtgtccaggatcatggtgacttgacccatttagaggaatgccaccatatgctgctagcaactgctgaggtttggcatttcacaggtttctcagaacctaagaactaagtgaggactccaagaatattccatggactctaagtccatggctagattcccaggcccagaggatacatttggaaaaggaccaaagttgtcgtcatgaaattctatacattgcaagcctgtaatcccagcactttgggaggccgagatgggaggatcgcttgaggccagaacttcaagaccagcatggtcatcatagcaagattccatctctaaaaaaacaaaacaaaatgaaacaaaacaaattatataaaaagaacattaaaatgcaagaaataacaaaacatatttgatttaatcttgtgaaaactttcatattttcctaccaataaaattgtctatgacaattcctttagaatggttaatttggttgtttaggatttttattgtatagcagtgtcaaacacattcttgccattcacttattctgttaaagagaactattgacactctcctaactgttgctccttcaggaggagataagcagtaagactgttaaaattctatcaaaatactctattgatatcatgtgctgcggcttcaaaacactactcagtaaggatgctttggaaagtaactcagctgcctaatgtgtttctgctttaaaatatctctgggcagctaagtttgtaacaaggcatataaatctaatgtttagggtaaaaataaatatcccttttggtccaagcagtttaaatagtacttgtaattaatgcataataattaggtatctaaaaacaactcttcaaaactgaactatagttttctggcaaatgtgtaaatccatgtttatttaaagtgtattatatttataaaagatgaggtataaaataaatcgggcttaaaacaatgctgtcatcaattctaaatgaagcactatgaaacagctagttcaaagtcatgaaaatattgaatattttttttctcctttttctcctgtattttgtgtgtgtgtgtgtgtgtgtgtgtgtgtgtgtgtgtgtgtgtgtattttcaaccaggaagcatatgcttttttatcatgttgggaaaataaaatcctaccttttaaccttaaaaaaactatgaagatcttagcaatttctacaattcagttgtttgttaggtgaggaatacattccttgttaaaatatctatttgcataatttggtgagcaattacattactagtgttcttttcttatttgagatactctcccaaggaattgattatttgcattacaaataaaaccctgatgaaaatacataaaatacataaaatttgtataaaactatatatttatataagttatcagaaaaaagtgtgaaggcatatgttaagtgaattaaaatccactaagggcttgttattaccaagtcttgacctaggcaacaaacatatttatatccagtcaaaaggttggtagagaaaataattacatatgacaaaagtagaagttataaaaatgatgttccagtaagaagagaaagaacaaccagagaataaaaattcttggaaataagaacaaaagtttcagaatgaaagaatgcatgatggaaaggaaacagctgaagacttactgtaccagaagaataagtcaaggaaatactctataatgtacagcagataaaatatttgagagaaaatcaaaggaaatgagatttactcctagacatataaactcgcctattaagagttctagaaagaatggagaaaatgaaagagtagtaataattttataactagaaggagaaaaatgtcctgtcctgaataaggcatggtgaaagttcaaaatcccaagtataaaaaacagttagaaagaatgaataagacctactatttgataatagtacaaaggaactatagtcaataataatttaattgtacattttaatataactaaaaagtataattggattgtttataacacaaagggtaaatgcttgaggggatggataccccattattcatgatgtgattattacatattacatgcctgtatcaaaatattttatgtaccccagaaatatatacacctactatgtacccacaaaattaaaaattaaaaaatttaaaaactgagaaaagaatttcaaggataaataggaagttgataaaacttctggaaaggagaaaaaataaaaataaaaaacagcttacttatggaggtataaaaataaaactgtctttttctcacagtagacgtgaatgaagaaaaatcttcaacattcggagagaaaaaataatttttaaaaattagaaattgagtatcttacataacaaaagaaatgagtagtattacggaagtctccaatttcttcccttttcatgtttttaaacccactctatattgcactttgtcctcaggcttcgaccctcacgacggtaagctgactgtgacagcgacaaactttcacactgagaagtcaaaggcagaaatgatggggattattttcctcactcatcttattttgagagtaagcgcttttctcagaagacgcccgtgaaactgctcctcacattctctgcccatttgcttctcaccacagtctatcctttttctttgcttcatttttctccttagcacttgtcactgtttgacacactatgtattttacatctttcttgagaaaaattaattttgaacctggaagcatatatgtcagaaagacagcattcagaattgagaacaaattaaaaacatttggaaatgcagtggcttaggaaatttccagccacagaccatctctgaaagaattactcaagaatatacaccacccgcaacaacaaaaaatgagtttaagagtgagaagaccaggcatccaagaagtagtagaagcaaagaaaccagtaatatgtcagttctgacataattggttaatatgtataatcatgaactttgagagtataatgatgaaatattgactaaatagagaagaatgtattcctatcccatgtatgcacgtggtaaatgcaactacgtagaagtactagtgataagtagtacttctcatcacctcccacatgccaggtactcgacttgatgctttcacatataatacataatttattccccacacaacaaacttgacaagcagatattatcctattttttagagaggaagaaaagtaatttgccccagttcacacagtgagtgagtggagtgtgctgttgggttatggagacttgtttttcttgctctctcctgatatcatgctgtctgataataattacacattctattgatcttttttttctgatattgtcagctactgctgtgtaacatattttcctactcataccaaatcttcccatttttactgccgctaatttctttcattatagtgcctctcaagccattttctcatatcatctcaaccacaaccccatttctaaataaagaacgaaaattgttattaattgacctgcatgacaacagtatattatcagggagccagtcaccagatattatttattttcaggtttttttttctttttaaacctgatactcatcaaagcctgcatgcaaacatttcattcttggcatctgaattactgtggaaaggtctcttggttttcttcgagtgcttttacattaatggtttctactaaataatctcgcagaggcacatgttgacctctgtgctcttagtctcgtaatgaattatgttggaaaggctcagtgatatattctcttcccctcactgattctatgtcaggcccaaaataggcaaagaaagggaaaagttaaaaaagaaaacctgtcttgatactgaacaaaatgagttattttttattgtccttttttcttttactcttaactaacacttctcttattcttgtcccctttctgcatcttatttctatgttgaggataggctctcagaagacctgacaagcactgcagtaactcacaccccaattctatttccattctatttccctatttctgttactaactcagtcacttagagtcaagctccttgaaatcaatttttacactttgttttctcttttcccatccactctaaaaccatcatcacagtttgccagttcaactctaagattcttgaacggtctgcctctctttttcacgccttggactctgctttcatgtcagctgatctcttcccttttgtagcctccaattcattctgcaaaggagtaagcatgaggaagtaaaactactgtcatgattttgcatgggaattcatgttcccaaagaatatctcttggctttactccatgatgtcttatagaattcttgtttaaaaagctgctcccacccttctcttctccatgtgaatcagtgtatctgatagcagtcatgttggacttttttccttgagtctttgcaaactctttaagaagtgcttttccattctcaagaggatggtgagtggaaataccccgattatctcaaagaagaggaaaaagcaattactccggattttgaagattgagcagaaaacaattgcatttagttaaaattactcttaaaaatcccagcactttgggaggtcgaggtgggtggatcatgaggtcaggagatcaacaccatcctggctaacatggtgaaacacttgtctctactaaaaatacaaaaaattagccaggcgtggcggcgtgtgcctgtagtcccagctactcaggaggctgaggcaggagaatggcatgaacccgggaggcggagcttgcagtgatccgagatagcgccactgcactccagcctgggcgacagagcgagactccgtctcaaaaaaaaaaaatcccttaacctacataaaagtgaaattggtgacataccagttcaaaataagttcaatacaaatgattctccctatggagtcgaaagacatcactgtttcttcaaacttgaggacagataaaatagttaatgatgttgcattggaaaagtaaatattatttattagatctgcacagtgagaagctataatgtagcagttctgaaagtgtcaccagaaagtttgaaaatagctctagtgcacagtaaacccattatctctgaaaagtaggtgaggatattgactgatctactgggcccagcaatgtaagccaccctgctcctactcctgctgtaacactcactcatttaaataaatttaaataaattgcccttattatttaaatattttatcattctcagtccaccaacactttgttcatattgttgaatttaaatgagttgaacttgtaaaataatgtaacttcacagtatagaaattttcacatattcttttggctagaagttatgttaatgtaattcttgaagtagcctcttctcatttgtcttttctaaatacaacagttccttaagaaaatgagatgtagggcctggagtgaagacgtagagcctaggtttagtgcagagctgtcctatgaatggatcaatttcagagagaaatcagatccgctttattttggtggagaggtggattcattatatctaaatgctactttttaaagaaatgtgaatagtgagcccattaattccttcagagggtgtctagaaagtctgtcatgttccattttgtgatttgagagccaaaacctatctctaaaacaaagcagatttattctaaaatgagcaatatgcagatgagggaaatgacaggtttagagaatgcacttatttaatcatctcctgaaaaaaaaaaaaaaaaggcaaagggatcactgcacattttttttttttttctgtttgagtctttggatagaatctcatagcttttgttaaagagtgtgatagtgttagaatcttatttttaaatcttccatagtgcagtcattaggagatttttgatgaggttttgatgagtctttctatgaagaaacagcttttcagctctataaaatgtatgctgaatgagctgaaccagtataactagatgccattgcttgcccagtctagattatcccttctacctcattgttttctctaatctggtacatcattcctgattagattgattatatcgggccaacttttatttaatcacccacagattcactaattatccattaagcaactgttcccatagaattcttggctttgtgggaaacacagacatagatttgtcatattccctgcagtggaagcatcgagtcactgcaggaaaacagaaatcacagaatcatgacattgcagagttagcaagaatcttgggacataggtagtcatatcggattgccttgaatgatagggcattccctgctgcctaaggcaggatgccatatgattggagagctctgaccgatggaaacttctcagaaatgttcgtgttcaaagtcatattaatggtttatcgtaagtgatattatagagcaacagaggtgaagtgaattcaaactctgttcatatagaggaatttatggatctcatctttaaggaagcgaaattcttcacagtgtaggaatctccatgagaaactatttcataagaagaattttcagagaaaaaaatggggggggctctccagaaatggggaaagtcctgtagtcagaaaagcacagacctgtttggtgagagtcatggaacaattgccctatgcactggcacatagtgggttctcactaaatatgtattatataaaggacagaattaatgactgagtggatgattgcagaagagtctttcttgtccaggcgtgtggtggcacgggagtggtaaaggaatgctgacgacaagcacatgcaacctcagcatcagcctgcgtgtcccgacattgacccatctgcacatttcagtcccagcctagattctgcatttgtagaattacccttgcagtggggactaatattcattcattttacccacagtatagagtctttaaagccgattttctcctcacatcttaataaaatactggttttgcatctctctgaaaaggctgcaagttgctgacatctcttgaaccagaacaaagatcttattatcatcttccttgaaacagtcatattgtctatttggaccttcacctcctctcacccctgctattgaagcactagaaatgccatgcatttgactcacttccttctgggatgtgttctctttgggttcattctaaaatgacatgaaatgttggaattctgcagataattcagcttcccacatttcctctgagacccctctctgttggaaataacactattgtgatgcagatgcccccaataccctgtggaatctcaaaactatcaatggctgaccacaggatatcccttttccatgagtttcaatctgtgttattaaaaagggacccttacatgtaggagtccaatttgaaacaggatacagtcccatcaacaaggtcagtctcaaatagatttgtgcaggaaagggagagctgataaaaaattaaacatgagctttgcctctttcttttttaatatagaggatggcattttggtagaaattgattgaatgatattttataacgtgggcttaaaacatcacagctttgaagtcaatgaagaataaaacatattatcagcacatgatgccccaaacataataacattatcacattctcatgtaaaaatggaaccaactttccagttgagctgaaagtatgcatttgagctttggcagtgcattctgtatgcctctatcaactgtaaaatgcaaatgtttagttgctgtgtatgtaaccttagacatagatatcttatttagagaaccatagcatcaaggagggtgagagaggtaaaccaaaagccctttgtaaccaagaacagtgaaaaacagcaatgggtcaactcacaaactcaaaggaaactagatttaaaaataacattgtgaattctagtttatcccaaactcatgcaaaaagttgaatgactatagtctttccggacatagacagaaatccttcatacagctgaagaaatgtatgagagtaatccgaatttagaaaaatgctgcagggtgtgttgaagtacattttcaatgatatcttcggcagattgaaaaggaacatcttatagacaattgattgtttcttgaaatataataaaaacaaacttcgaaatgtgtatatgaaaacactgacctatgtggaaagaagaggcagcatttactttgtaatgctatcaggtggtaattcaattttctgttaactgaacttcaagtattctgtttcaggtcatagattggtggtgcttatataaattggccagtaagatttacaaatagtacctttagtgctcagttttgtggttgtatctctaaaaaagaaaatcagtttaattccatgcattggttttcttcttaaaattcatgcaatttgatatgattgacaaggcacagcattattatgcagtctgttagaaggaccgattatgcttatgaatacaagaatggagtgaatgaaagcaatgtgtaattgattctacacttggtctgactgttcattaacagtttgaatgtagcgcagttgcttctcaaatggaaaatgatgagagcaacctatctgtgctctctcatttgttttaaaattcattatgctaatattttttcacagaatgtttttgctgcatttgttttgccaaggataagtctgattgaatctttgtaaataattctactgctttcaatatttatttggcatttcaatcacatatttttcaatttacacttttggaaatgaaagtaggctctcccccacacctctttcaaagaaaaccttatatcctatcctccttttctctataattcagactaatttcccaggataaataggagtgggggagtgcaaagtggtgcgatagttatctcttcagaacaaagaagctgatttacagactgattgatttcagaaatagatgagcaaaaacagattccatttgtcttgccacactttagtctgatgaagcacaaaagggcctgccatctcattttccatagctcttcaagaggttgcatttgaaatgctgattaaatgtacaaatcgcattgctgttttcgtggctttcctgagtgctgtaggagagggcttcagtgcacaaaggctgcttttcctttcttgaatgtggagctggacactttagggaaataacatcactttcaccactcataggaagttatgatgctaattctgtgacagccatgtctgccctttcctctgtccacaggttcctgccacattataaaacaaaagaactaaaccagcactgtgccagtcatttctatctaggggctacaattacattcattattcccaaattagattgtgtttacaattaatactaatctcatgtttcaatctttggctacctcagatttttattaaattagcagttgactgattgagataataggtctgagaactccatactggtaaagttttaatcatctcagccttttctctgatttcttatttatctgccacctgactttgtacttggggctcaccaaaataaagcgccaactgtctggggagtcctgcattatagctgttttaagatatgttcaaaatttttttactgctcttcccatcaagaggtgaggtctaggtccttccatctgaaaaaatatgagatctttgtgacattggcaaccagtagaatattgtggtagtgatgctgtgtgactcccaagcctgtgttataaaaggcaacatggcgtccacctgctggtacacttgctcttagagccctgagttgtcatttaagttatccaactgctctgaggctgctgtgcagtgaggaaacccaaactagcccacatggagagtccttgagaccacatgaagagagaaagatgtcagtccagcctttggctcccacagtcctccactgctccagtgccagccaccagttgactacaaccaaatgagagaccctaagccaaaccccctagccaagccattgcagaaggtctgacccatagaagccaaaagaaataataggatggtggttgctgtgttaaaccaccacgttttgtggtaatttgttgcatattgcaacaaatctaaccacaaagctaaccagaatttgcatgtatacaagcatgaggctaaagtaatgagattcatgacaaacatgccaaaatgtatacatacaaatgtatgccattcatttctttccataaggagtcaccttgagaggaacttactcataatcatattgtcactgtgatgttgtcattgtgatgctgtcattatctccccacattgatctctgactttgggcacattattctgtctctctgggttgcttgaaaagtaggcgtagattaaatttttacatagtcttttcttaatctctaaaaattcttgacaattattcaaaattctttggttgttgaggtaaccaaaggaggagataaccaaaggaggagcataagaagtatgctctggccgggtgtggtggctcacgcctttagtcccaacactttgggagaccaaggtgggtggatcacttgaggtcagcctggccaacatggtaagttcgagaccagcctggccaacatggtaaaaccctgtgtctactaaaaatacaaatattagcttggtgtgatggtgcatgcctgtaatcccagctactgaagaggctgaggcaggagaattgcttgaatccaggaagcagaggttgcagtgagccaagattgcaccactgcactgcagcctgggcaacagagcgagactttgtcttaaaaaaaaaaaaaaaaaaaagtatgctcctatcctacgttaccactttaatatgtaaactgatgtcacactcagtgtacatattaaaattatagtaaaactttaatggttgatgctggccatgtaggaaaaaaatgccctcttgttcatcatttaaaccctatatttatctgaaaataattttttaatataaagaaattattgaggctaggaaaataaaagaaagatatacctaggggagtcattctgttaaattccttgaaattatatctatctttttctttaagagtatttttatatgtgtaatgatataagctcatctttggaaagcacattaatgatctttacattttataaggacagggtaaatgggattccagaatatggattaataaatcatatactctttgtttaaatgttttatttaatttttgaatagctaatgtattcacataacttgaacatcaaaaaataaaagcagtgaaaagtttcctccccatattccctcccccatcttcatagtttctgtcactcttctagtaggtaaccactcttattaactgctagtttatccttccagagatgttttatgcatgtagctaaaacaaacctatattcttccctacatcggtagaggaattttttttaacactaatgttagtgtgcttttctgaattttatttttatgttgtaatgtgtcttgggtatctttccatatgcatacatgaaggccttctttgtctattttacagaagcctagcatttcatagtataaatgaaccatcgttttactaacattgtttagtctgtcccctatggttggacatttagctgtttcccatcttgccttattatatacaatgtttcagggaatgacctgtgtaaatactgttctgcatatgggcgagcatattatctttaggatatattcctaggaatagaactgctggatcaaaaggagtctacatttgtaattttgttagatatgattaaatcattttctctggagatagtgccaatttgcacttcgctgtataatcgtgtttgggaaacgtgaaccatgattgatgctcatttatctggacaaaaatgaattaaacttcttagaatctttagctcagttcctgatagacgtgtacagaaggagatgcacttgagagctgcaaaaaaaaatgttattctgatttattccttcttttgactttgaatactgaaggccaaagaggagagtgacttgcagaaggtcacgtagctgattagtgacagatctgggacttacaacctgtagtcagatcttaggattggtgttctttccacatgagtaaagagatggtaactttctgtcattcctgcctgtgtgctgaggactccttgtacactgctgctgttgatgatgacatttaccatttcttgagccttcctatgtatcagactttgaatttaatacttctatttacattatcttatttataccaagggattcaaaacccatgtgcaagataaagcattgtccatagactttgcatccatgtatattacatatatatgtccactatgaagatgctacagtgtttaataaaacataaatcaatacaaatcatcattaaaattataatagctgtttgtctctaacatgttctcaatggattttgaaactattgtgaaaaattagtcatattttgatattaaaaagaattcttatagtcaaaagcctatgagctgcttaaccatgtctcagatcacttttacctgcccagatattctattttccatccctctccattataaggttagatattaataatgctacacaacacagaagagaccacagagataatctaagcaggagatttattttataggtaaggaaaaaggcaagcaccactgaaaatgatgggtttatctaaggcacttgatgactaaggggctggagctggaattcaaagacaggcctcctgactgaatttaactactccacactgagaaaatgagaaactcagtgtggagtagttactcataagtactatggacaattaaaataatgaaggagatttcctgtctagcctcatattgattcacctccagctttgtggatctgagaggtcatcatgttggtcgataataacattcgatcttggatgctataaatttaatatagagcataaatacaaagatcaatattttaatgctgaggaggctcatttattggctgtttatcctcagtcctttaaatgaaatggagaactaaagaaatgcaaggaataatttttcataaatttcatttaagttttatagacgatgatgactaaaggaaagcaaaggaaaagtttatgatgtcactatttcctacacttatgggcttttctctctttctctttttctttctctcccttatccctccctcccttctccctccctctttcccttcctccctcgcccccgttaatatctctaagcctcttctttactttgctcaatgttttttattactccagataagaggcacttattcttgatcttctccatccacaaaataagagaaccatggtcatgtcccgttgttctttcatgtattaagtgtttgatgtttagaagcagtggggaaggggctaaaaagcatagactttgtcttcaacaatgggaacaagattgccaaaatggccctgaaacaacatttcccaaaggtgaaattgtggaaatctagtcctataaggtgttcttcaaagcacaggtttcaatcgtcaactgtatttaggaaacagagcattttatattctcctcctggagacgcacaactccttacggcattttaaatgcccactgaagtcttgcagtaaggtaactggtgtgatagaatttcacctgttttttttttttttttttttttttttcaaatttaattgacctttaaacccatatcataccgaacccatttggggaaatgctgctttatagaattgtgtgttattctggttcaatttttctgtcatttgtatccatcagaaaacttagaatatcatagttgggtataaataacaagtagccaccagaggggaaataaagtaaggctaagcaccatctccttcctttatggattctaacatttattaaagaaactaaagtacaatattcatataaatatttactatggtacaggacttgcattgcttgaatttatgcaactcttgcttgttacttttattacaaaaaaatgatatcactgtgtgctattttttttcctgagtacacctcaagcccatttatccttcacttctatattgtagtggttctcactttaaaagtaagtttacctgtgaaacaatatctgcgtgaacttattagtgaagttttgtatgcctcctttgatcacatgagatgagcccctcttaatatcggctgacaagggtttaaatactgtttcagaattaatcatggaaaccaatgctttaggtcttttctcaaacatcaaatagtatcaacatttagtgggcaaccaacagagatttttcttttcttttttccttctttctttttttttttttttttttgagatggagtctcactccgtcactaggttgtgaggtgcagcggtgcaatctcggctcactgcaagctccgactccctggttcaagcgattctcctgcctcagtctcccgagtagctgggactacaggcacacaccaccacgcctggctaatttttgtatttttagtagagatgggatttcatcatgttggccaggatggtctcgatttcctaacctcatgatccgcccacctcagcctcccaaagtgctgggattacaggcgtggtccactgcacctggcgagatttttcttttagtgacttatttgctgctattgaaatgccatatgcattttttaaactgtaccatattcttatttttgtatactcttattcttctgtcattcttgttggaattgagtggtaacgattagtcaacacaaataatttcgttataatactccaattacattagactgaatttgtctttgtgatgaaagttgattagttgttatgatttacaccaatgaaagggactaataattcagttcaccgataagactgggaagcaagacttacaaggcattttcaagtaaatttgattaaaacgtggggtttttcttctgctctttcttaaaatgaggacagtcccctttcactacattcctaaaattaaaagtttacgtgtgtgtagagattaaaagaatagcacaatggcttgttgtgtataaaaaatatcaagttttgtatttttcaacataaataggagttgaacagtatagattgcattaaaatgtttgaatgttttaataatacaataaaatagataattaactattaacctattaaaataggtatgaactattagcataccttatgtaggtgaggattggtaggctatacttcaaaattggcaggaatgttttgcaattattcttctcaaggttattaatgattattaaaaattctcttggtattttttttcagaaacttgctcttctttattgtgtacaatgcctgaaggttgtcttagaagtaagctaggctagcactggctcttcccgtgccaatccagatgttccttttgcaggcaattactcctcagtttatttccccagtttatttcccgccaaggatttgtctttttccagggagccaattatgcacgtcttatactataatctgtgtcacttgaatctgaccaaaaactatgaaacaattcacttgttggggattccttttcacaattatcattttcctgggaaattgcctactttaggaggttgtgctacttaagatcttctaccagagaaatatttgcgtcgccaatgtattgcttagcttgcttgtctccaggctctaacacaaatacctaaaataaataaagtattaattatgtaaaaaaagtgaaaaatacctcgcttatcctctttttccttccttttgtatttacagatgtcatccatactgtagggccaatagccaggggccatattaatggttcccacaaggaagaccttgcaaattgctataaatcatctctgaagctcgtgaaagaaaataacatccgatcagttgtaagtaattttatgttttttatttctcactctttttcaacctttatgctttagtaatctgtcttgtctaaagagaggtaggaaaccatttccaaacttttgagaactaagtttaaggatcttagtagccgatttggttatcatgactctaatctttgatgtgctataaatatttgctaaatttttcatgatgtttcagaatttaaaactataaaacctcagaactggatttatcttatctactttttcctctttattttgccacttactttcttttggagaaagtaaatattatggtagtggccagcagatttaaagaaggaaaatagcaagtgctgagtttgttatgatagcgcacatttaatatatattggttgtatgcttgtgcattctggagccatgtttaatctctatgtacatgcatgaatgtgtgcatgcattctcatgctagtgtcagacatgatttatctgcaggaaattactctgcgtatgtattttaacctgaatgttgttattcttttagatttattttactcttattaaactaatattctgtaggtggtagctgggtataccacagctcttctaagttttatcagtagacaaagggagttcagaaaatgtggatctaatctatttccttaccagtaggctgagatgaaaggaattctcttctagctggatttggaggtatttactcacctgcttttcttttgcaacatgttctacctttattacatctcaattacaccaagaaaatcaaactatagaaaaacacactgtaaatatctaataataagttaatttggctggaatcccttggttgttccccctcccccatatagattatagccttgctgaaattgtggggcagaaaaaatagttaaatgcttgatttcatagcagactgaatagatcagcattgcttgatagttcacagaggtagtggttttattatttgcatgaagaaattttgagaagcagatacatttaggtaaccctggatggttgttatgctttttgtgcatgattgtaattatgaagtgcatttttcaatgcaacattggtgattctgcttgaaataaggaaacttttcatgacctaattatatagccctttttaatctttggataattattaacagagctggatattttatttctctctttgattttctaaaattttgttcgcaaatggctcaatacataagatcctattctctcttagaggtgaaagctgaagttcaaagagaatggagcaaagtataccacaagaccagttggttaattttgttctctataggaaaataagaaaaatcaaaacaggtatgcacatttagggaataattaaaattttgtcaatatggcttattgatttaaaaaagcaaaagactgaagtgcttggaaaatggatatgtagagaagtttccaacttggaaaatatggattttgaggcctgaagagaatttgctagtggaatcactggcatctctaatgacttgtttttaaaagccaagaaaaagtaagaagtaagaagtttgttagaaacagtataaaaataacattcaaccttttaatagagaaaggaatctctaactgtaattatcttaaaacaatcgtgttactctatttgctaccattaggtaagcaatggaagaattatgggctaagttaactttttaacagatggcatgcagatgggctgaagtaatgctcctgtaatactctagtcattctttgataggaattagatctaccttaacatctttgatgattattttgaagggccaattacatattacttgaatgaaattagcaggtaaggctgaactgaattcatcccaatattagtaaataaaaatggagatagaaaatacacaaaatgtgggaagaaatgtccaacgaaattgatcatcatgttttgcatggtagactacagttgccatcaaatgtcttgtctcttttacacataaaaaagaaaaatatttttcttttctttctccctccttcccttccttcctttcttcctttcttcctttttttggagtaaatggggctctcttctttatatggtgtgtcatgttcttgatcaccattaaataaataataatgctaatctcatcacattctgattatgtagagggaaatagaaaactttcagaaacatgattatgactggatacatgttttatagtataggcttgtattttgtcaacttatcacaatagatggtagacatggttgatataaaaagcctggttattaggatgaaaaataaacttaacttgaactcatttatatacatgtcaaaaagaatttctcataaatccttttatcagagtggcttagtgtttgctttgccacttattactgtgtgactgtggacaagtaatgtcaacattttgtaactttggtttccacttataaagaatcagtaaattactactgttattgcagacctgtccaactcatgtggctgttgttatagggatcagtcgggataatgtgtataagataattggaggaatggaattctctgaaaagtatttgacaatgttacttcaaatataagatgttttcacacctcatgatttggcaatttaaggaaatatcacttatttctttgatatctattctgaacaccagaactctagacatttaccatgtaatttcttgatgtttttaaacaacagggaaatgtccaggaataaattaaatatttgataggcaccacttttctgctaaggttaaaccaaaggctttaggatcacagcacaggatccaacatatatattcttattcttattttaccaaaagaatagattcttcaaatatttttaatggatgtaagacaagtagtatgataatttatttaataaatatgaataagacctactgtgtaccctgacgttatcaggtaacttccgtgacaaagagaggatctagtggttgttttctaacaaaatgtgactccatcttatgaccacctagacaaataaatggacaagatcatcatgtccactgtgtgatttgagaatactctgtagttctcttatcacttttaaatatcttcccagagatgcatgaaattccataattaatgagtaatttaggatgttaaggcattgttctttctctgcaaatttcctttaaaatgcagatactcataagatcagtagataattaattttctaatacattaatatgaagaaatttatcaaattacttttcatgttgacaggataaattagagtatgataaaagtactgagcaccttagcctgggggaggagaattggagaaaggtctgaaaggagatggagaaaaacagaaaaaagagtagggtataaataaatttcacctacctctcagttttgctaagaggagatcattcttgaatagtagagagggaaatgttatagtcatacataattatttagaaataagatactgatttgggcgtaagatgtgttgtggataaaaatttttaccatgaaaaaatactatatattttattaacttaggggaaaaaattcattacatttctgttctccatgcattgtttgtaacagctgttttttcatacctatccacatttgctttaggtggtaaaggaaaaagataaattaatcaacaaatcaaatggctcattttacgatggcatttcttttatgaatgatgatttagtgcttaatatcaggaaatatttaaatgtaagattttaatcctgattctccttctaatcttaccgtaaatcgtttcaattgaaaaaatatgaccaatctttcatgcctcctagacctagtctgtgcaagtttatttcttccaaatattattccttattccaaatattaaagtcagttatttttatttaaccatgagttacccttggatccaaaaaatttatttttatatatatttatttatatatatatatatatatatatatattctttttttttttttttttttttttttttttttttttttgagacggagtctcgctctgtggcccaggtgggagtgcagtggcgcaatctcggctcactgcaagctccgcctcccaggttcacgccattctcctgcctcagcctcccgagtagctgggactacaggcgcccgctaccacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccggcctatatatatatattcttgacaaccttgagattgttgattgcaagataggcaaaatttaaggcaccatgaagaggataattagcagtacaaactggaaattggagtgggaataaaagaaaactttaaaagaagaccagggagcctacagattttctctgtaaaaccttgggaaagacaaagatatagctgtcaaaaaagaaaaaagacccaggttgaatcccagaagtctaatgcatatgacctgaggaatgcatagtcagaccagtgaaatcaagcatctaaattatgttgatttctagaacaacagtatatcctgaaacaatgaaaactacacatatacatgatatccttggctatatatatctaaaacatactaacagaaatcgtgtatattggtgaaaatcttggtgaaatctcggggtgagcgtaggggtgaagacaagaaagaaaaatttctattgagccagggctggaaaatgaaaatgcctaattttgtatccaatatcaccacgcactgatggagaggatacatagatattttcttatatatcatgctgtctttattctttttgtttgtgagcacagaaatattttgtaatgatttttatgtgtttatcctgacttctgtttcccttcttttaacatcatgttcatttttaaaaaactaatccatgtcatacaaaaagtatcacagcaatttcttcttctagcaccagttaaaaggcatagatttatatttgtcaatcatattaggtatttgagaaaactattttcactgatgaaatacaatgcaccctgtctgacattctttgaatgacaacgtgtaatagagtagatgttttattttgaaaaaaacataatctgcatataagccagattttacttaggttaaaaattattttcccatgaaaataaatactaattgacataggaatttagtgattttatgtgattatgggcagactaaaacttgtatgtttgtttaagtggtgtatgctacctgtgatttccacaagcatcatgctagatgatttttttgaatgaaaaaacattgtaaatttttgttagtaggaaccacccaacttcaatagggatccctcagagctaactgatgttccttccttgagtcatagatcttgagaagcaagagcttccaatgggaaagatgatgggcctgcaaattcagtactacctctaggcattgtggcaatcaagcaattttggaattctgcatttagttgttccactgtagtgtaggttttcattttaaggcgtagtcaagtgaatcttattttcttatacaagttcccttctgagagggttgccatggcaatgagttctcagcctgaaattcttaaatgttggttttatttcattatctgagtttccattacaggccacatcaatcaatgcagttctctattcaagaacacgtctgcagccttaaaaagctgaccctttcatttggtacctctgctcctctgcctaacttgatgtcaccatttcccagacaactcttcatctccaagaaccctcttctacagggctgtcaatttgatcttttccagtttccttttaggcaatatctagtcttggttctcacctgtctcattttctcatttataaagggtaataccaagtctctatgtcttccctggttgggtttctaacagctgtgtgactaacaatactattaataagtaacaagaacaaaggcacttttgcatttgtgcatcactctacagtttacagcagtgtattcctatacatcatctcatttatttttcaaattctctaacttgctgccactgttactttgatttagccagtgtgggaaaaagctaactcaagacttttcctttcttcttttcccctacattcacgtttcgtaagatctcctcagagggcacagaggtacacaggttattgttactgggagtgacaagtgacaggacaggcagcagagtcgaggaggagggcgggcatggaatgatagtaaattcacaggctgtgccttggaaacagatagttatacaaccaaacccacattgacagatcctgcacaatttgtgtcttctggtggccacaccagagagatgatttgagttagaggggtgaatgagatcaatcattgagccatgaaatatagtaataagaatagcaaatgtttctgaactcccacttggtgccaggcactgtgttttagtcattaattctcaaaacaatcctgagttagaaaatgtgatttcttccatcttagagatgaggaatatgcaccagaaggaaactgccttccctgtggctcaattcctcatccaaggatatgagccaaaaccaaggtgatgcatatcgtgattctgtttctccactagctaagcattatgttgacgaccgtaactccatgcattctgtgggctattacactaacctgccatctgtaggttggacctgtaacactactggtcttagctcaagtgaattaaggtcttaccttgaacaaaaagttgaggtgggatttaaactgaggtagtctaaatctagtggcctaagccactgtgaagttcctttttctttcctccattattatgtgcctttttttgtctaaaccagtggttctcagtgggtgtagcactgccctctagggaccattttgtgagggtggttttgggcagtgacaacaactagggagtgccacaagcattttgtgggcagggacagggatgttgtgacatgtggtctggccaagcccacatgggaaaactgtccctcctcccacacaatgttttaacgttttgccagacagtcatataagtgaaaacctgtttataaacaccaagatacatcaaaacaaagcctctctctctttttcactgtatcctggactatcatgaaaattaaaggaagcttgtacttagtttgcttagaactttaccaagagtgcctgagaaaattatgctacagatggccatgcccaagcagcaggagagtttttcacacctggttgagtccacatttagagaattttttttgtagtgattctacgtagtgaagcaaacatcttccttcttcattgcgtgttctagtgtattcatgcccttgtctttacatgttgaaaatagaattttactataaatactttcattttaaatcattttcatatcacacttatggcactctattgattttttttaaattgatgtgttgttttcatttggcttcccttgggaacagaccctgagccaaggtgttgtgtgcacgtgctttctataggaggtgatgacagggaacagcgcagaggagtggggatgtgaggaagggaagaaaaagcagccaggaggagtgggagtgttataagttggcagtgtggacaagtggggctctgtcttgctggggagctctcagcaaccatgtagaacatgcctagaagtggtcccatctgagggaggagaaaagctggactattttttttttttatctttcccccttcatcagctggctgaggactgctcctgggtcattaacttcccagcatttcttatctgcccgcttgggcaggcagaaggaaaaagctcaggcagagagtgacagcaagggtatttgctagaagatgctgtggatgggcatgtgctagaatgatgagaactgggcagatatgggtggggcactgatgcctgtttcatgtgtgcagatgagtgttaatattgataaatgtcatttctgcatagcaaggggactttacaaaatatttgttataaaagggtttgctgagcctgatagaattgagagcattggtttaagttaaacagagtttctaatagagcaaagctacattgaatatgctaaacacaggttgctcaaagatttttattcttaaagttaggcatccaaattatctgcttctttaagcatagtgtgatatagatgtcataaaaatggtaattgatgtgactggccttatatcctatagaatacatggtcttatgaaagtgaatgtaatgcttagctaatagaaaaacaatatcacgtgttgtgtcaccttagttaaagttttttcaagatctcataatcctaacctttgattcatcatgcaaattacggaagagttggccacccaaggttgaatgcatgtaaagttgtccatcaatcagaagacacatattagaggtgagcaatttaagcaggagtctacctttgattttattctaatataaagtttctttcaaattatgtgttctttcaatgatttgggaaatatattgtcatatatttccttcaaaaatcttactttaggaccgtgatcaattctttttgtaagagtgtctgaaactttttgctttatttcatctacaatttgaaagaattatttttagtcacttgtatattctgcagatgtaagtctactagcaagaccaagaaaactatgtttaaaatgaaagtataaaacatctcaatttggctggatttgtcaacataattattttctgttcttttatcaggctagggaacattctcaggaaaatcattattggtttctacaacagtgtcttccagaggaaatactggcctagcacactgtcaaagagagtatattacagtgaaatttgtatagaaacagtaaagagatttgcaatgcaagctttcatcttgagtgctttatttttccctgacctgagcggcagttattagatcactgtatcatgaggaaatagtcaattgaagacacggaccacagagtcccaagcctgacattaggtttgaacaattgggcaattttggcatatatctagagggttaatagtatagagcaaaggcaatggctttaaaccaaacattttttcttgcaaatgttcagatttttttttttttttttggagagcaattgcaatgtatggaatctaagctattcttaaggtgttgaactcagaaaccaaaggagaaagaacaagtaaaaacaataaaaaatttaaaataaaaacaaatctgtcagtggaaagaaagctttcttgacttgtttatgtacaattcaatggagttgcaaagaggattttttttaatggaaaacatgtcacagattgggttcaagctgcactttagctatttttgtttgtttattttatacacacacaaacacatacccttcaaaactgtgcaaagtgaaatatttgctttcctggatgtcttatcaaagtggtatagtttgaatttataattatgaattaagttcagcagtatattaaacacctagatttcagcccatacgagtaactttagtgcagtctctccatctcttctgagcccatgttctgaaaatttccctgctcccagtatactagcaggtaagctatcccggaggatgcacaacagaaaagcttatagaccaaattaagaggcatgactcacattgactcaaggagaaagaagccaggagaaagaaagaaataggttaacacacttagactaggtgacaaatgtgtggaagaacctcattttctggttatgctgtgtttgaatgctctctttaccatctctaccctctcaatggtgatgtggttatgaggaccatagttgaggtttgaacaagggagcatggcagatggtgagtgcctggggcccactacacacacttgctctatcagaaagacaggggcaagtgggcctggccggtatctcatcagttcattggtgaacagcaggggggtttacctccatttctgtcagagaagatgtaaggccaaatgagactataatgagtatcaccaatgggaggataatttgaggataacattgctgtcactctagaggtgacatgattcatgcttctgacctgttcttaccattcttttccattttgaaatgacagtcttgtttgttccatcctttttatcatatagcatgtcttagaggttacttagtactgcatttaacacaattctatgaatcctgcctatatctcaaaatctgctcgcttagttattatcaacacttaacacgagttatatatcccatttgtttttattttcttctatagaagaattgaatattctcaaataatacagcaagcatattacactttttataagatgggatgacagctaggtgtggtggtgcacacctagagtcccagctactcaggaggctgagacagaaggatcatttgagcccacgagttagttatgatcgcaccactgcactacagcctcagtgacagagtgagacccagatacccagtctaaaaagaaaagaagaagaagaaaaaggaaaatgggataacatatatcagtaactaatcattttaactgggtgatgggcaggttctatgtatggactgaattgtgtcccatcaaaattcatacattaaatctctaacccccaatgtgatggtatatagagatgggacctttgggaggtgattagacttaaatgagttgataaggatggggccctgaagatggaattactgctgtgataataagagacaccagaggccttgcttcccctgactcttggcttctcaaggatacagctagaaggcagccttctgaaagacaggaagagagccctcacaggggaacagaattgtccagaaccttgttcttgttctttccaacctccagaactgtgagaaataataaattcctgttgtttaagcctcctggcctatggtattttgtatggcatccagagctgattaatgcagtgagtatgcaggcattcattatactattctctctgtttgtgtatgtttgaaattttccgtaacaaagcaaacttaaatgtttaaatatataaaagagaatgatagattataacagtatgtacttcctaggattattgtgaggctataaagaaggaatatttgtaaagttctcagtagattacatagcttattaaaaataatttacctgacagatatgttttaagcaactattatgtttcaatcactggtcaaagtacttgagatatagctgcccttgtggagcttacattctactgatagcagttttcattattgttaatagatggtttcacatcatttctagatgctgtgacattcattattattacattcttgggcaattatctcattaccattgcatttttttcttatttttgtgatttctgaatctttaaaaagctaagaaggtgatagaactgagtagagatccagcaagtggcaattctatgaaatagtaataatataaccctcagttaacatacatccatacaaacagacaactatgtaaccaggcctgtattactgaagatcatgttttattgggcagtatggtgaatcaatcaggacgctgtcttgcagaacaagtgaaacataccactacataaagtcttcaaaacaatgaaaatccagaaacagcttctcaagcatttgatgtttttcaatgtaaaaaaatagatatttagggtatttctctcaaaaaaaaaaaaaaaaaaaggaatagctcaaatctatgctaaatactttaaattccttgggctatttggctaccctagggaaacaaggactcatagaaattgtggtcagaagcatgaataaggaataggtgacatgttctgttgctcacaatagaaccaattctccattaggttcaggctttattttttttccttcaacaaaatgcaattagattctccaaggcatgtattaaatatgaaagaacagacactgactttgtagtggagaaacccagcagataccaccataatcaagtgatcaagattaagataatcagtaatgagatatgtcaacattatgaacctcttggtataatggatcaagaaagacactacatcactgctatggtattcttgccatagccacagtccagtcataaccatagtctaatcatgagaaactataggcggacctccaaagagggacattcaacaaaataggtaattaatactcttcacaactgtcaaaatcataaaagaaaatgaaaagctaggtttattcttctcatattgttatggcatattacattaattgtttttcaagtgttaaaccagccatacattcctgagataaatcccatttagttgtgtcatgtaattcataatcatttttatatgctgttggattattttttatataataagtgtttgagaatttctgcatctatattcataagagatactggtcttcagtttgcctttattgtgatgtctttgtttttggtgttatagaataacttcagaagtgttatctcttcttctattttttgagagagtttgtgaagcattggtattctttaaatgtttaggagtagatttaataatttttaagctatcgtaagaaaacatttatttagttcatatttgtggtatctaataaatgaccaagaaacaggatctagtagtatatttttaaaaatgtaaaaattagaaattcatagcacatgcattttggtttttaaattaaaaatatttgcttacaggttttattatttcacagctactttgccaagttttcaggttgtctttctcaggaaccactctgggatggaggttaatgtgcaggacgctaatatggaaatgtttttgcaatcaatatctgcagaagggaagaaggaaacagaattgggcagagggagaagtcacgtgatgatgcaatgtttatggagcatctggtgaccctactgggagctctaaagctgagatgattgtttcaaaatggttccaagttggtgtgaggagtctagacctgtacattctgagacaaccagttattaatgcaggctgcacccaggaacgaatgtgatcttggaataagtagctcctctcagtcaagggtaatttctggagagggctgacagctgagggctgtcttctggcaacatcccttgaagctggggcactgtcctgcacagagtctgggtggtgcatcacagcacgaactgggattcttaaactgagcatgatcctgctccaatgcccaatgtatttgacagttatgtattctctcttggatatggtttaaaatttaacagctctaggaaaataagaactgaggcaaaataccttgcttcaagtgatgaaaagggtaataggctgagtattctgtatttactggtcagagcagagtcattttgatctacatgcacacagtagaatcgaaggaaacagtcctcatttttcttggttatctggctcatttgcaggaataacacacacacatacacacacacacaggtcaatatatgtggatcttaaataaatatgcagtggggccaacttgtagtggtttatgagaactgattgttaaaatgtcaagaattctgtgagctggccgggcacggtggctcacgcctgtaatcccagcactttgggaggccgaggcgggcaaatcacgaggtcaggagatcgagaccatcctggctaacacggtgaaaccctgtctctactaaaaatacaaaaaaaaaaaagaaaattagcggggcgtagtggcgggtgcctgtagtcccagctactggggaggctgaggcaggagaatggcgtgaatctgggagatggagcttgcagtgagccaagattacgccactgcactccagcctgggcgacagagcgagactccatctcaaaaacaaaaaaaagaaagaaaattttgtgagctgattattaaaacacaggctttattaaaaattaaattttataaactcacaatttaataagttatattaaatatgaagataataagtactcaatacacagcaattcctaattactatattttactattacctatgccctttggtttatttatgtctattatatttatatggtggaaatagtatataatggtgaatttctttgcatcctttccaattctatgttcagtgacatcatatagatagtataaaattttccatgttggggctatttacatggcagaaaccaacaaatgctaaaaatcagggcttgatgtactattttgctggttaatgagacttaagaaatcttgtcagtgctataaatattagagaaaaagtacactagccatagtaaggtgatcatattattactcatctaatagcaacaccaaagcaaaatctgctaatttcatgcataagtgatggtttttgtacctggacagcagggataccaggggaaggctgtcagctgcctagtttgggtctggagacatggaagactttgaggtggggagtgccagttggtttgaggcccccctgcaccccagattgctgttttttatggttgaataggcagacacttctttccctctcactactgcaagtgtatcattccagaaggtatggtttggccaaaaggcatagtattcctaaagaaaggagttccaatagcttttctctgctaaaagatctcagggtctgattttattttgatattaagaattttacctaactaaaccctagtacaacatttttttaaattatgggtaattaaaaacttccatattttaaacagtagtaaaggcacactctgcaaacatttctgtctgcattacctaaaatttaatggatcaggcaaatgatacaaattaggcacacatttgccaatatttttaattagcctactggtttacctgcatacatttgttactgtaagttattacttataagagttacttcaaattcaagatcagcagaactctccataaaattatatacctgtggcactatcaccaaaatataacatcatagacttgtcataaataattcagagatttgttgtaaccattcaacatggtagtgttaatgtgagacatggagaattagcatttgaaatggataattccatatttatttcatgccttcatttattttacacatttaactgctttggtttaaatggaaggagaatcctttctcaaaattcaatctcagctgtcttcttttcaggttaatggttgatttctttcaaattacaaatcttggttcaacataaggatgatgacatattgcagaaatacctttctattgcttgaaatgagaaaatgtatttacttattttctgtgacaagtgagggggatgctgttatggcactcaaaatgtatttatggtatttctattagaaaaaaaatctcaggaactaattatgaggcaaggcactggcaattctattgttgtattcaaataactgtgtggcaacttttccaattttgacaaatttggcttaaataataattcaatgatgcccctcaagtttcaaatacagacagtcccttacttatgattttttagttttatgatggtgagaaagttatatgcattcaatggaaactgtacttcaagtgtccatgcaaccattctgtttttcactctcagtacagtattcaataaattacatgatatatttcacactaaattataagctagactttgtgttgaatgattttgctcgacggttgtctaatgtaagtgttctgagcacatttaagatagagtaggctaagctatgatgcttgataggttatgtgtattaaatgcattttcaacttaccatgggtttatcgggatgtagttttatcataagttgaggaacatccagatttgcacttttctaacagcctatgttgtgagcaaatttaaagacactgtgctttcagacaaattaagaagcatttttaggaactggatacttcagctttagataatagtgtgcatctttctaaaataactcatatgcaatggcatgagtagacatgtccagatgtaacgaaccataggctagaatcatgtcctaaaacaatctaaagaactacagacacatatgcctttaatgctaataaatcgtcttatctcagtgtcaaagctattactacaatttaagtttaacctctttggaaactttctgttagtatattggtattttggtgagtatatcattaaaccattaacatagtgaatagggtgctcatacatgaatgtaaatgtgagtgtatgtgtatgtgtgtgtgtgtctgtgtgtgtgcactgtgtatccacatcacttcctttccctgagttaccaaacctgagttttttaggggccagcaatccatgcctttacaacactctgatgttgatgtggttttataatatctttgtggtatcacagaaagaaagttgacctagaaatctgaaaactaatatttgagttttggcctttctaattaattgctgtgtaagcccatctttttatttttttttattagtgaaatgaggaaaacaagatcttcccttaatcaaatcaatgggaaataacaagggttaatgaggatattaaaaatttgaaactcttaaccactgcagtggatgcgtaagatgatatagttgtggaaaacagcttggcacttcctcaaaaagttaaacacagaattatcttatgatcaaacaattccacttctaggtgtttacccaaataattgagaatataggtctgcatataaacttatacactaatgttcatagcagcattattattaatagcaatagccctaaagtggaaacaatccaaatgtccaccacctgatgaatagataaacaaactatgatccatttgcaataaaaaagaatgaagtactgacacatggtacaacatggatgaatcttgaaaatgttatgccaactgaaataaaccagtcacaagaggcctgattccatttatctgcataggaaatccgtagatacagagagtagattaacggttgtcagaggctggggataagagatgggaatcagggaatggggtgtgactgctaatagggtatcttttttgaggtgatggaaatgatctggaattaaatagtgatgatgattgcataactgtgaatatactaagaacactgatttgcacactgttaaatggcaaattttatggtatttgaattatattacaatttaaaatttaaaaaccttgtcctgtttatcctggaggattgttgtaggaatgaaatagaagtggaaagttctataggctctaaatcatattcaggaatccatgccattgcatggtgaagcacgtaggcctcagtgtacgcaacttgataaagagagtttgcatgaaaagtcatctttatgttgggtaattgggggtgtcacatggagggttatcactcagaatgcttgctgtgaagagctttatagaagagttatataaattacacacaaaaaagtatttttttaaatggaaagcacaagagagatggagataaatcgaactttctgttgggacctgccactttctgctttacatgttaatagtgactgtataataactgtcttcctaggctgcgaaaccctgaaggatggaagcttcgtgtggttcatctccattactctgcagcaccctgcgtatagagagtgcacagttagtaataaatgagctttgacagatttttttttttttgagactgagtctcactctgtcgcccaggctagaatgcagtgacacaatctcagctcactgcaacctccacctcccaggttcaagcgattcttgtgcctcagcctcccaagtagctgggattacagacaagcaccagtaggcctggctaatttttgtatttttagtagagacggggtttcaccctgttggccaggctgctcttcaattcccaacctcaggtgatctgcctgtcttggcttcccaaagtgctgggattacaggcatgagccaccgcacccagccagacttttctttttaaacaatatcctgtttggaattctaagcaaagtcagcaggctactgaatggacttcaagcaccaccctctgggacttcacaggctgctcctctcttgtttaaatgtggaaggatggaagctcaccccaggactctaggcaaagccagaacttgaggtcagcgcatctcacactgcctctaggccaccagggcatgtcttttccaaactctcttagggctgctctctgtgactttcctggtgtgatcctcaagccgtcctccctgcatctgtctgtgtttatctcacttgagctcactgcagtacttgacacttgtggccattcctttaggatgcttgcctctcagcttccaggacaccactctcctctctttcctccttcctacttggctgtttcttctcaattgtctttgtggccacctctggcttaaaccctctgtgactcctttgttcaccctttgctcttcttgcacagcagtatatctttacttaccagtaccagtcaaaccctaacactggtggtataggggcttcagtgactacaagtccctgattcccaaatcatggctcggctaagacctctgtcttgatctccattactgaatatccaactacctggtggaaaattccattgcatgccccagagtccgctcagtctcagtgtatctcaggcaacctgcttggactcctgtaactaatgccattgtgaatgtcactgacatgagtcttatgcagtcagaaatccaggagctgttctaggtctctctgcctcacccctctccttccagccagtcatctcttgcagtcctgtagacaccccctcccccacaagaactctcatatcctttgtcttagtttctgttctctctgaagcaaaccctgagaatgagacaagtacttggttacaaggaatttattgggtagttcatttttcccaggaagctccatgagggagtagggaagtgagacagggaagaagcaaaaccaataaagagtgtgttaacaaccaggtgattgctaatggcaactggggcacagtttagctggggagcttctgagaaggcacgtggaagctgcttcagaattgccccgccaaaggacaaggacgctgaggtatttgtctaccaacccctgtcgcctccttgttcgagatctccctcttgcatagctagcaccttgagtcagtgatcaccctcaggcagtctcaggaggttatctgtggctatgggagtagtctgcaggggaacgctgcaaagaccaggagcagggtgacagcccaagagcttctgtggtactgtcttctctactctctcccagccaccattttctgtcacttctcagctgaaccactgcactggtctccttgagactttaaggtttttaaaatttctttgtaactttttgcacatcctgccagaaagattcacacacacacaactgaccatagcatacactccttccctctgattagagatcttagaggctcctcagagttttcaggatgaagcctgattaccttagcatgtgcttcccaatactccaaggcacccaaggctccatagcaattgcatgggggttggacaggatactgtaacatttgaaaaaaatgcagttctttaacatttgttgggcatcctggtaactattagtttaaaggcagtctacagtttcaaaattagatcatgcaacgttccttttcttgatgctacgttatttccaagttgagttcatgactattgctgtgattaaaaagcatatgcagaatgacaatccatgtggaaaaggaaacatgggcggcaggggccgagctggttcaaaggtttgaggatttgcacagcgccaacaggaccaccatcccattaccaaataattgtggttatttaagagtgaaatgtaggtattatttttccctttatatgtatgacttttaaaaataggtactgagctgttagtattaaacccttactacgttgtttagacttatctacttaagaaaagaaacttttaaggcatttctttacctaaggccctggccaccctcttgtgtctcctctgctgccactcttaaatacaaatttttggctacctggaaggtccaggaaggtcatcatgcctttgtttgtgatagcacagactattccatctgtcaagattaccttcctcacctccccaccaccttcaccagccctacaccacacagcttaaggtgcacttctgctaggatgagtctctgattagtgttttttgccccaggtattattttgttgcctctgtgtctgcacagccttttgtacacagcttttatgtggcaatattcttactatacccccactggtgatgtacttgtctatctgccacattgttccacgatttccatgaactccatgggcacagacgttgcattcgctttgactttgctggcattttttattgggattatgtccatttagcttatgataaattagcatgagtgcctaagatgggatatagattcttgaaaaaaggtgaacatataagtcaaaggattgagaaaaatgtaagaatgtatgtgaaataataagcctttactctttttcttcttgtttatcatttcaacattttatgttgtgattttctgtgtatatgccacaggacctttgcatatgccatcctctgtgtttagggggatcttccttctcccttcacctgagttacctgcctcccttcttatcctttggatctcagctctgtcttctcttccttgggaaaaagttttacatttatatttgtatgcttatttgaatatttttcttcttcctccccagttcatgagctccatgagggtagggacaaggtctgccctgctaattattggatccataattgagtatattgcctaacatgtagcaggcattcagtaaatgtttgtagaatgaatgtagaatgaataaatgaatgttgaatctatgaaagcttcatgtttgcatcaagacctgatgactattctgaagcagtgggatgtagtttttccaagagagagtaggaatgttgtctacattgtgagaacagaaaggatttaggcaagggccagcagggaatggaattttagttccaagcttgaaagaaattgggaatcattttaggtttccgaaaaaaggggtaggggtcagatgatcaaaattgggctgaatgcaacacagaaagttctgtttatttaaccacttgcaatatttcacttcaaaatggattccctgccactgagaagctgccatgttttcatttgctggaacgtggtgaagttagataaatgataatgccatgtctttgttcattcctcagttagaaagcctcagccttaaatgctccccagtgcaaattctcactgaataaacatggagtgtattgttttacaacatgctgctcaatgacattgcagcacatttggcactgctgagcatttcaggatgaggaggcagaaaataacaacagcaaaaagcccataaaacaaattgcatcccctatattccttaatgaaggacttgggtgtaagttgcatcaacgtcagagaatactcattcattgcaaaggtttgggaaaatcatatttatgcataatctccttgttctcaatgatattttattaatatttatttcccttttgcctttcatctggtgttatcttcttttctttttcatctttattttccaagtgactagctgaaaagaaaaacagtgaatcggtgctaagttgctattttttcaattttaagggactgattcttaatcaagttactattttaaatgtttaaattgagaaagttccgggtaacaacctaaaaaatgtaaatacataccacacagttaattaatgtttctgaattgctactgtttgaagttgataagccccatgtatgaattcctcagctcaaagctgagggagttatattaagaagacagtagaaaataaaaataattagctagtgttttgtaaggagggaacataaatggtatctgtgtggctctaactttatcaattcagtctgttgatttcaaaattcagtcatttgagatatttggtattatgcagattttaggcagcatgtgaacaaagggctaaggtaaggattattgtattgcatgtatttctgtgaactaattttgaggagctatactaggcttctgttttatgtgtatctataagcattttacaaaacaattccatatgtattgctaattaaataaattcatctcaaagtttgttacaaactcaatcaagtgtttgagatgtagaaggaacatatagtttaatcctgtaccagtcaggatagcctaagtcatgctgaagtggcaagtgatctcaacatttctgcagcttacagccacaaagattgagttcttactcaggctagatgtccatagaggcagctccagctccactacacatcaccttcactctgggactggctgacagagctgtctctctctggaactgttgcttgtcacaacagtgagagagagaaggcggttcttaaagctacatatggcttactgtcacatttcattaactagaagaagtcattcggccatacctacattgaacaggacagggagacaaagagggataatcctccctcaggaaaaaggtatcaaatacttgtgattagtctaccactcactccttcatattttggatatgaaaaacatcaccagaaggattaagaaacttggccaagatcacttgcaaagctgggattggaccacattcctgtgacccaattgcagacattcctgtgactacatccagtgtctccttgtatgcaaatttgtggacacaccatggcatccacagactcaccagagaaggatgccacctacagagccagctgctcaccagagcctggcttgcatcatggcatcactttgatggggtcagcatattcgccccttgactctgtaggtccaaaatttgcatctgttaatgtatgctgtatcagtcaggattcagtcatggaggtagaaccgtatacattttggtgcaaggaatttattataggaattagtacttaaaccatgtgggaggaactaggaaaatgaagaaacaagggaggagttgaaggccaaaccagctactttgataagccaagtgtgttcagtcatcaaaataggcaggaaagggaaggtttttgggagtccagtgggatgttgggcttcggtgtggctaccactgctgtaggaccaccactaaccatttaggtaatgcctatggctgcttttgcactatgacagcaaaattgcatagttgtaattaagactcaatgacccacaagcctatgatatttactatctggccttttacaaagtttcctgacccctggtctatagttcagaagattgatttgctgatctatagtaagaaactcagctatgcagcaggtccagcaactacacagttccaagataagatatcatttccccattgttaaatctatgtgcaaagctaacttatgattaaattatggtaagcttaactgtaatacaaggaatcatttcatactatttgtaaagcagtgaacactagcgtaataagttatgatcgtggaggctaccacctgcaccatccataccccgagggctggacactcataactatgggtgaggccattccttccgctggggcaagaataactatagatgcctatgggaaactgatacaatctcattctctacacttcctttatatgctgaaggtcacaatctttattcttgcttagtgaagagagaatcgactgagctacatccacacactattcaccataatgagaattggaatattacttcaaattctgcagtcaccgaagcaaaatctgtaacagggtggatttcaaaaattattttttatcaaggcataacctcatttattttaggttcatggatgtaattttattctccaaggtaaccttatcttcaaattttataggtctcatgctgtcccccatcctgtatcacctacaggtgacttttccttgatatgacttatagaacattaacagtgctttcttttcaatcatactccgatttggttagttccaacttaggggacacttactttaaaatgtctcttcaccctgcaggaaacgagtttattagtgaaactttcaacggatatttttattccatttatgccatttatctctccatgccttgtgaggcaaaggagtggtgtttcaccaggttaagaggtaattgatcaagattcagttcaaaaaaagtgtaaacagtacagatcttaactctcttcagtacttttaatcaaaaaggaaaatcaaagcgtatcagccagaatcatcaataactcttggtggatgttcaaatgcagtgacctcttgacacttccactgccttcagtttttgtttttatcatttgttgcttagcagcacggggggaaagagcaggactgtagcttggatttaagctcctcatttactagctgtgcccttttatcaaatcgtttaatactgggagccccacttttctcatctgtagactggggatattaatggctcctatctcaagcagttttaagagttaggtaagttgatattgaactaatttgacattaatgttaaatacttatcatagtacctgagtatacctgagggcatatccttcattcatctaacaaacaaggtgctaaagacactattataattatcacagtagttctatgaggttgctatgattatcttttttgtttgtcttttaacaaagaaacagagaatcagagcagttaaatgacttccttggtcataatcctagagaattttagagctagagatagaattcagatctatctgactacaaagcccaagcttgtggacttaccctccatttgtcaaacgtgaattccttgaattgtaaaccatttggggccaaagcacacctttttttttttttttttttttttttcagttaagaagctggtaattgagtgaacacaatatagtggtacttcagttaactggagctcctggggatacatcattctggacagcctagcattccagaaagctttgggtatttgccaaaactttaaaaatgttgtttaatttagatagaaccctccataaaatatatatttctctatcttcttaaacagattatattgaacctgatttaagattacattaactcagtcatttatcatcgtgaacttcatttttatcctgtactctctaatgtaagaagattctgaggttttattgaaataaagagggatatcattgacctagtctgttatgcatttttaagttcctgtgtttgatttgtaaagtttaggtgcttcctgtccaagcacttgccacttctctttgcctatttgaattgtcagtctcccacaagaccacctgaaaactctgttgacgaagcaaaactaggtttattaaacctatggtacaattggcaatcatcactttgacagtcttggcagtatttcaaaatgagggaattaggttgacatttacatggtagggtatgaactgggtggttttaaggtgagtctcacaagataggaaattgtctgggattgggtagagttgataacataagagctctggagggcacagtgaggtgaaagatttaaagcaagtgttgatgatcaagtcattggtagtaataagcaagctctttcagttgggtcacagttatattttacaagagcacgtatttctttgagtaagaagctcagttatttttgcctagttccaatattaaaataggcaggtatgtctgatcccaggattgtatggtataaggacaagaaagcatattgatttggtctctcacttgactctatgtcttggtgcttctacatgctatggcatgggacactcaaaactggaactgtatggcaacagagatccagtaaaagctaagtgggagcccaggaaactgacttacacacatgagttttgtgcttgggcttgtgacatccatttttaaaatgcagagactcctttttttcactcctttttttcttgcttaatccctggatatctttctaatgtcacgtagccaacaccatcaactaggtgagcatcagttaggtatctatttctgcactgggaatcttgaatttataaatcctggtcaaaagcgagttaaagagatttttaaacaattacacaaagtaattcttgtgttttatttattcagtttatattgagttttttgcagctcttactctcctcttcttttgtgtttgaaaatttaaaaagtgatgctgtttggacacgagatttgttttgtaaacatgaaatttagaatgtctggggattctattaacactttttgaaaagatattgccttgttctagagttcttgagctattatataattgaagtaaatagcctgagaacatagggatttggtgtggaatacatggaagataaagtgatcaagcaagtttaaaatatacaattagtacctaaaataaagtgagtattgttttacatcttcaatctagtagtcggcaaataataaaaaaaggtcaaaagtcccaattatatagtaactatcgaactggaaaaagaaatgaatttgactcttactacttaaaacttttagctgtttatagtaatttaaaccaattgaaaataaatgttccagccagcaaaaatcctttctaagaactatgtgtggtaagaggatacaataaactaatcaaacaaagtttctgaagtctcattaaccacggaatttttagtgaaatggcatggatatggtatacttggatttatttggaaatgacagaaatttcctaacaatatttgaagcctgttttggtgagtgctatcaagggctgtttttctttttcttttttctagttatatattcagtactataaattgttggcagctggcccagaaaaagagcctattttcggaaaaaaaaattattctgcaactttatgctataacttaaacacactaaaaagtgtgtttaaattttattgtcagattaccagcttttatgcaggtagactccgtggaaaccataggacaatgacaaagttgcttcttttctttctcttagctatttttttactctggattacggtgtggatattaatatatatactttttatcaagtatagggaacaaaaagaaaacctgcctgcacatgtaatctttcttacaatatacatacctgtgaaacaccagatgagaaaagctatgatctgatttatgtcatgcgaaatgaatgttaataaatcctatttagtcacacagatgccaaactgagacaaatggaagcctctgggggcaagtggaggtgggcaaatgggctccactgatttatgagtgcagagtcatgaaattgaattcggcaacctacaaatgacacttattgagaacctatcaagtgctaggcacccatgctggtactttgaatacagaaataaaaggtttggattgtaaaaatgtcacagtataattgacaaataaaacaagttaattaaacaatatggtaagcaatagaagtgcaccctgcataacaatgttttggttaatattgatggtcccatgggatcataatgaagctgaaaaatttctatcttcttaaggttgtaacacaatgcatgagtcatgtgtttttggtgatgctggtgtaagcaaaccattctgtgctgtcagtcacacatttatgtacagcacatatatatgtatagcacacaatacttaagataataaactatattattgttttacgaatttgctatacttcttatcactactttagagtatactttttctacttataaaaaaatacaagttaaatgtaaaacagtctcaggcagttccttctggaggtattccagaagaaggcactgttatcacaggagatgacagctccctgcgtgttattgcccctgaagacctcccagtgggacaagatgtggaggaggaagacagtgatattgatgatcctgacttctgtgtaggcctaggctaatgtgtgagtttgtgtcttggtttttaacaaaaagttcaaaagtttaaaaaaaaaggtaaaaatacaaaaaaagtttatagaacacatatatatagaaaaagtattttttgtacaacatacaatgtctttgtgttttaagctattatttccaaaaagtcaaaacgtttaaacaaattttgattttataaatttaaaaatttatacattaaggttactttattattgaagaaaaactttttaaaaataaatttagtgtagcctaagtgtacagtgtttataaagtctacagtagggtactgtaatgtgtgaggccttcacactcactcaccactcactcactcactcctgaaggcagcttctagtcctgaaagctcccttcatggcaagtgccctacacaggtgtaccctttaaagaaatcttttataccatacttttactgtatcttttctatgtttagatatgtttagatacacaaataccattgtgttacaattgtctgcagtattcaggaaagtaacatgctgttcacatttgtagcctaggagcaatagactttaccatacagcctaggtatgtagtaggctacaccatctaggtttgtgtaagtccctctgttgatgttcacacgatggtgaaatcacctagcaaagcatttctgagaacatatccccatcattaaccaatgcatgatgacaggtaaaaaggttgattactgccaaatagtacttttgaaaaagttaaaactaggactttcacacaaatatgaaatgaatatatgtcaaagattttgttaaacctattgataaatgagagaaccagtaaagtgatagaaccagttcaaggaacgtttgcagagctagatattcataggcaagttaataaaggaaaattaagataagattgctaagttagagataaaagcagctaatttcctacaggacaagagagcataacttttggaattatcatttcttctagatataaataattattttagtctctgttgaataaaagtctacaaatgtagacatgtaacctcactaaatctggactcttttatcaatagtaattggtaggttggacaaagctcatctccatagaaattcaaggatgcttctttccccccatacaacattctgctgcttatcttttgccttattttcaagttttgggtaattttttaacaacaacaacaacaacaaaatttaggagcaatagcatatgagacagaggaaaaacagtgggattccaggcttcctcactgggctttgttaagcagaaagttaaggagagaagacacctgagataggccttctacaaatgagaaaatttccaataggacaaaatgtggggggagctggcataggtagaaggaaggcaaaaacaggtaaatcccaagaaccatttgacaggcaatgttgtatttacttttgtaacagatatagcactgtgactgggggccagtttatgagagacattactttatactttgctgcatttgttgtggtgatggtttttttaagttagaaaatcagatcatctgcatactgaagagcagttatgagtcagttgtttttaaagccatacatttatatgttagagaatttaaactctttcagaggaaaatgcaaaagcaatgaatgtagaaggcagtgaagacagagatgattttaatgcacccaggtattaaaactgagcagagcctctaattattcaacattattctgaaattctctttcatcacaccataggcttttttttccctcttcttttctatttcacctccatttcttttctctctggccccagatatgaaatgaaatctgggagcaaccacaatttctgtctcactggctgagcaggatgcttctgaaagaagcagcatctatatatagtttttcttcttaggctgcaggtgtgggatggaatagaatgaaatggaacagaatggagcaaaaaggaatggaatgttatctctcctgaaattttttttatttaaattatggatgcataatagttgtacatatgtatgtggtacatgttatattttcatataggcatacaatgtataatgatcaaataaaggtaattgggatatccaattaccttcagcaatagtttttttgtgtgttaggaacattccaatggcactcttttagttattttaaagtatacaaataatgattgttaatcatagttgccctattgtgatactcaatactagatcttatttattctaactgtacttttgtgcccattaaccattccctctttatcccccctccccacttcctttcatagcttctggtaaccatcattttactttctatctccatgagatcatttttttttttttagctcccacatataagtgagaccatgcaatgtttttctttctttgcctgacttatttcacttaatagaatgtcctccagttttgtccacattgttgcaaatgacagtaattatttttaatggcttaatagtattctgttgtgtgtatgtaccatttttctttattcaactgttaaaagacacttaggttgattgcatatcatggctgcagtaaatatgggagtgcaaatatctctctgatacactggtatcctttcctttgattatatacccagtagtgggattgttgggtcatatggtagttctgtttttagttcttgaaggaacctccacactgttctccatagtggctgtaccagcttacattccctcacaacattgtatgaaggctcctcccctctctccaaatctgtgctagcatttgttattgcctgtcttttgaattaatctctttctgctgttaataatgtaataatgtatttacttagctccatttttctctttgatattaatttccattttgcaaaagaagtcacattaagaaatgtttattaatttaaaatctctttactaattgggctttgccagtaggtaataaactatgggccatgaggttattcaatcttgcagtattttttccaggaaggtggtaaaatatgaccatagaacaaactattggccttgctatatgagctgctgtgattagacatttccaagcccagcttaaggcaacatctaaccagaagagctctaaatataaaataaatgaggtgctgctctagtaatccatttatacacagcatttattttagccattttttttcatttgactgttggcagtcgatcattggatttatacggtttggcattgatcttggagaaggccagtttggtgcccacgtcaaacatgcccaatattctattgtccatgtgactccctagaattaattagaaaacatttcaaaagggccactctaggatttaatactatcaataatagttgtttaacccaaaatatgatgaatctttgctttatttatttctaattgggcagttttgcattttgccgagtaggattaataagcaggttaagtctaattggcttgctttgactgaagggctgaatcatttcaatatagaaacctgtactttttataatttgaaaaaaatccacccaaatcaatcctgaacaatttttattttactttctcaatttttctttttaggtcatttaaacatcttgggtccttttacatgaacagcaagactgatgctttttgaagaaaagtctgtcttcagatagaaaaggcttctgtttgtatagaacaattagctaaaattagcatgtaaatttgaacaatattatattgtgaagctgattgggcctggaggttgggatgcaagtaacttctcttgtttattgtatgcaaatatagccacttagctttaattggacattgaaacccagaacaattatcaacaattgctttagtattaatgcacagtgggaactgcctatcatgactttttatttttttcttaacatttaatttttaatttttgtgggtacatggtaggtgtatatttttagaaagtacatgagatatttttgaaacaggcatacaatgtataatactcacatcaggttaaatggggtatttatcacctcaagcatttatcctttctgtgttacaaacaatccaattatactcttagttatttaaaaatgtataataaataattgttaactgtagtcactctgttatgctatcaaatactagatcttatttcttctatgtaactatatttttgtacccattaaccatccacacttcccccttacacctacccttcctagcctctggtaaccatcattctactctatctgcatgagttcaattattttaatttttagctcccacaaataagtgagaacatgtaaagcttgtctttctgtgcctggcttatttcacttaacacaatgaccttcagttccatccatggtgttgtaaatgacaggatctcattatttttatggctaaatagtactccattgcgtatatgtaccatgttttatttattcattcacctgttgatggacacttaggttgcttccacatcttggctattgtgaatagtgctgcaataaatatggaagtgcagatatccttttgatatactgatttcctttctttgaatgtatacctagctgtgggattgctggattgcatagtagttctatttttagttttctgagaaacctccaaactgttctccatagtggttatactaatttgcattcccaccaacagtgtacaaggactcccttttctccacatcctttccagcattttgttattgcctgacttttagataaaagcaattttaactgggataagataatatctcattgtagttttgatttgcatttctctgatgatcagtgatattgaacacattttcatttacctgtttgccatttgtatgtcttcttttgagaaatgtctcaaaaccttttggccagattattagttttatttttctctatagtgttgtttgagctccttatatattctggttatcaaccctttgtcagatggatagcttgcaaatattctctccgattctgtgggttgtttcttcactttgttgcttgtttcctttgttgtacagaagctttttaatttgatgtgcttctatttgtgcatttttgctttggttgtctgtgcttgtggggtattactgaaggaatctttgcccagaccaatgtcctggagagtatccccattgttttcttttagtagtttcatagtttgaggtctcagatttaagtctttaactcattttgatttgatttttgtttacggtgagagataagggtctggtttaatttttctctatatagatattcagttttcctaggatttttttttctctttctgcaatgtttgttcttggcacctttgtaaaaattgagttcactatagatgtatagatttgtttttggttctctattttgttttgttggtctatgtgcctgtttttatgccagtaccacactgttttggttactatagctctgtagcataatttgaagtcaagtaacatgattcccctagttttgttctttttggtcagaataattttggtgattctgggtcttttttggttctatataatttttaggattttttatctatttctgtgaaaaacgtcattggcattttttatagggattgcattgaatctgtatctcgctttgggtaatatggatattttaacaatattgattcttccaatccatgaacgtggaatatcttgccctttttgtgtgtgtcctcttcaattttctgcatcaatactttatactgctcattgtagagatctttcacttctttggctaagttagttcctaggtattttattttactcatggctattaaaaatgctattactttcttgatttcttttttggattgttcactgttggtgtctagaaatgctactgattttgtgtgttgattttgtatcctgaaattttactgaatttgtttatcagttctaatagtttttttggtggaatctttagttttttccaaatataagataatattacctgcaaacaggataatttgacttcctttccaatttgaatgccccatcaggactttttaaatggcagagacttataagcaattgatactgcatccaaagaatgacaatctttgtgctcatcctttgcacaataaaatcaagtataggccaaaatctggccaataaggtttctatcagtgtctttccatttcctctaattgtgcctttttgctttgtggaaattaatggaagatgcctctttgaataaaaggaagttcaaaataaaatttactattttgagaagatccagaatgtggactgttttcaagcagatatttgacagttcttaatctggtgggattctaaaaggtcagtaagttggcttcctaccagttattgctggggcaaagggaaccttccttcattctttgattcagaatttcagtctctagaataaacttgagagtagacaggttaataggagaaaaagcatacacatttattatgtacatacacatgaggtcccacagagtgtgagactcaaagaagggcaagatgattgaagcttaaaaagcattttgagctacagaaatagggttttaaagactcttggagggtggtggcaacaagctatgaatgggtgaatggaggaaccacactgcagacaaaggatgtcttattctgcggatagtctcgcaggttgcagccctcagaagaataggtgaaaagtctctctgagcacagtatcctgggcatggagaccttttagtctcctctcctgccacaaagagttagaggatgaggggattaacaacaatctcattcctcctggaggaattttccctagtgaaataagggaacttcagagaaagccccctgaccaccccaaacttcatgagagaaagaggatagtgagatggacagactgggcctggggaatggtgagaagtgaagtgggaggggtcagagagaccttagatctgaggctgcttctttagttaaaagcaccatacttctgggtattgttttctgagcccaaacattattaaatcatattatatttgaatatcacaaatgaaaatcattacatgaattaatcagatcttgatgttcttttaacagtatggcagcacctggagaaaactgtgaaataggtatacttgatttagtctttggctttagaattgcaaggaagaggtgctaagaagtggctatttgatcaccctgcaagctctcctctctgtgttttcctgttcccaggttttctccttctgctttggtctgccagtcctaaagaggaaacacattcacactcaatcaggagtaacttacttccattcactcttccaggagtatttgagcatcaaaatgggactgtgaaaaggaaatgcattatctgaaggaatggatgccaagaccccaccagcaaatgtggaaatttgaggggagtgggttctgtgcacctcgaattcagccacatgtttacccatgctactctacctaaccaatgagctgccctttcttggcaattcagtcttctttcaatatattaagagcagggtgttatcatgtgactcattttttttcgatgtaactttagctgcttgcagaaataaaattgcttcttaatagcagatctaaagagggacaaatcacaagaatgttccagttaaatttatattttctgtaaatatgccaactgcacttgcacttctttttctttcttcttttttcttattttcacattttccctgaaccttctcttactgaaaagaaaataaaaggctataaccatgcacacagatattgctctgttttgaattaggttgctatgttaaccaaaagaaaaaaaaagttaccagctatcattgttccaaaggttgatttctgatttctctaacttctgttgtgtctgcatttctctcctcatttttcaaagaatgaccctcaatagcttaataaatcagctaacaaaatgttttagcatctgctaacattccctcagtgtgttacatgcatgttcaaaggctttgttagaaaacacaatgaagggaaaccacaggcaattctgacaggcaatatgatcgggtttcaaaatacttcaaaaccccaatctttacattaagactttgcttgtaaatatttacattgattgcccagatggtggcagaattggagaatgtggatcactttttttttagaaatgtctcttaataaacttaaagattcataagccacaattgcaaactttagtaaacacagtactacatgttcatgtgaaaagttttgcagctataattattattagttttttaaatcagagcaatgggaagtgaaaagatacaagttttcttcagattttgaggacagcaccttcctgcactatccgtcactaagataagcctgggtcttggttgcttctaaaatagttcaattcaagacaatgaacttgtgttgactaccaacgatgtgaccttcattgtgccaatgatacaaaatcactctaaagtgtagccaggcaaagaattacacagttaaaggagaaaggatgtgactccttctaagtaggtataatcaggatcctcagcagctcttctcttacctggtcagctgcagttatctcctaaaagttcttcttgcttccacttttctttctctctaaaccattctctgaaccacaaatgttccaaatctcaattccatgccactctcttgcttaacacacttcagtgaatccccatcactcccaggacaaagtccaaatcctaaagatggctttcaagacctcccatgaattgtatgtctcttggttacctcagtgaccctgtctctaccacttttgtccccatcctctacttttgggtttagccacacagaactactcatggttacctaaatagggtactctgcttccgtttctatgcaagacattcatccagacgcccttcgcacaagcctgtattctagagggcaggggcgcggggggcatgagaaggcatttagaggaattgttcttgtggcttagcagccattgtgcaaataatgtggattttattagtaggagtggagagaaacaactaggggctaaagccatgtgcaagaggggatgggcaggaaggaccagctctaaggacaagagcatgcaaggcctgcagtgaaaaacctctacgtccttcacgatcccttaaaaatctacctgcaaagcagtcattccatccccctctcctctgcatccccactccaacttggccaacccctaataactttgcttcagaggtcacctctctccagaagactttcccaagtctcaccagcgcttacctccctacccccagggaagggtcccccagaggtctctgctcaaatctggaagggtgtttctcacaggccattataatttgttctttgcttctctgccttctgcaccagactgctcaatttctggaggatagggacagtgccttgtctacctttgtgtccccagagcctggcatgcacactggcacaagataggagctcaaaacctttgtctccccagagtctggcatgcaagctggcacaaaataggagcccaaaacctttgtccaagatattgaataaacatgggatggcgtcagacattcactaagcatgccccagcctctgactcaacccccaggtagagaccactatcctgtcactctcctcatctcccctcaacagatttctaggcttttcttgctcagatttgaaaactaggtagaaaactgtctcactgagacagccaagtaaaaatggctccccagagaacttccgactgacctgagcactgggaggatgggacggggccttgggaagttcctgccagttgcggaggtggggaggagcctggcctctccggttcctgggtggacctgggattcaatcagtgagatgggggcctgtgaacaggaatctttctcgctttgctgagagttttgtttgtttgtttgttttgttttgtttggcccaataaattctgtttttctcacccttctgtgtgtccacgaacctaatctttcctggtcatgtgacaagaacccagtttttagctgaactgaggagaaagtcctaacaacatcagtaggtggcagatgagtgtgaaaagttagtgagtgaaatcagaataatatatattcaagagaggagagaggaagagaaagagaggaagaagctgaggtttgacaagagagaggggagagttttagtttcttttgagttgatttgcttggtttgagaacaggtgttcaagattagtgcaggatttcagaaattgtagcagagaaaaaaagaaatggaaaagaagttgactgttgagacttatgatcttgttgatacccaagaagcatcatttctgaattggaattctttcagattaaagttttatttaaaaatagattgagggccagcgcagtggctcacgcctgtaatcccagaactttgggaggccgaggtgggtggatcatgaggtcaggagttcaagacccagcctggccaagatggtgaaaccctgtctctactaaaaatattttaaaaattagccaggtgtggtcgtgggcgcctgtaatcctagctactcaggaggctgaggcagaggattgcttgaacccgaaaggcagaggttgcagtgggctgagattgcgccactgcactccagcctgggtgacagagcgagactcatctcaaaatacataaataaataaattgaaattcccttccctttttccttactggctttgaactgtgtttatttgtgtgagtacagagatcagactatgagaatcatggactctttcaagagttatgaataaataaatgagttaactaatgaacaaataaatgcatgattgaccttccttccttcagagtcatggctgcagtctccacccatgaactccccacgggaaaaaaaacagtcttctccccagactttggggaatatgaagcagccaaccatgaaaaagttgataacttttctctttctgcaatttgtcttctcaaaagaggaatgccatctgaattagctcccttaacacttcagagccacagcatcttctgaatagctggcacaattttcagcaacattcatttcaaatcctgttgactgaacatgtggttcagatgagagcttattatatattgttaaatgatttcattggattataaatcactgccttcacaattctctgtgggacacacatggaattctggttaaaagatgttcaatattgtaaccctccagagagaggcttcccatgacccttcctcatgcagatgatatggttaagcatgcatggccaggctggcctgcccaacgtggcttggatgaggtttctcttcccgaacttgagcaaggttttcccttagtacttgaccttgtatcatcctctcttggccttcagtccacccattccttagctgtcccttcaccttgctgacccaccatctcgctatggctcccttgcagctgattatgtcttgtccctaactgaaaaatagaaactaaatacattttgaaggaaaatggctaactactgataaatactgctttgccattaggggaattcttgagtaagatgatagtcagcagtgaatagtcagtgaaaagattatcatctcttctgcaaattgtccctggtggagatttgattatatgcttaggggccaccttcctgtcttttagaattttctggagcagctgtcattataattactgaggacctttatgtgaccttgtcatcttgggcaggtagctcctaaagggatttctgaagaagacaattcatattttctgtgcacctgccttctcaatattttttgttttcacttagtgtccctgaaactctttctctcttcacatttcactctctgcatcactaatgaggcttccatttacctctttaattaattaattaattcaatatttatttggcacctattaggccccctgtaggataataacaccttaagctctggtctcatttaggagaatttgcatttatgacaagactctagaagacttaaacttttaaggccccaagaggtaaatttctaatggttggccacccctgagttgggaggcactaatgtggactatgaactggatcatcagcatgtagaaccccagaggcagatttctcctgaagttaataaagctccagcctcggggtctcacactgacacagccttttttttttttttttttggctgtacacaagtgttttcggtcgctttatttataattgccccaagctagaaaaaacccaaatggcttccaacagagcaatagttaaacatccatatgatggaatactacacaacaataaaaaagccaacttttgatacatgcaactacttgtatgaattttgaaggtattatgcagaatgaaagaagcccgtctcatattctatgaagccgttgatataatattaacaaaaagacagaaatataataatggagaacagatgagtgactgccaggggttaggtgttaggggaggatgtgactgtaaagggagttttttgaggttatggaactgttctgcatcctgattatagtggtggttacatgaacctatttgtgtgttaaaattcataaaactgtacaacaaaggacaaaagtcaattttacaatacaataacctaaagataaaattaaaaaaataccttttgggcaaaaatataaattttgggaacggtattagagcttcttagctgcctctgtcatcagttctgtctttggtgcctctcgtgcttgatctttatgtactagaaataccagaatatttatagtaccccaaacacactatgcaatcttgcctccatgttgagccttctgccttcctgatatggaaaactccttttcatccttcaaaaccttactcagagcatgcctcctctgtgcagctattttttctgatttcttctcaccaccagatttaagcacacccttttcggttctacttctgcttcttgtaaattatttcactactgtgtcttacaacttattataatgacataggctagtttttgtaattgtttcttcttttcagtaaattggatctccaaaactgtgtaagcttcaggccccacaaaatctagaccccaaatgaccaatctctctctcaatttgttctagctgctgtaacagaataccataaatgggtggcttatatacaacccagatttctcacagttctggaggttgggaattccaagatcaaagcactagcagatttggcttctggtgagggtacaatcccttgttcatagaaagcatcctcttgccttgtcctcaagtggtagaaagggtgaggcatctgtctggggcctattttagaagggcgctaatcccattcatagaggctccactctcatgacctaattaccttccagaggccctacctcctaataccatcaacttggcgattaagtttcaacctatgaattttgtggggacacaaacattcaggccatagcagacaatctctttccaaaaacagaagatttgtgagatcaaaagccatgtctatcttatttaccagtttccaaaacagcacaggcacatggtaggagcacaagaagcatttgttagatgttgaataagcaattatacgtataatgtgcatagctcttttcctgacatgtagtatgggctcaataaatctttgttaaaagaaggattactttgatgaatgaatgaatatgaagtgaaaggtaggtgaaccctacatttctacacaaggagatgttctctctgccttactcttccctattcatctatggtagcaggcaagctgatttccctaccctaagaccagtgatagtccagcatgggtgaagccatccaggaatagttaaggcaccgtgctacctacacgtggttaataaacaggctcttgttaacaagaaacagttatgtggaaatacttcatttccatctgtaaagttctagatttcaaagtggagagctgggatctcttcccacttcacccactcctaacatttataataaagcattgcctaacacagaattatatttttagagaaaaatgaaacacatgcttgagaactcaatcctattaacacaattttttcagtagtggtaaccattaaacagttatgtatttaacctttgtattctttaagtctgctaaaatgtctaattagttaatcaggaaaataattatttgctaaaaaagggaaatttgaaaattgtgtacagatgcataaaactgagttcaaaataaacttctattttgaggctttagtgcaatcccaatgtattagcattttatgattctttgtattcattaaaatgtttttcacaaaaatattggaaagtttcccaaagtcctcctcatgttcctcctggtgtatatcaaacagaatattggactcatctactcaaatcatagttagaattgtattttgtaagaggctatttccttggaagttattcaaaagatacatgtagggaaatattctgatttataaggtcaatctttctctgtcacaaatcaattataagtaaactgttttcagaactgtcttttttgctatttataatagtcaacttgtgaagcacttaacacacagaaatgtgtctgacaccaagattattgttaagggctgttctttcctttttattcagcattgtacgcatgtaccatttacatttattacgtggataatgggaattcatggtcttgaaggcatagagtgaagaaattacttctgaatacagtatgcaagctgaaaagtagggagtgatcatttcaaggttatagtgagggcaactaattttttccaatttggggagtaaaacaattttataatgcatttccaaataaagtctattttatatggaatagtctacagttgccaatcaacctgcccatccaatgcccctttccattggctcccactatcctaatcctaattagtctcgacttgtcctggtgcttttggcaggaagaattacgtttgctcatgctgttcccttgaccatgacatctcttaaaggcaattcactatattgtctgagattctaaaaattaaacttccctactgggatgggtaatactgagtgtcaacttgattggattgaaggatacaaggtattgatcccaggtgtgtctatgaggatgttgccaaaagagattaacatttgagtcagtgggctggggaaggcagatccacccttaatctgatgggcacaatctaatcagctgccaacgaatataaaacaggcagaaaaaggtaaaaaggagagactggccaagcctccgagcctacatatttttcctgtgctggatacttcctgccctcaaacattggactccaatttttcagtttggtgactcggactggctctccttgctccttggcttacagacagcctactgtgggaccttgtgagcatgtttaatacttactaaactcccctccatatatatatatatatatgaaggatatatacatatatgttctgtccctctagagaaccctgactaatacacctacccaagctaatgctttctctacaatgaattgcaaagaaaatgaaagctaacaaagaagatgagtttggctttttaagaaaacagttgaccagacataaaagatctcagggtgaggaaaaggcagttttcttctgaaggcctacagatggaagggacagtatgggtagctaaggtgactgaattcccctctgcacttagtgtgtctggatacaattattggctctggcaatttgggtgctgtgctttcaggacatagtgtatggtgaatggtgggagaattcaaatcatagactctgacaaaaagtatgctccaattctgtttccccatctaataactacaactgtggacaatgtatttcattaccctgagctttggtttctttatctgtgaactggaaatactaatacctacctggccaggttgtcaggattgaagatagtatataccaagtacttatcacagtggtttgttagcaaataagcactaaacaacagtagctattattgtaatgacgactacatggtccttatccttctattcagggtgaggtgagctaagatagttctaagagtttaatgaagcagcattgcctcatgactggtaagaataagaagacatggggaaaggtgtttatcatttaaggaactaaggtgaacagaatcaaaaaggggttgtattgtatcttaggaaactaagataagactggaatacagccatcaggatctatttgtaataggatgagagctcagttgcaaatacaagttccattcatttgatgaaagagtctggcctgactgaggctgtgttttgaactcattacagttagactcctgtggctcaatacccatttgtgctggggctgtattgttcttcatttcaacagacatatgcaaatggttctgagaaatgttagagcctgttcttctaaagtgaagttagtctttctcctggttcttactctagaaacaataacattgttgggtgccccctgtctttcacctcacatctatttcatccccaactaatgtcagtggtgctaccagtgcgacagtagactaacgtcctctggtaggaaggactcaactattctaacactcttccacatttctcttaagttgtgctggaagcagaagtgattgagtttcattcattcagtaggtattcaacgcctaccatgtgttaggtgctctcctttgtgctgaggtaaaataagtaaagcagacaccgtccttgacttcattgagctcagggactgagaaagatgaacactaatcaaataatcacagaaataaaaaattttaatggcacattgtgataattgaaacagaggacaaattgagaatgttctgagtttttaaggggcctctgacctatcctggaagtttgaggaaaggcttcctggaagaagtaccactggagatgaggtgtggagctataagtgggcctataggagtggggtggcgaggcgtgaggcatattctaggcagtgtgggacaaagtccttagacaagaagcagcccagggtatccaataattgaaaaaggaggctggggtgactgggggtgggggaggtgctaaagggtgaagaattaggctagatgatcccatagggaacttgtaaaagttaactatgcccagacccactcctagacattctgctttaattggcatgggatgggtccatggcattgccatattttatttaaaaaccaaactaaaccacaaacacacaaacaacaacaaaaacaaacaaacaaacaaaaacaacctcccaggtcattttaacatacagtcaaagctgagaaattctgaggtacaacatgcagcaccttgtagccatagttttcatcctaacaacaatggggagtcctttgaagattttaaggaggggggtaattagtattaacattatcagatttgcttttgagaagagccctctggctgaaatatggcaatggatatccatggcatctaacaaatcttgctgtgcacccggtaaacatatagtggtagactcaaagtagactgggcatcaaatttactgcatgtgaagactctagatcaaaatgcaacttggtggtgatagatcctcctctgttgaataagcggatcatttcattcaagactgtaatttctaggtggaatgcaagcacagactttcaaggaagcttgaaattcctgacttggtttgggtccatttagagagatttacaaagagaagaagcgatatttagggcacaaagctatatctggcacaggtgacttgtgttagacctggagactcaggcctgtctcttagcattgaaggttcctgagctcccagcaggccatgtgtggctcccaaatctccagtgggaaatatggaaacactttgaactcccttcactatcactgaaggaaacagaacccgatttcagcatggatattgatttttaaaatgcacttcaaatgcacagaaacttgtagtgggaatgcaaggagaaagcagggcatcctgagaaccatgttacatttaggtcattaatcaatacgggatcagaaattgaggaggtgggtgttacaaaacttttcttaatagaatatcatatatgtgacgtaaaaagtcaattaaaaatctcattgatgaggctggttgcggtagctcatgcctgtagtcccagcactttgggaggccgaggcgggcggatcacaaggtcaggagatcgagaccatcctggctaacacggtgaaaccccatctctactaaaaatacaagaaattagctgggcatggtggcaggcgcctgtagtcccggctactcgggaggctgaggtaggagaagggcgtgaacccgggaggcggagcttgcagtgagccgagattgtgccactgcactctggcctgggcgacagagagagactccctctcaaaaaaataaaaaaataaaaaaatctcattgatcacctttgctaagaactaacttaactagttatttgaaaacttttacaaaatattaattatgtttccaaatgaccaagattgaaaaacaggaaagatgagtaagtcttaccataaagttatcaggaggctacacaaaaactaacaagtaattacacgaaaatacggggccctttcttctctcaacttcgcagtttcactcttcctggtctctcacctactctctatggtgtattttcagtataaatcaaatataattatctaaaaagaatgaaagcatatatatttcaaaatagttcacagaaaataaaagatagcagatgagaatagagggagaaagatgtggaagagaagaggtgatggaagacaaaactttgccagaagagacaaaagaactttaaagtctaatttataaattgctaatctgaacaaactaatagtctttcaatgcactcagtgattggcgtaatttatcttggctttaacaaacatgctgatattgcttcttgtaacacatttattaccagaagaaaaatataattggtatcagtgtgaatgcctttggctgcaagtaacatcccaagtcagctagcttcaacgttaagcaaaatttgttacctcaaagagcaaggaatcttgagatggggtggctttgacaacttccgtatttcctccctgccattttcaaccagttagatttgcccctggcaaccatcccatcatggttgcaagatggctgccatagttcctatcatcttaagacactgtaatatctactggtagaagacatacagtttcttcctatatgattcattataaaaagcaagaaatcctttccccaaggtcctcagcagacctctctgatgtctcattgtgaaaaacttgatcaaaagccgacctgcctgtgatccatttaccagcaaaataaataagatctctctgattgaaggattggtgctgatgaatgaggttttaaccttgaataatgtaggggatgggtgaaccaacagagttcttctgggtagcaagaaagattgaatatttcttaaataggttgctataacctgcaccagtgtttctcaaacttaatgtttggaatcacctgtgatcttgtgaaaatacagattctggttcagaagttctaggctggggcctgagatcctgcatttctaacaagctctctggtgattctgatgctgctggtccacagacaacactttggatagaggatctagaccctagacaatcagatgagaagcagtctagtataatatgattgaatacagcttatattagactgtctagctgggtgatttggggtatgttacttaaattatctaagcctcagaaaaaggaaggaattggggaagaagaaagaaagggagagagggaggagaaaagaggtgtgtgtggggaggtgagtcgcagactcattgatgagaatctccaaagcagtggtgtttctgttcgcttttctaattcattaagatccctctgtggtgatgaattagagaacttggaagaaaataaacagcgtagtgtttaatatgagcattcaggaagaaaataaataaactatactaataaaattctgggaatggtaacaaatgtatatgtatagcagaataaaaaacctcagggtcccagtgatagcaaggtatattgaaatactgcagtgatgttacagttacaaaacatactctgcctttctgatgcctaacaatgcatatattatgttctgagctatggagttctgaaggataaagctttttgcccctgagtcatacccagaaaggaactgtggcagacttagggataggttatgaggaaggagtaaaggaagaggaatcctcattatgaaataagaccaaatgacacacctaacccaacttcagggggagataggtccttacttgacagggagaggcaaatggctgtttcctgtcttgacagatcagatagaaaagtgaacaggatgcagtagcagaatgagggtatgtggaaagatttgagcaggacccctgagtctagatccctcccagtcctgcttttcactagccctgagtcgttgggaagttggcttaacttatcctagtctcaggtgtcttccaagagctactgaaatagtaatagaagtcaacgtacacatgataaaacaggtagcaatggagatccattatctcacctactacctccctgataatcccataatattggcatcatgattatgtgttattaactctctggggaggggtggtgttctataaacacatatgatttcgcttactctccgtaccaagtctactgactcctttctgccttcaatagcaatattataatagcagaagaacactttgcatcagttattttgttggtcttcattaggcattaaattcagtcaaatgaagtagtgattttgattccaaaacacttagtgtgacagtccttacctctgaccttgttttgcatgtgtcacagtgttttgtaaacttttcctgaatgtgaaatggatgcctcgcgtgccctgctttcgccttgcagtctgactattccatttctgtgcacttgaagtgcattcaaaataggcaatatctgtgctgaaatagagttctgtttcttcaatgataataaaaaagaatgtcagttttttgcttaaaacccacaacaggtagttagtggaaacttgaaggtacgagttatgagcgactttaaaatatattttcttctgtgttgttaatggcttacatatggggcttcttgcagggtgtaggaaacttctaaatagtcctaggagacacacatgaacaaaaaggtcatggcattttgaaccctcactgctgccttctttacaattacccatatgacctttggagaggcatctcggagaacaccagggatttgcaggaaagccgggctgcttggcctggctactttctacagaagccatgactgctaaaatggactctcagtcatccccaggctgagaagttagggctgcagcttgatttcaaagaatgcagatctaaggtccaaggtgcaattcattgtccacacatcaattaataatgcaataccagactccaagaatacaagacagcagtgtttttcaaatataataacttgaggaagttggtgagaaattgatacaaaaaagtaaaatatgagttcatatagcaattcccaatcatgataatacttctactgggatatatccatttgaatttactgagaaccttcttatattggggtagtttagaattagttctatctacaaatagtaattcataatgactgtggtattggtgaagatgatgataatggtaagtggtaacatcttttaagcatctaccgtatgccagaccctatgctaagggctttgtaggtatcatcttatttaacccagtgcaaaaaaattgacaaattctaggcttaggatcaacatgaggataataaaattttcttttggtaattacatctaaggacataagtacaattcacaaaccttgaggtcaaggacttcacctttcatcttttgatggtgctgcacagtgcctagcagagaaaagactccacaaatatttgttgaaatgaaagaagcaaggaggaaagttttcaaagcccagaaatctgaattatatttgtaaaactaactcagtttaataaaatgtgtcagtgttaactacatcatttaaatgattattactttattttctaaatttttataacaaggagtttaacaatgctgccttagggaaataacagcacaaatgcataaagatggttgggtaagaatatttgtttcagcactgcgtggtacagcaaacataaaacagagccatttaaatgtgtgaatagagaggcaaaaagaaaacaaggatgcaaacttttttttttattttatataattaaaagattaaatgttggggtaatagtcacagactaaatatcttatattcattctgcagacatctcagttaagcatttggaattatgcatgattttttatttatttccctttttctgtaattttaataccacaaatctttttgcaaaatgaagagtccatatttttgctacagaaaccaggagatcagagttgccaatgtggaattatggacattggtgtgtctttctgaagagaaatctaaggctgctacgtgtaccagctgggatcctttcacattaggataattttaatggtagagcacttggcacaagttatttccttggtcttcattaggcataaaattcagccaagttaactactgatgcttatcccaaaacactttcactctaagacttcttaccttggaccttgttttcaaatatatcccattcagatttttcctaaatatctcccatccaagtactaatcagggcagaccttgcttagcttccaagattagatgagactgggcacatttagggtggcatggcctctgtattagtctgttctcatgctgctataaagcaatacctaagactgggtaattgataaaggaaagaggtttaattaactcatagttttgcattgctagggaggcctcagaaaacttacaatcatggcagaaggcacaggagaagtaggcactttcttcacagggtggcaggacagagtgagtgcaagcaagagaaacactagacgcttataaaactgtcagatcttgtgagaactcactcactatcacaagaacagtgtgggggaactgccaccatgatccaattacctccacttggtcccccacttgacatgtagggattgtaggtattacaactttgggtgagatttgggtggggacaaagagccaaaccatattattctgcccctggcagaatctcatgtcttttcacatttcaaaaccaatcatatcttcccaacagtcccccaaagtctcaactaatttcagcattaactcaaaaatccacagtttaaagtctcatctgagacaaggcaagtcccttctgcctatgagcctgtaaaatcaaaagcaagttagttacttcctagatacaatgggggtacaggcattggataaatgcacccattccaaatgggagaaattggccaaaacaaagaggctacaggctccatgcaagtctgaaatccaatagagccctcattaaacctcaaagttccaaaattatctcctttaactccatgtctcacacccaggtcatgctgatgcaagaggtgggctcccaaggccttgggcagctacagccctatgcctttgcagggtacagcgtcccacccagctgctttcatgggctggcgttgagtgtctgtggcttctccaggcccacagtgcaagctgtcagtggatctaccattctggggtctggagaatggtggtcctcttctcacagctccattagacagtgccccagtggggactctggagactctaaccccacatttcccttccatactgccctaacagaggatctccatgagggctctacccctgcagcagatttctgcctggacatccaggcatttccatacaccctgtgaaatctaggcagaggttcccaaactcaattcttgacttttatgtacctgcaggcccaacaccatgtgtaagcttccaaccaaggcttggggcttgcaccctctgaaacaatggcctgagctgtacattggccccttttagccatggctgggactcaaggcaccaagtccaaagattgcacaaagcagcaaggccctgggcccagcccatgaaaccatgttttcctcctaggcctctgtgttgtttgtgatgggaggggctgctgtgacaacctctgacatgttctggagacgttttccccattgtcttggtgattaacatttggctcctcgttacttatgcaaatttctgcagccaacttgaatttcttttcagaaaataggtttctcttttttatcgtattgtcaggctgcaaatttttctaacttttatgctctgcttccctgtaaacataagttccaattccaaaccacatctttgtgaatgcataaaactgaatgcttttaagagcacccaagtcatatcttcaatgctttgttggttagaaatttcttctgccagattccctaactcatttctctcaagatcaaaattccagaaatttctggggcagaggcaaaatgcagccagtctctttgctaaagcatagcaagaatcacctttattccaattcccaaaaagttactcatttccacctcagcctggacttcattgtccatatcactatcaactttttggtcaaaacccattcaacaagtctctaggaagtttcaaactttcccacatcttcctgtcttcttctgagccctccaaactattccaacctctgcctgttacccagttccaaaggtgcttccacattctgggtatctttattagcagtgccccactctcagtaccaattaactgtatcagtcctttcttatgccgctatgaagaaatacctaaaactgggtaatttataaaggaaagaggtttaattgactcacagttctgcattgttgggaggcctcaggaaacttacaatcatggtagcaaagaagaagcagacaccttcttcacagggcagcaggacgaaataagtgcaagcaggagaaatgccagacacttataaaataatcagatctcatgagaactcactcactatcacaagaacagaatgggggaactgcccatatgatccaactacctccccttggtactgcttttgacacattgggattatggggattacatttgagatgagatttgggtggggacacagagccaaaccatatcagccccagaccctaattaatcttgaacctgaaataattttagtgttgcctctctaaccatttgtgacaaagaatgagtttggtaagacttagttcaaactttaagttaacagatattctttatagaagagaaaaggctctagctgcctctcttagaaaaatacatatcaaggccaggcacagtggctcacatctgtaatccctgccctttgggaggccgaggtgagtggatcacctgaggtcaggagttcaagaccagcctggccaacatggtgaaactccatctctactaaaaacaaaaaattagctgggcatggtggcaggtgcctgtaatcccagctactcaagaggctgaggcaggggaattgcttgaacctgggaggcagaggttgcagtgagccgagttcacgccattgcactccagcctgggcaacaagagtgaaactctgtctcaaaacaaacaaacaaaaaacaaacaaaaacaaaaaagaaaaagaaaaagaaaaatacatatcaaaaataattataaaaattacttcattgctttacttgtttttctgtacacaacccagtgagttctcttccaacattttatcatggaaaatgccaactatgtgcacaagtagaaacaataggataataaactcccatatacccattatatagcttcaacaatggtcatctcctttcctaaatggctttatctgtaccctatcccttattttcccagtccctggattattctgaagcaattctcagtatatcatttgacctgtaaatatcaccgtatatatatttctaaaatatagaatagtttaaaaataatactaatacaacactgaaaatttaatattaaatttcttttccttgatataataagttattattcatttttaaattgtaacttttttacatagtttgtttgaatcaagatatcttgtgccttttttaatctgtaggtttctgtctgtgctttctctcattctccagcctccctccctgtatcatcgctatgattgctgtttatttattgaataaatcagattgttttcctgccaaatttcctctatctagatttagggattaaatatctcgtctgtccatttagagtcagctcattgtattcctgtattgtcattgaatatgttcccttttttcttgtatttttcctaaattaatagttttgtagctaatggactaatcacatcaattcaggtgaggtttaaattttttgtgtgggggaggtggggagtttgtttccataggtaaaagtgttcttctgtgaggaaaatacatgaaatctatttttctctctttctgtgatatttgcagtctttgataatgtcatcttttcccctgtgtatttttgggtctgggatgaaattttgtctttggctacattacctgtctagggattatcagagtcctggccccttcattttgctgagaaaattttgcgagttgcctatgaaatgtatgctgtaggtaacccagtagttactccgatagaacgaagtaaggagataagtggaaagtgagttaataattctaccactggctgtatacccttgcctaggttaagccccatgactgccattttcatcatctgtaaaatgggaataactatacctatggtttttatatacaaacatatatggcacaaaaacaatgtttaataaatgatagttattttgttgctatttaaataatagtactttgataatgatatcttgatgaaataataatatagtttagtctgtcatattttaacactggtttgctgacggcagcaggtttggtccatttcttctatttttatgactaatgttaagaaaataatattacaaaacttggaaataggtaaaagaatgactacaagttctttcaatgtcacactggagtattagttaacagtcctgcccaatgataatttcattttctctggatagctattttactattttcctttggtttagatattttatatttctctaaaggtaaagactggattgcagaaaattaacagtcacataaataattttgtctaatagaaatgtaagtgaagtttgtctggtagaagagataacctcaaaggttattgtttaattatccattagagcaaaagctagttttttatctatcttagctatctacttccacatttccttagagccaatgcaaactcagtctctcaaattttctttgaactagctttatcatcgtgctagttctatcagtgagttaaatcaatcttggacacatgcaatttatattcgtatgacagcaatgtatttaaatttttgaaaatcgtacttcaatatgaagttttcaatctcattggtgaattttgctggtctgtttgatattaattatagattctaactacgctgttgccatttctctagaactcatgggagggtacatattaaacctcattaacacatcatgagctagaacctgtactggttttaggtatgtagccaaagactaaatatccttattaatatcaaataacttttatttcgatgtatggcagtggtcatgcattatgatgttttgaatttgtcaatatattctgtttagaaaaacagaagttcctactatgaaagttagctttctttggctctttatttttaaagtgctttaaggtgtagatttccattttttgggggggttgcatttattcatacatatgtggcaattctaaatgattaatcaaaaagtatcataaattattttttcattcctccaaagactatcctgtaatttccagcccaatacctaccccatctccacctctttcacctgagtaaaggaaggagtctttcttgcttggaaaaaaaaatgtaaaattcaactatattttaaaatgctgagagagaaaggggtggggaaacagatggaggcaagaaattcatcagagttgaggaaggcgaagaagagaaattttgtagggtttttgagaggagattatatgagtgttgtggattgaaaagaaaaagaaaatttaataaaatcagtgagtaatgtgttggatctttaaatatcttcgagaagcttgggtatagaatgaaattaccatgaaattagtttataaatatggtttgaccctaaaccatgcttcttgaataaggaagtacttgggaactaacaacatgattctccaggtttatcatatcatgtctttagtctgaaaatatttattgaatactaatgatgcactaggctctcttctaaagtctggggacatacacaaagacagagagcctgcccttggggaacttacattctcactggaggtggggaggagaacagagaataaacaaagggataaagataagatatgttttatatgccaggtggagacgagggctacaaagatataacacagggtgagcaggctggagagagagaagtgggttctgttttatatagtggggtgaagtaaggtcgccatttagtaaatagcacatttatttctagccaagaagacacagttcatcagattgagatcatctaagtagacatcagattgagtaaaagtttcttagatctggattctggtggcccagagtactgaatctgcagtatttcacatccctcagaagctagtgctgctattatatttttcttggtaaatttgtagaacccagaattattttgaggggtaggcatgggttggagatacatattagagaagagagaactagagtgaactctccctaaaatcactttttatttagaaaaaaaaagagacgctacactgcatttccctagtcaaggtttgtacagttccatgccatattcctacaacatgtttgctcatcagagaaatgaaatgtgaagcagttctcttgtatcagtttagagctcctttgtcaagggagggttattttccataaattcaatgtaaaaggaaggaaacataattcactttcaaggtcattaaaagaataagaaaagttagatcctatcaataaaactttaatatgctaaactaactggcagcaagaaagagagctattttctcaataaatattgtatacatgtgctttgtcaattaactttttttgactgtgaacaaaatgtaaatgtcatggataaatgatagctttaatgatgtttttcagcgttgtactgcctgttaccacggcttcttaacaaagatgttaaatcattaggagtcatatttcatgataattaactacaaatctggtaatattaccacttttcatttggcatgaaatgacgagggagaaccatgaggtttattggaggtacatgacaaaggacagagagacttaatgtatgtgtataaatcttataaaactacctattggacagcattttatgatggacataaattcccattcactctctgctagtgatagacagggaagtctgcagtggaagcagaaagctgagatgggaagtcaccctagagaataaagggggcgtatgggtttatttctttgtcttacttgctcgctcttgcaacagctaaacagatcctcattctcgcctaagttttgaacaattagagtatgcactgttattaattctcttattaaatgtattttattataaagtttgcaaagatgcttttatgattaaggagctattggcatttgccattttacactactaatcttccatctgcttttctttgaaccttttaaaatgttcagcaaggtcactcaagattttattgtagggaaataaaagatcaggaacactctgccttgttaatattttcattccagcctgttgttaatatagagagatagtgatatagggcggaaaggacacttcttatagagttaggtaacctgatttgattttgcttattttgttaattttgatattgaccactgtatcagtcaaggctttttctgttgcaagtgactgaaatccaatgcaaagtagctttagaaaaggagaagacactatgttggttgacatagttgaaattttgaagaattctggcacagctctcaagaacaaatcgccccaacagggccatctgtaccaggctctccatgcctctgctttgctttccttggtgcaagcttcattttcaggcaggctgtctccatggtgagcagaacggcagttccagactcattaatcttgatgcctagagatcccagaagaagactgcagtggctaattttaggtctcaaattgactggactaagggatacccacctaattggtagaacgttatttctaggtatatctttgagagtgtttccaggagagactggcatttgaatcagtagattgagtaagaaagatccacccttattaagtgtgggcagttaccatctaattggtcgaaggcttagatagaacaaaaaggcagaagaaaggtgaatttgctcctttttctcttccggaactaggatcccgttttctcctgtccttgcacattggaactctgggttctctggtcttcggactctggaacttgcaccagcagtctgcctgattctcaggcctttggatttgtactgagtcatgctactgacttccctggttctctagcttgcagaaagcttatggtgggacttttaagcctccataatcaagtgggacaattcctcttataaatctcctctctgtctctctatatgtctgtctgtctgtctatctatctatctatctatctatctatctatctatctatctcctctccatcctattggttctgtttttctggagaaccctgatacaaagactgtttctgacactattgaccaatatccacatcaagggtctggttggtccaactgttcaccttagagttcatctatgaagctaggaagagagaacatcatgctttgattgtccaggcctgagcctgtgcctgcccgcctcacccatgggatggatgctaatcacatggtcttaaaagaattaatatgaagtggaagaggagtggttatctgaagaaggaaatgtcaagcagtcaagtagcatggatccactgcttggcattcattcactcatttttttctaactaacttttaaaaattatttaaaatgtttagtcctccttcaagcattgtgctggtagtgacacaaggatttagaaagggagaacgagcttctaggaatttaaattttagagggaaatagttatgtaagaaacatatataatgcaatgagataaagtattcaaagtcaatgatatattaaaggaaggatcttatgggtttgcttgttagagtcagggaaaccttcaaagaacaaacttaaactgttgtttgatttcctctatgagaaccgggtgcacatcggggctagagtggttcgcacttcaggatgaaacaaccgtgaagaacaaggaagtggcaggagatggagctaaacaggtcatcagaggtagatcttgaaaagcccttcatgtgatcaaatgaaattttattattttttctttctgtgagattggtgatattgatcagatgaataatatatatcaaatgtgtacactaaaaagagcacttttatgggcatgtagaggatcatttgaaagagtaacctccccagcctcagaggactttctggctcactcactcagcaaatattcattgagtgcctgctgtgtactgggtactgtgtgagtcaaaatgtaaggcaatgacaatggaggtagaaaaggagacaaatgtgaaagcaatttcacaaagagtaacacatttgatgtcaaatagctatggtagggaagacacaagactttctggttttccagtctgagctattgggaggaggcaataacattccctgagccagggattctctgaatctgtttactcatacataacatgacaacaataacaagaagccagaatcacaggactattatgagaatgaaatgaaataatacaaatttaaaaggattttgtaagctttgaaacataaaatgagggtaaggtgttattttaaaatatatgtaacatatttaaaaataatctctggttgcttttgattccatgatgatgtaattttctccccataagaagtatctattgggcagaataaattaaacaaaatggctttgctatctaactaaaataagcattatttatctcaaaatgccagtctttaccagcctcactttctatattctggcttttttcccattatgcagagtgttgatttggaggggggagtaaaagccagttgagtttctcataaagtttcacactgcagacttgggcgacagtggttttgtttaaagctgattcattgggatttcctaagagatgctattgtataggtacaataactgtttagtgaggttctttatgagacactcaggattatggatccataatttgcattcattgcaaacattgtaacaacttcttttgagccattaaaatgaaggtattgaaaggctgttaagaactccaccaagccgtgaaatcacaacaggttcatttattggagaaaatatcattaagatacaagccagcattacaaatccagatctcttctacgcagttgtcacatttaacttttttccagcctctctgggcaaaggaaggagctgttatttgagtaagttggggccctgaaatcattttgcaatgcacccatccaggcagccatccattcatccactcattcatttcaattcctaggtgctggggcagacgctgaagaaaataacatgctattcctacagagcttaattgtagagacagacacataaaatatatttgcaataaaatgaaaacatgaaatgataggctaagtgtggggtgctttggatgctgctgagaagacagggcggtaggagaaagaagcaattgctgaaacaaaaagaaaaagaaaggctgttccaggcagccaaattaataaatgagcattgtgttgcaaatttgtgaattctgctccctgggaatcagtaattctatcagctagccttttcacttccattttcagaatttctgatttaaagacaaattaagctaaatgcttagttgctccataaggagtctgatgtgaaaaacccatctatgccatcactgggggttctcattgtttctcatctgtaaagtcttttgggatttagatggatcagctggctgacctttgctgctgtcctatgagacataaagataatattcctcatatacctaaatcatctagcagaaaacctgagacacagtaggcccacaataaacagcagatattatccattgacagaatggtggcttggcaaagtattttaaattgaaaagaagaaatatgaattgcattcccaattcctttaaataattgcattttcttccatcttgtaattaaggtctcatctgaattttgccccatacctataagacattaacaacatagattcatttaaacaaattaaaaataatttcaaatttatttttaacaaatggttagactgtcttttgcaggtgcacaggaaatgaagtattattattagtttaaagaaaaatcatgacagtttcatgactaaaaaagggaaaaaattgtggaggacacagctgcacctgatatatatcaataattagttcctaatctcatgtgtttgtaacatataaatcatctttgtttccaaaaataagagcatagtagaatatctatgaattaaaaatgactagttttattactactactaataaccaatgcattgtaatccaaataaagctatctttgggttgtaaataagcaaacagaatcacaggaaggtacaaaacatccctgtgattgttgcattaagtaccaggtctcttaagtctaaatagattgtctcttgttttttcttctctttgttttgttgttgctttgttttttgtttttagagatagaggtctcgctttgctgcccaggctgaactcggactcctgggctcaagtgatcctcccatctcagcctcctgaatagctgggactacaggtgtgagccaccatccctggccttttgtcatatttcaattgaaataatctgggctagttttacaatagaggtaaaaaattccaactctggtgctttggaattgtataactgtaaacaagctaattaacttatctaatctataaaaaaaagggatgatattaatggccactcatgcagttactgtgagaataaataaaggtccagcatatgacccagtctggaggaggtatttagtaaaaaattgttgcacctatctttttcttagcttatcactcaccccgtattagcttttgcaatgctttccaatttgtaacaacccatggggattatgggagctacaattcaagatgagattttggtggggacacagccaaaccctataacaaagtacactcctgatttggaatatgtaacaattcaaatgcataataaaagaaacgtggctcagagtcgaagtgctgacttctaattcatgatgaaaatgctaactgccttatgaccttaggctagtcacttagccctggggcctctagctatacaattagctacagttaaaaaatgctacatcattattataaagtatggtaagtaactgaaataatggatgttacttaaaacgttatactaatttatataatgactgttttttcttggtttaatgcttccattcaactgtattttttttcatttcctacttctttattactgttagtggaagattttctttgccttgtttatgaattttaatctcatcaaattcttaacatcaggtttggaagggaacttgcatattatctgatggagtgaggtccctgaggtgctatttcctgcttccataccatggtagatgtcatttgaatctctttagtgacagagaactcactgcttcttgaagcagtgtgttcctgtgtttgagaagtactgctatgagattctttctaacaccaatccatttctcagctacttcttgccaaaattctacctttaagggctacatagaataagtcgataatccctgccacatggcatctcttcagaaatttgaaaatgggtaacatacgtattcctagactctatttattcgtcatatgcaatgatttaggtatttcagaagtatccattttacccaagatttataattagtatggtattataacacactgccatatctttgaatgaattaagttttagaatattgcgttattcatatatctatatgcactgcttaaatatagagtttttctattttttctaaagttacaggaaccttatgttccaatccatatataacatcagcacttcggacacttctgctgaatataggaaaaaaatcttcaatccaaaacaactaaacaaaaaaagaacatgttgaagcttgctaggtcaacgttcaaagcagaaaaagtttgcatgattgtgcctgagggcacatgaaatggaaataactatttcctaatcaataagtgtgatcatacctggaggtgaggtcaggggaatagggagcaggtatccagggccctgtctaaaggacaccttgtaggccccagggaaagagaccaaacctctgatgcaaagaaaacaacatggaggccaagagggccaaatctgtctatagatgtactgtttgcatggcacaatgttacaaaaaatacaggaggctgcttttaaaaatcaggagatttggccaggcgcagtggctcatgcctgtaatcccagcactttgggaggccgaggcagatggatcacctgaggtcaggagttcaagaccagcctggccaacatggtgaaactccatctcaaataaaaatacaaaaaaattagctgggcgtggtgatgggcacctgtaaccccagctacttcgggaggctgaggcaggagaattgcttgaacacaggaggtggaggttgcagtgagccgagatcaggccattgcactccagcctgggtgacaagagcaaaactctgtctaaaaaaaaaaaaaaaaaaaaattcaggagtttttatataaactctagattgcaacttctcttgaagacttggaagtcctggcaatattgggcctgcatttccactaatcaagcatcggatgataaagctgatgggatgggacatctccaggtgacctctttcccaccttttcctatgtgtaatgtactgaacccactgccaccatctttattgtttgcctgattcctgtgggcattcaaacccccagttattaggtacctggggctatgcctgcctttattatttcagccacatccttctttcttctaaacctcccgttttctttaattatttactcaacccaagatagcacatgtatgtgcaagctttctcaagtgtaattcttcagacaacacagggtggcttggtgctcagatctcctcctctgacaaatgttgagacttctccccttcaccttttcacctgtaatccagtgggtctccagtattttttcctgccatgctgcctgataaatggtattctcctgtgggctacattctcacttttaacaatgctcacttgggctgccacaaggccaaaaggagctgcagctatgtgcccagatgtaacctttgtctcttccttcccccaactgtgtggaattgacgttcttggtttttagtgacagaaaaccagaagccagttaaaatatctttacctggcctataaacccattaaaaaacaaacaaagaaacaaaacaaaacaaaaacactctctttaggcatcagggagaggcaaattaaaaccatggtgagaagtttctagacatcggattgcttattgtattactctttgtaactttgtgatatggtttggctgtgtccccactgaaatctcatcttgaattatagctcccataatccccacatgttgtgggagggacccagtgggaggtaattgaatcatgggggcaaattttcccatgctgtttcatggtagtgaataagtcttatgagatctgatggtttcagaaagggcagttcccctgcacattctctcttgcctgctgccatgtgagacatgcctttgctcttccttcaccttctgctataattgtgagtcctccccagtcatgtggaactgtgagaccattaaacctctttttctttagaaatctcccagtctcgggtatttcttcatatcaatatgaaaatagactaatacactttgactatctaatatagttcctaataacaaaaattggaaaaaggaaaaacacaattcttcctgcctttcctttcttgctaagtgcacagtctgttgagatgagaaagagaatgtgttgatgtggctttgaaaaagaggtgctgggtctggtaaccaaagactagatggagggaagtttctgtgtataagtgaaatagcgatgatagaatgccattttgcaaacctaattaattcaaggatctatgcaatacttatcaatgtctgtcatcacacacacacacacacacacacacacacacacatgcacacaccccagaccttaagtgtgtcttatacatcatcacttataaagtactttagccaccactcacaccccccaactcaccaatcctccagacataattgtggagtcctaataaggaaaaagaagtcaggctggtgggaccaggggaaagtataaagaaagagcagataagctacaagcctgcctttcttcatggtccaggacatgcagccctcctgtacagatagctcataatcttcctgcacctgacttatcacgagaccctcggctaatagaaaaatgcaagttagctcactgccacattggcattatcaatactgcatgtagccctctccagcatgagcacaatcctataaaatccccagcaagcttttgtctcctggcagtcagctcctctcttgatgatctgcctgttgcacccttgcaacatattttcatactttctctaataaatgtgccttttgttacctacaactgtcttggtaaatttctttaccacctacaccaccagccccagttagccgctacccacaacaataactattgattaggaagtgcagagaagagaggaacatgttaaattataccatagagccagcaaaattcctactggaaaattctacagatcaaatgacccagctttttcaacataaaaattagaagagagggggatagaaagagagagacagaaaaagaatctatttaaaatatgacttaaaagacatccacctgaagcaaatgtaacaaaatgatcacttattaattctgtttgatgactacaagggtattacacagaattgttctccatacttctgtagcttagttttcataattatatgatgtttctgtggtcaaaaacaaacataaagaccaaatttggttcaaaaaataacagagagagggaagtgagtagaggcatacatggcattttaattttgtgtatattggaaatactccatattaaaatttgaaaaacaaacagaagcagagatgccaatctcccccactgcactctcacatacctgactgctagagggtaatgttctgtcctaataagactgtatctacccagtctggaaaggaatttggttgtttctgatccctaagaagaatatctcatttgcctttttctatggtgttatcagaaaatgctttgcagcaaataaatggcaactccataagtggatgttaatgaaattttaatgaatctgaggtgctggcaccatatattcctgcagagctcagttttttaaaaatgctgctttaatgctgaaagtttacagaagaaaacagcaacattaaggccaaaatgaaggtagcctcggttggggagatttttcccagcgtagtaaattgtttggccttcatttccctggtcccctggaggtctgcaagccccatggtcagataccctgtggtttccagtgctgggcggcttacacaggagaaaggatccatgatttctgctttcgtcctctgctgcctcttgatattgagggcccctgcatcacttaaaatgtttattgcagattgttcctttttgcccttctaagtagtctgtaaactctattccaggcaggggctgggagagttattgcctgttgatacactcacccaaataagtgctgagtgttctttgctacacacatatggactttggctcagggcccagaatacctgagtcaatttcagaatccaattgttacagcgggcttgtatttttagagaagaaaaaggtgtgcatcctaagatccaaaagctgtctacatttacattccaactttctttttaattaagaagatcacaaaaatcaatagagaatttactagcaaagagggccatactggaatgatttggggaaagaattttgctgcattgacagaaagagggcaggggaggtgtttaccaaaccatctgtaactggctgggtttttctcatttatttcagattccattctctctattcattctccatcccatcccatccttggaccccatctcttccagaatgttaactatgccccatagctatgaaatgaattttccataagagaacaatttcctacttttatggtgctagaacaattgtgtgcattgttagagacccctatatgactttgacttcgtcagaagagaatagtaactctccattgacaggtcctggtgaccgaaagtataatcaaagtcagtgcattattaatgactcttctttttaatgactcaatcacagtgtgaaatgtttttcaaacattttattttatataatttttccacttgggaaagtctgcccacaaattaagggaacacaatagctgaataaaaccagaaatattgtgctggatgttctccaaacaaattgtccttcaaagagatggccagaagttctgatcaattttttcatgacaagtgggggccagataaaggatatacctggatcaggttacctgagaacacagattgagaactgggctttggaatctgacagccctgatacacctggctttattatatactaatgatatgatctttggctccttttgaaaaagctctcagggttggtttcttcctctgtaaaatgagcctactgaagcctctggaacaggggttgtgtgaagatcctatgagataatgcatgtaaagtgtatctccctgggccttgggttgttgactccttattctgttccaagcacccagagtggagaaaaaggcagggagagcaattccagccgctggctgtccatactgctctgagctctgtgacaggtaccaggagaagaaacagtggcatggggatgggcagggaagagaaatggaagcaagagagagagagactggctggcataagaagagtaagggttacattcagcacaattacctttgagatgtaaacaccaaacaacctccaagggtaaaagaagttcaagaattccagacattggtcaagtttatgtagttatgtatgaatgactttaaaagactttgaaactagtgtgtgtttgtatttttagtaacttactttttaaaaatttgcattttaggtgggggtcacaccaatggttgttggttacattctgcattccctttaacactttattttatatattaaaagagtatttatggggtgcagtcatgaaaatggctaccagttaccaggtgcctcctatatgccaggccttatgttttgcactcttcacatatgagctcatttaatctttctgcaatctctcaatgtattattatcctcattttactgacaaagaagcagaggcccagaagactaggcaatttcccccaggtcacaaagctattaaatggcaaaggtgagaatttgaatttaagtttttgatccataatctctgttttgactccaaaacccattatacaccaccaccaaaataatggatgaggctactattttgatattgctaataactggaagtgataaactaagacacagaaccatattttaaccagggtttgctgtctggttatttttctaacactgttgcctctgaagaaaaggcaggtaaataatgtgtgggtgtgtgtgtgtaaactagtaaatttcacctaatttatttgcatcctttctactgctatttctaacccccatttttgagactatcttaagagtcattgtctagggatgcagctacttaaggagcaaaacggtcagggtcatttaaaatctcttaagcagagaacatttaaattttcttgtttctggctactggtaacaaatcttcattaaatcttaaacacagaataaacaaagcatgaacagattgtgactgcttcctaattcaacaaagagagattacggttttgcagatactgttaaatgttggaacagaccctgtggaagtcattttaaggcccagagtattttcatgtattttggcctctctaaatcagtttttcccagaggaactgacattgccaaaaaatatgcattttgtttaaagttgtctggacaaagatttatgcttctgtgaccatctgcattatcacccatgcaaggcaatcaatactgtcctaatccagtcatatgcctactgatgctttatgtatatttcacatacctatctgcacaagagaaggaagtaattgcacagataaggaaaagcaaaagtagcaggacccagtttgagattagatcctttgactgctgggtccagacatggatgggtatgggaacccacctggggtctacttgaatgagggagaaaacttacccagagagaatccaaattagaatgtgcaagtgtcaaagcctcattctactgagaagagaggaagctttgagtagaaacatctagcttttctttggacaggtcttagatttatttggagacatctgttatggccccttcttgctttattttatggttccctattcacttgacgtagtccatgataccaatatccctcttaaaatatagccatcctccaaactgaacttgatacgtaggtacagccagagtatgatggcaattactgacttttttttttaacttacaaaatttactgttattaatgtagcttaagaccttggctttgcttttgtctccatagagagttttagttacctaaagcctccacgtatttgtaattcatatttaggccttgcaaagatgctcattgttctcaaaccatgattccaaacttagctgcatattggaatcacctgggaagtttcaaaatagtttcctgtatctcactgccagagagggattttgtaggttcagagtgtggcctgggtttggggatttttaaaagactccagatgattccaaagtgcagggaaatttgggaaccactgttctaaccttccaattcaaagtgtggtccatggcactggcatcacttgggagcttgctagaaatgcagatgcttgggctctactcagacctactgaactagactctgaattttaacaggctagctaggtgattcatgtgcatattcaaaaactattaatataatcctgattacaagacttactttgaaattttattaaattccactttttttcttgagcttcaagaagaagctacagtttcatcactggggctcagaccacatgtgaagcaactgggttgggtgtcctcaagtgggtagggttaaggctggtcaatgataaacctggcatcagtattagacattcaggctaattctggatcaaagtgaacacaggaatcagaagaagattaaaatatagttttagctctttgcttgcaaagctgggctgaagacccggatggaatgggctgttccttgtcctttgatttcccccgtctcagctagttagtttcttgagaggggagagaacagaggcctctgctatgaagtggggaggtcctgcctgcaccttggtgagcttgcccccacatggcaccactggcagagaggagaacgtgttctgcttaagaacaacttcagaggaaggacagcgagcaaggtgacagctagctgtagaagtcagtgaccattcgcctgccttactggcccactgagtcactccttccactgggagggtgggcatgtagtttcctggcagctgttgctattctagggggcacagtggaaatgtaggaagaggatataagtcttttacctcatccctttttgttgattgggaccagagagcagttacctggcaggcctgcccaggaggactggtcagaaggcctcagaggaggaatgagacagaagagtgagccagcacggggcctggttgatgggttcagagaatcagagaaagcagctcaaagagcagctgggctcatggtcaccaacttgccttgttcccaaatgatgttagcttcctagtgtcttcttttactcagagagttgagagttgagatttcctttggtttcttgaatttcagacaggtcactgaaggtatttaagaatcttacttatcaatgggtggaagttagtaagatggtaggtggcctttttttttttttttttttttttgtagagacaagagtattgaagtgcccaggctgttcttgaacatctggcctcaagcaatcctcctgcctcagcctctgaaagtgttgggatcacaggcatgagccaatgcacctgcctaaaattatatctcttaaagaagtgatttgtctttcagagatactacctagagaggcgccaggagagaaagggcaataggcagttatttagctttccccttccatcagttctggaacttagtcattctctcgcgtctcatttttcctctaactttcagatgtgcaaaggatgtcttaaactcaacaagacaggagaacagaaaatcccaaacaacccaccagtataaaacacacaaatgtaacaaacacaagaaaactcaatactagctcctctttctccagccaaactgacaatctgcttgttggcagatctctgaaacgtggtcggtgctcactggcactacttcctcaccacagccttgctctttggctcccagcatctggcccctcccaaagggctcaattgaaacctgtctcccaaagggaacatgtggcgtcctcattgccaaatccaaagccgtttcttagctcccgctccatttaatgtctttctgaaggtcattcctttgacatcgttgactatatttcatttctttctcttctggtgatcaaatgcatgagcttaggaatcagacagatctgaacataaatcctaactactgctagtaatgtgaccctgggcagataaaatacacacacacacacacacacatacacacatacagatgtgtatcttttattttgctctatagaaacgggatcatattttatactcttgtctgctgtttgccttactcacttaacagttcattgtggaactccttccaaaagagttggtgtagaactcactcattcttaaatattatggatgtatcacaaattattcaaccattcctctgttgatggatattccatttgcttcagacattttctactctgggttggtgatttcatcttatgggataaatccccagttgggggatggctggatcaaaggacacatgtatatttaatttacatttagtgggtatatttaattttaatagatgttgccagatggccttctaaaaaaactgtaccatttcacattccaccggcagtgtatgagtagctcttcctcaaagcattatagtcctgtttaattttttacaaacctggtgcatttcctcaactactatagaaattgagcatctttacaaacgtttattagccatatttggatgttgtgttctgtgaacctgctacttatatccttattcaagttacttaacctccctaagcttcagtccctttacaaagttattatgaagattaaataaaatatttatgtgaaggctttgcccaaagcctggcacaagtgacatgcttggtaaatagtagctgctgttaattcttttaaattcctttttccttatttagttaatcttcatcttcatacctttaaacatgtatctataagcattttccaaaattctgcaaactaatttttctctttgacatcttgcattctttctttctgaacatttcaattttacagtctctattctgttaaaagaccaatttgaacctctaatcttgacttgtcttttaacagcagaattgacggtttcaataccttgctggaccccacagatttatcttaccatctactccctgccccagcagcaaactctgcctcacaggaacacaacattcccatctgtgctcctgtattcctaaaggcacccttttctccaagacctatgggcttgagatcataaagtcatcatgccgccttgccctagacgttcatgtcagtagaaaagctccataaatcccctttacaatggctcttatagccatcctctctttcattgtttttactctagttcactccatcaacaacaatcaaaatagctaactaaccagtttttcctctgccagcgtctcactttttcaatctatttgttacattccagggaaaatcttctaaaacaataacagaatcatgtcactcactcagaaccatttatcagtttcttctattacagagtaacattctcactggccttggagaacactgccccaattcctttatgcaccgtatttttttcatgcccccagtctctttagtttctaccaacacgccagttctgatcactcacaagtgttttttgctcttctggcctaacagcctacaattcctcttccttctccatctgttggaattttatttattttcagagcctctcactctgttaagatcttccacgtttactcacctagaatgaatcaagtattctagcagtttcctatagtatcccccaatttaattattctgtaatatttattattatagtaggtcattttcacaattcttcttggcctttcctcaccacaagcttcttgaaggccagaatttactttttgttccttataatattttctttcttttctgtgtttcccaatctatttcttatctagtaacttttaagtgctcctttatttatttattttaattttggaataaatgcatgactggggttggagattagggaaaattgaatctggtgaaagaaaggagcgagttgtcttagattctcagaggtagcaatgggaccatgggactggtagcaatggtggccatgggactggtccatcccatagttgtcttttatttgcttcccatacagtagtaagtgaacacatgttttataagttggtcaacatttaccaatcaggatgttttatataagcatctggcttctcttgaaataaggaacatcagcaagactggattggcattcctggacggtatatggatggatgtgaggtatgacaaggtttctcttcaaacagcctgatcaaccttttgttctttaattcccagtacccctccccatctctttcttcttctttccttctttctgcctttactacatgcccaggcatgccacagcaccagtggcgttatcagcaccagctcatattcctttccttatttggaaaaggactggctctctagctcactgcagacgaccccttcccgctctcccctctctcccttacgtgcctgccttatctaaaaaaaaaagtttaaatatttagccaatcgggtctagcttagattgtgaggtctgatcccagccaatggggaaaggacacaggggcaggatttgcatcaggaataaaaacttccactctcctttggtctgtgtgccctcatggcaactggccatacgggaggcacccctctccacagaagtaaatttgctttgctgaaaaatcctttgtctgagtgctcgtttgcttacaactctgagctttatttctaacaatggagatgagcaactgtagccttccttgggttggcacagtctctcatccttgctatagcccccacctacatctcatacccatgaatattacctacgtgacacctatgggcatctgagtctgtaatcacagcactaactccatgtgtgaccctgggctggccaatggatccttgggcctcgtgttctcatctgttcatactttataattacacaactttagtttatcaagagttccttttatttgttttttttttcccatggatctcatgtttaagatattttctccatgaaacagcgcacctattgaacatatttacattgtttcacttacactgtcctctttttccaaaatgattcagattttaaacaatagtccagaattatctggttataattatattatgaaatctcataatttttatcatgtttattttgctaactaagcaacagttaaggcacacaaataaatgcttatgcactgtttgttgctattgtttgctggggtttttttagttcactgccttctatcccaatcacaagtccagtcgagttactgtgacagcctgacatgggcctctggtatcaatggctgggtccaccaggtctgacaattcctgtgataccattaggagccagtcagagctattacaatgctgagttgataaaattgtgtgtgtgtgtgtgtgcgcgcacacatgtgtgtatagagacttgagtagcatgtgtggtagccttgtcgtgaatgtatggataatgcttattattgaaataaccaaataaacaactatagaccgtaacatataaggtaaaatttgaaccctttccactctcaatctcattcccagttatttctttattgttttgaatgtaatggtctaacctttttctttcccttgtgtgcatttaaagaaactgtgaacatactataaattctatcttttgatttgctcttttctcattacttcacaatgtgaattggatatcctttcattccaggacattttcatctgcctcattcttcttaattgcttcctatcattccagtgaaggcgagtatcaaaaagtatttagctagtttcctgctgatagacatttagtttgtttccaatcctctttccaatttaatgatcagttttcttgatgaagaaggtggaggtaaaatagttattacctgacagtgtttctggccaaaatgctaactactgataggtatttgaaagttgactccctgtattcttgcaatatcctctgaattattctgtattctgaattatttgtaactgaattattctgtagtttactttttcctaaatgagaatctggacttaatattggctaccctttttattcataaagctaataactcaggttctgagcacttattatgtgccatgcgcatgctaaatactttacatacattatcccatttaatccttccagtagtcctaaaggcaaatactatactattatgtcaattttacagaaatgtagacaactaatttgcccaaagtatcataggtgtttaaggggggagagtttgaatacacacaaacccaagctagaagctatgctcttaactttgattgatgagagcacagggtctgttttctcagggtctattttcttccctgaatcctcgtgtatgtgaaactctaacagcagagtgaggaagagaagaaaggacttccctgtgtgctgggctaagagtgtaatcaggagcagactgttcctaaaaacagggttgtaggagcagcagtaaaagctcatttctgttacaactttggagacccctgtaatgctttcaaattagaaacttttattagtccatgttgtgttgctataaaggagtaaccgagactggataatttattaaaaaaagaggtttacttgactcatggctctgcagaatgtccaagcatggcaacagcatctgctcagcttctggagaggccacaggaagatttaacttatggcagaaggcagaggggagcaggcatgtcacatcgtgagagagggaggaatgagaaacaggggtctcttttaaacaaccaggaaagggcacaaactcatccataaggcaccccaccccatgacccaaacacctcccactaggcccccactccaacactggggatcacatttcaacatgagatttggagagcaaatattcaagctatatcaaagctctgcaccaaagctctatgctgatctcttgagaacaaatttatgcttgttgcagaaacacaggctatagtagggaaagctttggactctgaagctatagatttgctgtggaccagctatgaccacggtttcctccaccagaggataaggcttggatcttttggtctctgacgaaggtttttattttgaaataatttcagaattacagaaaatgttcaaaaatagtgcaaataattcccatttccatttaccttccacacagaatcctcaagtgtttacattgttccatgtttgttatgttgttctgtctcctctctccttacacacacacgtatgtgtttgagtttagtaaatgtcattatcatgttatttctatttcccaacttttggggaataagatatgaacataatgccctttacccctaaatatttcactgtatattaagaaacagagacactctcatatataactgtagtttaattattaacattaataatagtaatcttatctaatttatgcaccttgttcaaattttgccagttgtcctactaatgtcctttaaaataaaataattttcttttttttctggtctaggatccaatacaagataacatattacattttttgtcatttctttatagtcttctaaaatatggaaaagttcctcacaaaacgtatgtttgtcttttgtgactttgacatttttgaagtgtataagccagttattttctggaatatccctaattttgatcttaggatatccctaattttgatctgttcagtttttctcatggttagactcaggttatgcattttttcagggaatatcacagagcaatgttgtgtccatcttggtatatgacatcaggaggcaggcaatggatgtttatttatctcattacaggtaatggtaagtttcaagacatgatatggatggtatctgctcaatttctttcttataaagctattattatctttttgtaattaatttatatctttgcagacatactgtggagacataatgtaaatatcctgtttgtcatcaaactttttacccaatagttttagcaacaattgatgattcttatgtgaaacattatttctgtgttgcttatcaaatgagtgctgagactcttgctttacaacttttacttacaaagcgcttactgaacaataataaaaaaattttagtcacttcagtgccatgtagataagttcatcattcaacttggattagccatatttaactttgcaaggtctaattatggataccatttattaccgagattaagagtaaatatataagaaagatatagttcttaacatactgttactttaaatagatttgattagaaattttgctttgtgaaaaactactcaaacttccagtgttaaagatgaaggtcattcacattggaatttacactcttttaatggcttatgtatagttgaggtccacttacttgccaaattcaaacatttagattcaaggaagaagtccaactgaatttcatgattgttctcaaggggacaaataaaagaaatatagacattcagcacttcttggctacaaagttaaccctagggattaactttccacagcacacgtagcctgtgctctctccagcccggctttcatggtccctactcagagctcagcaactccactgaagtcttcaggaaaccactgaatcatttgggtcagactggcttgactgggcctccttgtgctttgctgttctcccaaagcatggaaagttttaatctaaacaatcattctttaactcatgagcagcttttcacctccccctttggattttgggtctgtcgcttctctgtcctatacaaagcaatgtggtaacaggcgtacccattaaaactcgtccatatctctacacatttagctgttatcattcctaccttacaaacagatggaaaactgcaggagataacttgtgtgcattggaagccttttctataacttctacaaagttatttttcatacaaactcatgtgttcaacaaccagttgagaaaaatcttatagattaaatgtgaaatcaaaagcaatgcagaatttctagaatttgcttcattgattttgtcaagttatacatctccaaggaaaagggggtggccattatcttttcctccaggtcctctcttcattctctcttccctctagcagggggaaaggcaggacttaattagggagggcactgatagctgatgattaccaaactaatgctggcatcaccctaattggcacctagcaccttgtgttgctgagtaggagaaatttcttcctctaatttgtgcttctgaagcatctacagatctggcaatttgccttgtcttcttttagtgccagcaagcactaattactttattatttgatttacttcttaatgaattggtgacttgatttaaaaaatacttattatatatttgcttggtatcaagaactaagctatagagtggaatacaataacaagacagaatatctctgccttaggaggaaacagacatgagacaaataaaatattataatattctatatagagtattacgggaccatggagaaaagaacgatttattctgtctgcaaaaataagagaaggcttcaaagagaaagtgatatttttgctaggtattgaagaacaagaggagttcctcagaataagaagcgaataaagattttaagtatgtacttagaggtatataaaagtatagtgtattcagacaaaggtttagagtccaatgtggcttaagctaatgccatttggagactactcaaagcagtaaggatagttaggtagagtgtagaatcagaatcaagactaatgcaggtttccatttaatgtctgtgttttactagcatagtatggccagattaatttatttagtctttctaaccctgtattatctcatctgtaaaatgaagataatactcatttctcagggttgttgtacagattcaatgggaatatttataaggtgcctggcagaaagcctgggaaagagtaactttttaaattattttattttatttttcttttactatgctttggtctacttcccctaccaggtagaaaggtaagaatggcaactgacgagcctggaagtagaattggggcccaatgttgaaagcctaaaatgccttgctctggggtgtagatttcatgcgtctggtcagctttctttcaacaaattagatttgcttgaagctccaaaagtctactcatttggtttcactccaacccaaacaaattccatttccctgagagctgccaatcatggctaagtgtatatctgatatctaaataaaatggttcactggaaggcatgactatagtaaaaaagagaatgatgcaactcagaaaagaaaaaagaatcttcaacaacaatttaaggaagtgttaatcagcattcaggaagtgaggattgagaaaatacatattgccacacacatgcatgaacttgaaggacaaaattgtgttagacaaattgagttagatcctcagtgattccaagatcttgcagaaacagagaagtcctcagataagggaaaggtgaaatccagtcaagcagagaaggggcttggtgagtgactttccttttacatcgcactcagataacagaaaggaaatttcatccaaacaggaagatcaactatggctagcccgtttgcactatatcccaaaggaacccatatgtagtttatgtgatcaaagacattcaggggaaatattagaatcttttaataaagaatgaccaataaatagtggtcggcattgtttcactttccatatgttttactgcccaataaaccaaagagaaaaatatattttcagagcagaaaggggataatagaataggtaaagacttagtaaagtaggtaaagtaggtaaagacttagaagaaaattgtaagaaatccaggtggtaaataaaatctatattttaaattgttttcttatgcatattttaggatccatgataaaaactatgcagtaatggttaacctgtagtattaatgatgaaaaaaaaggcataatttttaagaacgtgcagagaatagtaatgtttgatagcaaaaacataagcaaaaacaaaacaaaacaacaataacaaaaacccctttgcagataataacaggaaaatagttaagtaaattactatctctcatttggtagaattgcatgctggtattcaaatatgttttgcagagctaccatttgacccagcaattccattactggatatatatccgaaagaaaacaactagttctgccaaaatgacacatgcactcgcatgttcataacagcactattcacaaaagtaaagacataaaatcaacctaggtgcccatcagtggtggattggataaagaaaacgtggtacgtatataccatagaatactatggagccacaaaggagaacaaaatcatgtctcttgcagcaacatggatggagctggaggtgattatcctaagcgtattaactcagttacagaaaaccaaatactgcatgttctcacatataagtgggagctaaatatcgagtactcacaaacataaagatgacacaatcgacactggggactactagagtggggagggaaagggggacaggagttgaaaaactaactgttgggtactgtgctcagtacctggtgattggatcatttgtttctcaaacctcagcgtcatgcaatatactcaggcagcaaacctgtacatgtatcccctgaatctaaaataaaagttgaaaacaaaaccaaagtgaaattttaaaaaaaaattgttttggaaagtaatattttagtagccaaagagaatatcatcaaataatctaaataaacaaaaaaaattaaagagagataaagtgactacatataaatgaaaaacatgcatcatagaaaatgtaacaacgttaaaggaaaagtgtcagactagagagactatctttgaactattctttgaactatttattaaaactacttgtaggaatttatcctatatacatactttcatatggtcttaaaaacacatatgcacactcacacttttgagaagattgaacactggatatttgacatgtagaaattggtgttaatttgttaagatgtgatggtgctatttggctttgatttttaaagtccttttttagggatataatcagacatatttgtagataaaataatacgatgactgggatttgcttcaaaataacccagtgttttaagggcttggggagaagctggtaagttcatagatcagatgatttgatgattgttgaagctttgtgataggcacagaatggtttagtactatgtatgctttttctacgtttgtgtatgttggaagtgtcctataatagaattgtttaaagaaatatacagaaccgtgtatatagtatgcttctgtttacataaattaaaggaaatgtatgttgtgtatgtattttttcatttatgcttatgtttatataaaaacatagctgtaaggatagacaagaaagtaggaacagcagttgcctatcaggaagatagttatttgacttggaggtgttttaggaaggaaacttattgttcatggtatatatacatctactatttaaattttctaccagtatctgtattccattatatgtgtgtgtatatatgtgtgtgtatatgtatgtatatgtgatacactgacttgaatatacagacacacatacatatataataaaaaatgatttattcaagatattaatttactgattttctctagtacatgtattcatctatctatgcctttagtataaatatttgcatatatgcatgtttgtatttatacacatttatatatttatatgtttgcatatatggtgaaatttgtgtataaaacttttaaatattctcagttaagatcagaaaaaattttgtaatctgcttttatcattttctccttaatatatcagtcaaaacctgattttctgaaaagcataaatttcaaaagttttcactgaaaaaatggagaaattttgccttttaaaaaatgatatgcggccgtgtgcggtggctcacacctgtaatcccagcactttgggaggccgaggcgggtggatcacgaggtcaggagatcgagaccatcctggctaacacgatgaaatcctgtctctactaaaactacaaaaaaattagccaggcatggtggcgggcgcctgtagtcccagctactcgggaggctgaggcaggagaatggcatgatcctgggagacggatcttgcagtgagccaagatcacaccactgcactccagcctgggcgacagagcgagactccgtctcaaaaaaaaaaaaaaaaaaaaaatgacatgcaataactgaagttgatttcttactggagtaatgtgtggaatgtttctcttctgttttgtggaatccctcctagtgctctcaccttctctgggggttttcttctcatttctcttaatgaacaagtcaaggaataaggtgtgtgttgttgctcactatacttctgcctaccaccacctcttccactgggtgtagtggatggggaggctttgaaagagataaatgaatgtctatgtgtatgttggatactctaaagctcaaattcctgaatgtggcatttttccaaccaaaaacgcatatgagcagactaatacattttaaaatatcaattttcaaaaatattttttatttcatgactaaaactcttctgaaaatctgtcccataattgtgttattattttttcactcatcccacttattttgtgggtctaatgagatgatatttgtgatgcattagttaagttggtaataatgggtagctcttcatggaaataatgaatatctaggacaaaggtaaaatatcattaaaaggtaaaatatcattaggaccagtaagttttacccagtgtcctgttgaaatttacatggtgagtgatgtcagcaaaaatggtggaaaaagtagtttcaagggcctgttgcttttggaaaccaagaaatcaagtaaaagctgtcagaatcaactttgtcagcacgctggaaaacagtcaaatgtttacagcaaccaagtgaatgcttaatcgaaaaagaaaaaaaaaaggcaactttaaaaatgagcggacaggcacagtggctcatgcctgtaatctcggcactttgggaggccaaggtgggaaaattgcttaaggtcagcagtttgagatcaacctgggcaacatggcaagacaccatctttacttaaaataaaataattgttaaaaaatgatataaaaacttcaaggtacttttacataccctttctatactcccctacccggcttggtagaatttttgaagcccatgttcccagtgtgagaccgtgtccctgattttgtagggagaaagcaagactttatctattcaaacaaatcttggggcttgcctgagggactgatgcaagttgtttgtctttattttgcctaaacttgaactcattcagggtgaaaaagcagtgggtatttcttgaaaatattatagggtcaatgaacaacctccagccacctggggcaaaaggttgtagttgaggcaaataatgaagaactgaaatcctgggaggaaaaactggaaagatagtttatctgggaaactaaatcattcaaaagtgtctgtatatactggagagattaaaaaccacatgcacacccagtgcaggacacctgttagaaatgacatgagaagaccttgagctatcaactcatgctgattgctaggccaatgcaagcaggaagtgaaggttaagacagaattttaaatagcatggctaagcaatcaaggagtgccctaacacagagctaatttcaccagatgatttcaataaaagattcaagtaggtagaagaaagaatcagcaaactggaagtgggtcaattaaaatgatctcatttgaaaatcagagagaaataagaatgaagaaaagtgaacagagcctaaaaaacctgtaatatgtatgtatatgtaatacactgacttgtatatacacctaaagcatattatcatgtgcatgattggaattacagaaaaataggagagagaaaaagaggcaaaagaatagccaaagaaataatggccaaagctctccatatttggtaagatgtaaaaatccacacatataagaagctcaatgaatcccgagaaggatcgacacaaagagactcacggtgagacacattataaccaaactgttaaacactagaaacaaagaaactctgaaaagcaacaagggagcagtgacttgtgtccaagagatgctcaacaagattaaaagcagatttctcattccatggaagccagagagagcaaaatgatatatttaaagtactcaaatgaaaagacagaaacaacaacaatcaaccaagaattctatatctgacaaaattatccctcaaaaatggagaaattaagacatttacagatggacaaaatctgaggaagttaatagtagacctgccctataggaaatgttaaacagaattattcaggctaaaatgacagtaagttgaagtcatatgtagaaataatgaactctggtgaaggtaaatgcataggtaaatgtaaaagccagtattattttatctttggttaataactcctcttttgatttcttatatgatttaaaaggcaaatgcacaaaaagtataaatatatggttaattgcctcacagtgcataaagatgtaatttgtaacaataacaacataaagcaggcaaaagctgcatttggacactctttttatctattgaagctaaattgatatcaattcaaaatagattactgtaaatttaggatgctaattataattcccacagtaaccactgagaaaatatctttaaaaaacacacaaaaagaaataaggaagaagtaataatggcacactaaaaaaaaaaaaagtcagttaaccccaaaagaaagcaataatgaaggaaataaggaacaaaaaaagtataacatatacagaaaacaaatagcaaaatgacagaattaagaacttccttatcagtaattattttaaatgctcatggataaaattttcccaaaggcagaaatggtcagacagataaaaacacgattccagagattactttagatctaaagataaatgtgggttcaaagcaaaaatatggataaagatattccatgcaagtagtaaccaaaagaaagccagggtggctctactaatatcaggcaaaatgatcttttagtcaaaagctattaaaagagagaaagaaggacattaaatattaataaaagagtctattctttaagaagccatagcatttataaacatataggcaacaaacaacagagccaaaagatatgaagcaaacactgatggacttcaagggagaaatagatagttctacagtaactattagagatttaaatatcccactttcagtaatggatagaacactgaaatggagaccaagaaggacatagagaacttgaatagcaccatacaccaactagacctgacagagattttgaacactccattccacaacagctgaatacacattcttctcaatttcttctgggcctgtttccagaatagaccatacggtaggccacaaaaacaattttcaattaatttgaaaagactgaaatcatgtaagtgatcttctctgaccacaatgacatgaagttagaaaccaataacaacaacaacaaaaaatactggaaagtccacaaatatgtgaaaaataaaattaaataacacactctttaataccaataaaccaaagaagaaatcactctggtaaattgcaaaattcctaaacatgaatgaaaataaaaacacacatacacaaacttacaggatgcagaaaaagcagtgctcagagggtgacttatagctgtaaatgccaacattaaaaataaagatctcaaatcaataatccaattttgcactttaagaaagtagaaaacaataagcaaactaagcccaaggcttgtattaaaaaaggaaataataattattagagcagagataaatgaaatagaggatagaaaaacatcagagtaaacctggaggaccttgactaattcccctgactaaacgaaaatggtgatatttctatagacctacaacaaaaatatcataagagaatattcgaactattacagaacagagataaaattgacaagtctctagaaacatacaatgtagcaaaactgactcaagaagaaacattagtattagtgttctccagtgaaacagagctaagaagatatctatatctctgtccatccatctaatctatctatctatctatctatctatctatctatctatctatctgtctatctatctctatcaagatatttattataaagaattggttcacttgataatggaggctgaaaagatccaagatctggagaaccaaaaaagttgagaatataagttccagtccaatggctttttgagtctggcaggcttcagactcaaaaacaaccagtgtttcagtttgagtctaaaggcagaaaaatagcaatgtttcagctaaaggtagtcaagcagaagggtttctttttatttagttttttttgtactgttgaggttttcagttaactggttgaagcccaagcacattagggaggaaggacagtctgcattactcagtctactaattcaaatgttaatctcatccagagacactgttacaaaaacacccagaatgatgtttggccaaatgtctgggaccagtcaagctgatacataaaattagccatcagagatatagttaataaaactaaaagttagatccttgaaaagatcaacaaaattgtcaaatctttagcaagacgaagaaaaaaacagaagttgcacttaattgaaatcagaagaaaacagaagttgcacttaactgaaatcagaaaaaaatagaagttgcacttaactaaaatcagaaatgaaagtggtgacatttctatagaccttctaccacgaaaagatcataagagaatatttgaactattgtatgctaacaaattacaaaacatggatgaaattgacaattctctagaagcatacaaggtagcaaaactgactcatgaagaaacaaaatttgaacagatttatataacaagaaattatatcagtaattaaacacttcccaacaaagaaaagcctaagaccagatggttttactggtgaatctactcaacatttaagcaattaacagcaatccttctcaaacttttccaaaaaatggaagagggaacatgttctaactcattctatgtggccagcttatcctgataccaaagccagacaaagacatcactagaaataagaaaattatggaccaaaatcccttatgattatagatgaagaaatcctcaagaaatactagcaaactcaatttaatagcatattaaaaggattatacattataactaaatgggatttatcacagaaatgccagagtcattcaataagataacagcaatcaatgtaatacaccatattaatagaacaaaggaaaaaataattatcttaaccagtgcagaaaaagaatttgacacaatccaaaacctttcatgagaaaaatactcaaaaactagaaatgggagaaactttctcaacatgttaaaggacatttatgaaaacctgatgattaataccatggtcaatggtgaaagactgaaacctttctctttaaaattaagaacaagacaaggatgtttgctttcaatattgctgttcaacattgtactaaaagttccagacagaggatgtaggcaagaaaaaataaggagcattaaaattggaaaggaagaagtaaaactatttctaatggcagataacatgattctctatattaaaaattccaaaaatccacaaaaagagaaaactgctagtgttagtaaacaaagtcagcaaagttgcagggcacaacatcaatacacacaaatcagttgcttctatataccagtaattaacaaactgaaaagaaaattaagaatatacttttctttagaataagagcaaaggaataatatatgcaggaataaatttaaataataaatgaattgtacacttaaaacaataaaacattgctgaaagtaattcaagaagctataaataaatggaaggcatctaatgcttatgaattagaagacttaaaattgttaagatggcaaaaatacccaatgctatgtatagattctatgaaatccctctcacaattccaattgtccttttttgcagaaatgagaaagtcacctactagaatagcattaatccaaaatctgaaaatagcaagtgttggtgaagatgtggagaaactggaacctttatgcaatgctaatgggaatgtaaaatggtacagcctccgtaggaaacagtttggcagttccttaaaaggctaaatatagaattacatcatcccctagaattttcacttctaggtaaataccccaaagagtgaacaacaggaactcaatcaatacatgtgcattgaagcactacgcacaatagccaaactgtggaaatgcatgaatggagaaattaattgtggtatacaatggaatattttttagccataaaaaggaatgaaatactgaacatgctatactgtgggtgaacctcaaaaaagttatgctaagtgaatgaagccagacacaataggtcccatattgtataatctcaattatatgaaatatctagaattggtaaatccatagttatagaaattagttttttcattgccagggggctgtaatcccagcactttgggagaccgaggtgggcggatcacctcaggtcaggagttcgagaccagcctggccaacatggtgaaaccccatctctactaaaaataaattgctgagcgtggtgactcatgcctgtaatcccagctaatcaggaagctgaggcaggagaatcgcttgaacccaagaggtggaggttgcggtgagccaagattttgccactgcactccagcctggcaacagggcaagactccatctcaaaaaaaacaaaacaaaacaaaaaacattgtcaggggtttagaggagggggaaatagctaatgaaattattacttattgagtaaggaattccctttggggtgacaaaaatgttttggaactagatagatgttcacatagttgcacacattttgagtatactaaacgccattgaatccttcactcaaaatggttaattcatgttcttgaatttatctgaattgatacaaaagtaaacacaatacatgtcttctttacttcagcttctgtttaccagactacttggtgagaggaaatagattcttagagtctgacagacctgggttcaaattcctcattcattcattttatccatttgataagttaagatataaatatcaccacaacaaattgttgtagggattaaataagataaacaggtgcattaatgaagggtaagtaatactagcttcaattgctagtgtttctttctaatgcagcagtccattgtgggtattcctgagtagggaaacattatctatggtcatcaggcacttactccttaggtccctgtagtattcttctatcaaccagcaagcagagaaagacatggtagatctcttatggaaagttgttatgagatggtactggataatggaatacatcacttcttttcaaactccactgatggtaactcagtgtcattgccctgcctagccacagcagaggctgagacatgtagactgtgtttcaggaagaagaaaaagatttgggtgaggaaaaaaacaactcttgaggtatcgtacttgtatgaagcttcttgttcagtttgtgataagcacttaataaatatgaactctcttctttgtgggtaagtgagaatccctggcagcttctgcaaagttgtttcaaaatgcatgccatcctgatgacaggccactcgttgtggccttatggcaaagtcagttgatagggctgccaggcagacagtgagcagaattctttctggactctgttcctgcttgttctttttttcttttgtgttttggaacttcccttgactttggtcccatttagtttcccaatgtctaacttgcatttacccttctttcacagcttgctcacctttagcttctatctgactaggtctttgtgttttcattttgccctctcaacaaactatttctagtccttagctcagtagcttcactgagcaggcccataaactcccttttgccatttccacttcccagtcatatcttgaagacttccaacttaaacacattaatttatgcttgggatgattgttaaaatttctctattcctacatcttgtaattagcttagctgatttttaaaacaaatcctctaagaattatttttatgaaggccatctggtaaaacaaattaatctccaaggaatgttaatcagactaattgctaattaggtgtcctccttgattctattagttatagattggaaagtgtttgtcatatacattaatttttgcaaagatagtgagaaaacattattttttgccctgcaagagaacaagtgaatccatttgcatgtataatgtatgtgtgtggtgatattaaaagatatccattttttgttgttgttgtttttttgagacagagtctcactctgttgcccaggctggagtgcagttgcatgatctcgactcactgcaacctctgcctcctgggttcaagtaattctcctacctcagcctcccaagtatctgggactacaggcacatgccaccatgcccagctaattattgtatttttagtagagacaggtattcaccatgttggccaggatggtctcaatctcttgaccttgtgatctgcccgcctcggcctcccaaagtgctgggattacaggcatgagccactgcacccggccactacacacagtctttaaacttaaggggttgaaatttattctaattgttagtgtctcagcttcattattcctcaaatggttttgtggttcatggagcttcagaaatatgtttttaaacatacaaaaaaaatgccagtggattcaactcaatgaaagatggcaaatgagtttaattttatataccaatggtctgataggaattaccttgagtatattgtagagaatgcctgggtgggacggggatatttaccatgcactcactatgctcctctgtaatggactgagtagtgattcacaaaaatggagccacaaataataaaaaatcatttgtgctgaccctgaaaatgtgagcctcaaaataagacaaaattaatcagaaccagacaaactttaagggaaaccctagttctttattgaaatgtctttgtgccaaggtagttaagtgaaagaatggatgaaaaccaaaattcgtactctcccccgctcaactatttagcctgaggtaattattcacttatggaaaggagtgagtatttttggtcaaagtaatttaggttttatgaatgatttcttcctgtggttttatacatatttgtagagagtatgaatgacattctccctgaatttgtcttctatttagtggtggattggtttcacagttgtatgagacttcagggatcttcctttttcctcttttgttgtgaattctctttttataatagaagcatgaaaaaagtctgcctattagaaatgtgaccttggaatccatgaatccatgaatccatatttggaatccatatttataagaaatgaaatgtggtatcaaggaaggaattttgtctggaaagtcagatctgaattctggtcctgcctctctgtcagtgagccctgtggttgtggctaagttgttccatggtctctaatgacctcaactatgaaataagagcttggggttcagtttttaggtagaataatgctgtatgttgatgttgacattctgccattctgcagtgatatattgcttaatttgcctttgccagttattgagcacgagggggcagtaattggcagattgccccctttatttcttcttgacaaacagccaaattttttggcagctgggaattgttattcttcaccatcctgccatcactgacagatgcatttgacaggaccattggcttgcaatgccattccactcttacaagtaaagtctataatgcttaaagaaaaataaaaacatatgatattcaacttttacaaaagagtacatataatattctttatctgtcaatgtaaaaatggtcagaaacttttcagatatatttgattttcctttccatgaaggcttcatttttgtaaggatttttaaaaattaatagagaaaaaaaccccataaggactctcaaaccagtggtctaaaatggaattaattttgtccccatcaattgctatttctttgcaaatatttcttatcttggtgaatgatgaaccatttagcctctgacccaagccataaacctgttagttgtcccccttagcttttcttttcccacacccctccatcatcttgcattctgtctaattgattcagtaaatctggttgattctacttcttgtgtatttttattatttttcctttcttctccactggaaacttttatgactctagtttatactctcatctaggtcactgcctatgtccctaagttgtatccccagtgtctaatgccatcacactccctcctttaccctcaccccaggctacacttgaacaggtagagcagggaatgccatgtagacctcatgtagccaagttggaggccctttccagttcatccccttgactttattttaaataatacatgaataggattgcagaacttttttttttgttttctgtgatgctcatgcttgtgcttcttctgttcaatgtgacaaggaacaagatctctacaatgaattgtaccaatgctccaggaaatacttgccccatttttttttaattttagtttggtttaattcctctaaagtaacatcaagcaatgtgctataaaacagaaatatgtcttgagagatagttattctctctttctctctctcaatttaaaaagggttcaattttttactgcttcaggcaagtacaattttcacatactctgacatctcatgaaacctatagccaaagatttaggtataacctgaattcttccccttcagctcagtctttgattgtatacatgctcatccctatcctcaagaagaagtttacatcttatctcctctctgaaacccgtatacaacaccccaattcagtaattttgctggggactcctaatgctcttcttgtttatatatatcagcagctaacgcctgttttgtatgagctttctctatatgtatcatgatttgccaaaaacattgtcaactctttgatggcatagaccctgcaattaagccctcagattcccttgtttaactgatggcccagatagcaaatgcttgaaattgaagtaacgttctccttagcctctaacctgtgtcatcacattagctgaccttaatcagggcattaaaaacacctaaatagagactggtggccttcgaaggaggtcttttttgtccttagaatttttaaataaatcccactgtcaaagtcatcaaccacaagggaagtagaaaaggtggtgttggtctttagcacaattaaagaacctattagctaaatccctggcaggccaaatatgaaggcaatataggtaagtcttattacactctgaaaatcaggattaaatatttacaagtttgcataacttgacctttcttgcaaagagtattaaaactgtttttaaagaattccttctgctcctatgtaaaagggcattcataaggcctccttccacaggtggacaaagtgttcatctttggacttactgataaaaattttggctcttctgaggtagtagcagagacagggtagtcagggtagacagggtagaatgctaactgtatcctcaccacctgacaatagaagtttaaagatgtaaaagtatgataacatacaatctttcaccccattggtccttgttgtcaatagctctggatagctaggaatgtatttacttccttcttttgccagggttcattatttgtaccttgcaaatctgaacatttggccaaagtctatgaccttttgaggtacaaggaaatggatttttagttaagaatatttacaaaattaaaattacaaaaccttgtcccagctaaagcttgaaacacatctgtgtttgttcacagcttgtaacatttgaggctccccatcatgttaaatccttcctttttattttaaagtttgccttctcatatgccattgttctcctttatatttgagatgatggtctaggttttcagacagctctgggaaggcaggtgttaaattttaagctagtgcttggtaacctccatggtgaaatatgccactgtttaacagatgactactgtgctgtggacagcagtgccccaggagagaggaggtgtttgttccagaatctaatcaagctatggcctgtctgcatcctaacttatgcagtgtaatcacttgtatcattcgtggcatgtcttccattaatcagagctagtgcaggtaccaagggaacaggggttccattagcatgacatatggtggccttcccaaagttttggatgttttggaagatggttgcagggtttgtaccagtcatacaagagctgcttaatgacttagatattagtaaactttttcccaggcatttaatatcttccccgtttcctcttagtaatcgtagttaggttcttgatgtcccctgtgacatttttatatccatcaccttcaggtccaaactgtttgatttgctgcttcatcttggactcctcatatgtgcttctagagaacaagtatataaaaaagaaagtatgttttcttaattgcaaaagtgatgaatgaggtaggcaatcaggactgtttttcatattttcagagatgctgaaaatacatttagatttgttttcagaacaaaatgagaaaattgttttggaaaaaatgttataagtttggttactttggaaatgtcttcataaatactcatcttgataatataatttatctttgctagtctcatataacaatattgttgcctttaaaatggaaatttgtaagaagtttaaaattccagctttacatacagccccctttaaacctccccaggcattcatagatatgttaaaatatatctaaaataatactaaagcattacatttttttaccttattggataagctaatataaaagatgttttatccatttcacataattttaaattttaaaaatatgaagaccttatgttatttaaaatttattaacaatttatacactcccttctcctgacaagtccccatatattcttaaagataaattccctataaccattttttaaagtaaatggtatatgcttctatctgtcttggctatcacgcatctatcttggaagaaaattgttgggttccaggactgaatattgtactcacatttggataagacaaggatggggctctaagaaaaaaagcaagagagagttgtgtgcatcacaaagatgatgcctctcccgtgtccccatctccaagaccaagcatatacagaaatagccacaggtggctagagaaggaagaccagaagacatccaggagcatatggcaaggcaggaactattccacattgcagggtgagggaagagttaaactggtggagagcaaatcagaaatgcggtgaattcccaaaatattgggacaacaacaacatgactttggctattgtaggggatgaaaataccttttccacactcatcttaggttcatggctgaagcccctacaacaaaatacagattaataagagaaatgtgtatgaatttatttaatatacattttacgtaatacagaagccttcataaggaaatgaagacctgaagaaatcataaatgtttgtatttttttgctaggtttgacaaagagtggacactcacgggcatgtatgattggaggaaaaaatgttttaatctaataataacaaactgggagaaacttagaaaggcctatttgttcagattactttctgtgtccttgtgtcttctgagataagaatattccctttttctgggtacagggattgcacctctcacatgatggtcacgtgacttcacaaaggcgaggagaaggtgagagtgatccccttatttgtccattctcatgctgctaataaagacatatctgccactggataatttctaaaggaaagagatttaactgatttacagtttggcatgactggaatcctcaggaaacttaaaatcatggcagaaggggaagcaaacacgtccttcttcatatggtggcagcaaggagaagtgccaagcaaaagggggaaaagccccttataaaaccctcagatctcacgagaactcactcactatcatgagaacagcatgggggtaactgcccccatgattaaattacctcccacaacacatgggggttatgggaactacaattcaagatgaaatttgggtggggacatagccaaactatatcactgccccctacttctgctgttttctcatacaccagcatgccatattttggggtagtgtgtcctgaaccccatcactatcatgtgatggatgattgggttatatattctatccagcccttactctcaacctgagatagctaaagttcattaaaatagatttttgcttctactatgtatcagggactggtctaggtacttgacacatatcagttaatgaaacagaattatcactatccttgtggagtttacagaaaataagcagtaaacttaacaaataactaaattatatagtatgttaaaattgataagtagaatatatatttttataaaatgaagatgagaaggatcagaagggtcaaataattggggccaaggtccaaggtggggatgtcactgcacagtatttaatggggtggttggttaggacaggcctcattaggaaggtaatagttagataaatttttgagagcagttagggaatttgacaagcagatacctgtggcaagagcattccaggaagtcagaacagtaataacaaagactcaggaaggaggccagtctggctggacactgtggccagagggagagaggaggggatgagtgccgaggtgcaataccacatctgatcatgtaagtccatgcaatgaccttgacttttactctgagtgaaacaaagcagttttagcattttcagcagaggagaaaaacactctgatttatgttttcaaatgaatccttctggcagttaaatgagaatagacatagagagatttttgacatcattgctacttgtctggagttctcattaagacacagacctagaattgtccccataaatatttaaatcagagtcaccaaacatgacctggtgtcaaaccacaacctggacagaaattaattgcattgcacagctaaacctggggtctccctgctggccatatcagtggacttgccctgatcattttcttaatcttacattaacacaccacattatatgcaattgaattccttagatgccacttattattttatggcagttttactgaatgtatcgaaacccttaaagatgttctttttctttgacataacaattacactcttagaaatttccttaaagaaaattatctaaaattcagaaaagaatgccaaaagatatttaccaaagtataatagtatataatagtgtgcgtatatatgtatatataaaatagtgataaattagaaatgatctaaatatacagcgatgaagaaatggttaaaatactatggtgtatttataaggtaaaacactatacaccattgaaaacaatgttaattattggaaaattcttatgaaataatgcaaataaaagtaggaaacaaaacatacagaaaaaatctaaaaggaaatgcagcagatgttagcagagtctattcgattgtgtaaaatattcttctttatgttcctctgtatttacccttcttccatccaccattttcaaattattttatgaagttttctccagaagataccataatgaaaaagcttagagacaatcccaaggtcaagttcagagtgtatgatagaggccctttggacttgttcagggtgagagtggtgtatctgtaggtgatttagggtgacgtttggaatctggagatctcagtctacatgaatacattgctcatctggcacttgggtaggttatactttcccaggtagttcagctttaaagaaatgatcatatcctttaaaaacaataccagtcaggtgcagtggctcatgtctgtaatcccagcacttaggaaggcagaggtgagaggactgtttgaacccaggagctcaggaccagcctgggcaacatagcaagaccccattcttcacacagaaaaaataaagtacataaaaataaaagtaatatcaaaaaatgaaaatacaatattttaaaacaaaatcttgaagtgaattcacaaatttttcagatgtgtgtttaaatacacatctttctccttgagagtctagcttctatgctagtggttctcaaagggggcttaaacttgttagtaatgcagataattttaggattctatccccgacctactgaaacagaaacgctgatggcaatctattggtggggctcaggcgtgctaccccaaaatgctgcacctttggcatttgagaaaacagcagacacagaggagggtcactcttactttttcctctcccttgtaaaatcataagacccttatttgagaggtgccttcgctatacccagaagaaacatccttatctctgaagacaccgggacatagaagaatctgagcaaacaggccttgctaagtttccccgagtttatcacctcctttgtccagtcatacttctccgggactgtccactcttcaaacctaagcataaaagtacacaagctaatctgtttctttgggtcttcattttctcatgaagtctcctatgtcatgtaaaacttatattaaataaatctgcatttatttaatatcttctttgtatggagcctccaccatgaaccgagcaatgggccaggaaaagacatcttttcctcccctacaacgtgttttaacaagccctccatgtgattgtcaggcagggctctaaatttggcaagcactgcttggtgttgagtattcagaagtgacagactttggtagactccaggctcagcaggcagccctgccttcagagcatccgtccatgaaaacggatggaaaatgcagaagggcctctccctatcagaaggagaactgagccccaatcaaggtgtagattagtggttgggcatgtagaggagggctgatggaagattataagcagaccatttccagagcaacaaaaaatgtaggactgcttcctatttcaagttctatttctagtaacccaaactgatgttagatgatcacagcaagaaaaaaaaatgtgccaaagctaattcaggaaactgccacctgtttggggtggggtagtcaatatcacaggtagaatggaagacttcctttgcacttctgactaatggattaaagtgacaaaattcaaactgggctgttaagtcattctctataatattgtggaatcgctaggttttataagctcagaaggcatctcaagtttagaatccaagagtaaaattctgttctcagcaagcttcttactgccctgaagtaatttctcagatgggcccacgtgtcttctgcccctggctatctcttacttgtggcttgcataaaagcctctacgtgcactgctgtcgttatttttttctttgaaaacggaggcaaaaatacttcagctttgatgccttatgaaaagagaaaatcgtgacatcttcttaatatgaaaaactagacaaggttgttaatatttaattgtctaagccagatgcagtaacacatgcgaatgtgttcataagtttggaacaggggatgcatttgatttactcttctacaactttccaagtgtattttcattattttacagaagctcatataaataactgataaaatcgacttgttaaaaaattaattggatttgtaatataaagaattctttttacccatagtaatatttgttcgttatagattttatctttaatttttaaacttctgttattttgaacctggtgaggtctacttggttgaactattaatgaaccacatgccaactaaagttgatgtgattctttcataaatcagtatatgcatttataatgcacatcaattttttttctagaagatactatgtgtgaaaatgtattaatttaaaagaattagttaacttcaaagagatgccttggaaattttatcttaaaaattaaaaaagaaaagaaaataaataactgagcttcagacaatttatgctcagtcctcagaacataagctctaaaccatataaaactttatttggtcagttgctcaaaatagtatcaaatgggaccatcttcccaaccagactttcttctcttctcttgcaaaacttctcttctcatgtcattttcaagaacttgctttatgaataccttttcttgtactttctgagagtatcagattgcaaatacatatccatacatgtatgcatatatgcaaacatacacacacatgcacacacacataaaacttctctagggtaattttcagatggcaaaacaaagcaactcttcctctgctcttcactctatacataattttttaaaatgtgttattcctgcaatagtagttaaaaagaaaatagtatatatcgacctgaaagtgtatctccccagctcacagaggggtcttatttcactatgataaaaacaaaattaaggttatagttaataggtgaaagcaaagatcttaatcaggatgagttcaaaatgctaaagaaatgggtattgtgtaggaaatgggaaaagtttgaactgatagtgtgggctctccagtgctgttgacatgggcatatcatttttgtccaggttaaaagaatatttaaatattcttttaatgcaaaatgcaaaaaatgcatttgctgctaaagtaatgtattatttaacatagctgaataaatccagttcaatcatttgagaagtgcacataataaaataatgcttcagcctaatcaatctaaggcttttatttactctagatctatacttcatacgcttaggaggaaggttttttgctctaaaaattaggcgcaagtaaaatttttcctaaagtatgaaatagggatctaaatttgggcctcacaggccagcattacaattataatatatgtgatgaattaatgtgattaatttataattgatttagataaaaacaagctttaaatatgggattcctaatacaaatgtacagtattcacattttactaaggaaagaggctgttcttacagcccctttgaaagaggccgttcctacagcccctttgaaagaggcctttcatgagacgatatatgacgtgaatattgttattatttattttggtcttcttacgtcagcatttcagctatcctttatagttgctttgatatatgtttcttctatcagtttgtgtaaagaagccatccctccatgacctttgtatgaatatgagtgtccttttctgttggggatagaagctgagaccacagatttctttgcacagcaactcagatcactagtccatgaagttagaatggaggagaaattactggcaggaaactcagaagtctgcctttagcaaggaggaagaggaagctcagcttctccctcttggcaccatttctgttagtctgagacctgtaatgtgtggttagaggtggtaaaacccaatgggtagatgctctttaggcttgagtaatatagaactcttgaataattggaagaaatgaaagtagagttctttcaagtaggaacacaaagctatttacctagagcaatggttcccagagtgcagtcctcagatcggcatcttctacatcaacctgatcttcttagaagtgcaaaattttcagccccactccaagcccagtgcatgagaaactccaggtatgggacccagcaatttgttttggtaaactctccaggtgattctgatgcatacttatatttgaaaatcatattctttagagggtcagtagcctcttttctgctgcctctttcagctaaagagcattcagcctcttaagctcagtttcatttcctttctcctcgaaagcgaattgtttccttgacaggtaggtagtttagatttttgaaatgcagaattgagagaaaggggaagagaattggatcagaactgagagagaaattttctcaagagcttggagaagatcagcgctggaagaagagtttcaggtaggggaaaatagacatgtagccatcgagtctgaagtcatctggggtttgaatcttggttctgccacttagatgatgcagggctttggtccacttatggggcttctctaggactcagtttcctcatatgtacaatggagataaaacaacagtaatttcctcaaaggcgtgttaggaggttcaattagttaatgtattatatggagtatgacacgatgttcaatatccattaggtatcattgctggatgaagtatattctattaattgtgttcagaaaaaagggagcaacgaatcacagtgatttgaactttactttttgattgctggactggttactttgcttaaaaaaatgctttctgagaacagaccacatgggtcacagcttcaagaaaatttcaaaaggaatatatttttccaagtagagcaatgttaaaagacattcagaatccaagacaaataaaatgctctgttattacaaagctattgtaggtcctcagttatcattctctctgctccaactctttgaaaagctcttcccaaaacagagggacacaagttctttgtcccctgttccctcatgagcaaactgaaggcttctttgcctcctagtatatgggtcttttatttctaaaactgacttcttaaagatgtcaactagctttcttgtgtgcaggtcttaaaacatgattccttcagcactggattgaatatccagtgaagatttctgtaataactttctaagttctttttttcctctatcatagagttccattggccaataagaagagcattttgactcaccaacatagatttttatttttgacctcttcactctattaatggcaaatagtaaaagattacatagtgtggtggaaacagcaagatatttggagccagacaaggtagttctgactcaacctctaattagctttttgacttaggaaagtcatttatcttcttggatcaattttctcacttagttcagctttcaactaggacaatagaaccttacagggatgaagagacaatcaagtgggggaaaaatgattttttttaaaaaaaaactgcaaagtgccattcaaatgttagctattgagagttaatgataattaacattcactgagtgtggatgaagagctgggcaccatggaaagtctcatatatacatatctatatttatttacaaatagatataagattattgcaatgtatattatgttcaatttgttaaatttacacagctagtaaataaaacttagaaaatgtaattttcttagctcatgtttaaacatttaaacctcgattagaaacatgatcagctttggtctgaaaataagagaaaactctgacacaatctgatgaaaccaataaggatacttgctatcgctcataacgtgaagttcagagagacagtggacgccagagtgtctttaaccatattcttatagttaccatcttttatgacaatcatcacagtaggctgtgttagaaatttctaaagctgggaaaggcttcagcagtcagagtctagactgttttcttacagcagggaaaatcaagattggagtttcaaggagctaactcatgatagcaccaggggatggtcccttcatccaatccctgattggaaaacaaccctaggccatgacagtggcagggacttagtttgcttagtgacttgctctttataatttctagataaatctgcattttgcttcactcttctctcatcagagaggttgagttcttcaaacacttttgttgttatttctcaattcaaagagcaacataagaaagacatgctcttactaggtcattccaaggtttttttttccatctattatatgtaatcagatttgtatctctgttgtagaaagtcttatttttctttatgtctgttaaaataccagtaggttctctattctgctaatgtaatatttcttttttttgctgttcctttgagctggggcacattttattgttttgtgttaattctgtgattttaagtctgtatatcaaaattgtagtcctactaggcatgtaaatattataataaatacattagtaatgcagacagcctacaaaatagtttgctagtttgctctaaagatatttctggctgtgataatgattaatttcagataccctgcatcataattttcttgaaatatgtaaattacttccctctcaaaatttcttatgtagaaacacacacacgcacagacacacatacacacacatatttagcaggtcgaaatgaggttcttgaatctgcacaaaagttgttgatgccaagcccaaacagtacaattgtgagtgcagctggtcaggtcttcaataccgttcccttctcctcaccattcttcatgcccaaggggtctatttgcatttcctagaacatgccttgcgctttctagccttcagaccttttctcccagtttgtccttcacttaggatgtcttcttttagtatctccaactaaatgaaccccaccctttcaccaatagggttgaaaatacattttctcaatatctcagacaatcccaggccagacaaaaccccaagggccagttatcttttgcatttcttgagcactggttgagcatcgtgttagtaaaattaaatgttaatctcaaacacagagtttgagaggaaggcattcctgttttgcaagtcattgtaatttcccccgcaggtagcactgtgcttttagatgaagctcagtaggtggaggcttaataaactgttttttggattgatggtatgattagaagtaagaagacaattttggcttaactaagagaaaattacaaactagaattaattgtgtgttttaaccaaaaaaaaaaaagaaaaaaaaaggtgtggaattgatcttttgtttactgtaaacatgttttccttttaaaacctttcacagagactgagtaattttgtgctatctctttgacccatcttttgcctgcaccctctcatctctttctgcatcaccctcatgaggggccaagctttctttttaggttgctctcttccttttcaatgtgtttatgtatttttcttcttagaagttttgggaagaattcagttacatttcaaaagtcttgctcttcagaattaaacctttagccctgtgccttttgattggctctaaaagtgcgtgtgtggcctgcggggacagttgtcagcgtggcatctttcttccagtgtgcccctctcctgcccttaagcattccatttttccttttaaccgtaacactgttgctttaagttgattttcaacaggtcttttgactttgatgatttcccaagatattgcatgtgtgaggtgaggagggtgtatgcggacttgttctttcctgggttagtgactagcctgagagagtttaaggagctaaacacaactatttccttgagtatgagaattatgattgaatatagctctatttttctccacccttgtctttgacatagtcttctcactttctgcatctttctgaaacatctataatagttttgaccctgaactttattctcttaaccagtcctatcaatattgtaccgttttgaagttaggaggtcataaagccattaactaatttggaagattcatcaatggctttgaagagctttacaaaatatgctgagtattctcaaaaatcaaatcagatcaagttagaattttaagaatttattgggcatataaagaacagtttgtgttttgttttgtttgttcggttggttttgattttttttcctggagaaaggttagtggctcccagagagtctagggcaaaaggctagtagggcctgatctaggaaagacttcttgacatttacttgagaggggcatgcaaaggtaaatcaaaccatttttttacacagttttagggctacttagtttttcttttaagattttctttaaacgtctgcataaaggttttatttatgttttaattgactaataaaaattacatatatttgttgtttacaatatgatgtcttgaaatatctttacattgtagaatgggttaatcaagctaaggaatgcatacattaccacacatacttatttattatggtgagaacacttaaaatttactctcaactttcaagaatacaacatattgttagtaactatagtcaccatgttgtaatgtacaataggtcaaaaaaaaagagaacagttcatgaattgggagactttgacatggaaacatgacatgagtctcaatattacaacaattacagtacagcttgtagaacatatagaaggaaggattttgatcttttttcatgattggttatatcatttttgaaggccattagggctgtttaagctcatttctctgtagctgtattggtttagttacactgaatcatgttagtaaaggactaaaagcttacgtttgtgttttgtttacatttcacgttagcctttcagggaaatcaggatgatataagttttggttacttgactataggcagttggccttggggtaggtaaatggtggccttcatttttatttatttatttattaacagtaccctctctttttcaggtgagctaaactatttatccaagcaatgcttatttctccctatctgcctctctcttctcttctcctcgctaaacacagacacaaaccccaattagactgtaatattacggtatagttttgattctacccatcgtgacttatgagacattgcttaaatacacgctcttattttttattcatccaaatctcctcatccagcttttcacccatgtttttcttcatatgctgatgaattcctttcccagagaatctagccaattcttttgaggctggctgctagctccctccccaaggcctccacttcaaagtgccctgctgccatagcggaaccaccaacaatctttttcaaaacaacctggatttttttttttctccttaggtctgggtatcaatcagacacagaggagctgatgagaactggtaacctaaaacaggatgctaagaagcatcactgacatttatctgggccttaatgtgtggcaggaatttttctaaggacttttccttatgtgatttcatttaatcatctgaataactccataaagtattattattattatcctcatttttcagatgaagaaacaggcctaggggggtaagttacttgcctaacgtcttttagtacaagatggggcttggattatgaacacagaggatcagcctccagaatttcagttcttaagcactctgccaaatggtgcattatacaagtaggtacacacccctattttcaaaccttgactggaaacacaagcattatggttcattttaaaatacaatgttaacttttcagtttataagcatgatgttcacaatttagatgatacactttggaatggtacactctgtatatttgggacatttcatttggcagccactgaagcttgttaatatcaacaactggcttcattggctccttcaaataaacccgtttaatctattatagctggcctctagcaaatatgccataagtagaaataaattttgagttaaagaatattcaccgtgattagaagctcaaaagaagtattttaaatgtgtgtgtctgtatttgggtatgtataaatagataggtagatagacagatgggtacatgatagatacctttgaaaacctttttcagttatgaaagcatttagtatatagtgttaatagaattttatctatcataggttaggtgtattctgatgttcagtttatgtttttaaaataatttggcagaaataaaagtattgacaggtggattgccactttggcaattttcactctaagacatcaatcgacaaagcaccaaacagcaaaacatattactcattgactggtaagtcataagccccagaggctgttgatcatcctggatgctggatgcttgcctactgtaggacagatggaagaactggctgctaaatcgtttctagcacttgacgcccagcatgattggggatcctgagcactgctggaaaaatatttctctagtaacttatcttgtgcttatcagtgaatttgcaagcccaagagagatctgttttgttgagatggcttctgaacaagtcaaactcatgtttccaagccaatttctaatactacacttgttattggatattacttgaaccagtttctgtttatggaacacttagaaaatttaattggaaatattcattttgtgattcaaagattatttattgtacttttgctggaaaggctgaaggtaaaagtatggctacatatcatttggcctgattttatgattcaaaaccaaaaaaagaatatgtcctgtaatatcttttccattgcaatgtagttttaataatgctgcagtgagtggattattgaccaacatttcctagtcctggagccacagagagaaataagtcatgtaggaaagccagcatggcctcactggctcccattatcttgattagtaaggtaggattgagggttaggttttctttcttttatttttcaccaggccccaatatgtgctttttcgtcctttgtcaacttttctttttcttttttctttctttctttctttcttttttttttttttttttttttttttgagatggagtctggctctgtcacccaggctggagtgcagtggcatgatctcggctcactgcaacctctgcctcccaggttcaagcaattctctgcctcagcctcctgagtagctggcattacaggtgcccaccaccacgcctggctaatttttgtatttttagtagagatggggtttcaccatcttggccaggctggtcttgaactcctgacctcatgatccatccgcctcggactcccaaagtcctgagattacaggcgtggaccactgcgcccagctgtcaacttttctttttaactctcctttgaatagacctaacccacattgttgtgttgaattttgatgatcaacagtactctgctcgggcttcctggatccagagccctgcaagagataaagtagcaacaggtaattacttggtgaacaggagatattgaaattgaatcaaatgtcctagagctctttccgccagactaacctatccccagcttactatggaacacacatagactttggcttttagcacccttccgatgcagtgcctttcttccctgattgcactgtataaaagctacaaatcatgcttctctgtctacactccaccccgcaaacacacacttttttttttttgccctccatgcttactattctccttctgttcacatggtctttcttcaaaatacagttatttatttatatatggtaaattttttgtaaagatagggtctcattatgttgcccaggctggtctcaaactcctgggctcaagcaatcctcctgccttggcctcccaaaaagcataaaattattttgaatagagagttgggaatgaaaggaattcttggattttaagtttatagtatttgggcttcttctataaatagctgatcccatatattatggaaagagaggttacttgttttattctgtaatgatgcatagacgaacaccacaccggacccatttcacaaagcacgtcctgcaaaaaccctcacatccacactcattcatattttctttggtacataaaacggttagaaagtattgacaagtagttttcacattttgattatgtgatttgctctttgtaacttttttttattattgctcacaaaataattaaacacattcctattcatgcagacaccattatcaattcatgttagattaaataattttaaaattaattaacttattaacaaaataatattatagtatcttatgaattgcctagatatggcattgttttgataagccaaagactaccccatgataacatgtatttaggagcaaccaagagaagaatataggaagtctccagagaattctatatacttgggcttaactatggtcaaagtattgccctgaggccacttttaaagcacatttctgattcaaataatggttttgacatatgttaaggaaaatgttggcaacaaatctagagatgaattgaagacttattcactttacaaaaatatttcttcaacatgcaaaagcatacacctctggaagtctatatttcagctttccctagtattgactagtagattcttactgagaaaaaaaatgaaagaagtaaaagtagatacatttaaaattaaggcattaagactatgcatggtggctcatgcctgtaatcccagctattaaggaagccaaggagagagaatggcttgaggccaggagttcaagaccagcctagacaacatggcaacaacctgtctctacaaaaattttttaaaaaattagctaggtgcggtggtgtgcacttgtaatcttacctatttgggaagctgaggcaggagaataatttaagcctaggagtttgaggctgcagtgagctttgatcacaccactgtacttcagcctgggcaacaaagcgagaccctgcccctgaaaaaaacccagtaataggaaaaaaaatacaattaaggcatcaaaagtgattgatagtttaacatgcctttaacctaaaagtaaaaaatctattacattataatgtaaatcaatagaaacatgtcatataatttacaaaatgttggtgaacatacacccttttgagacacatgttttctgcagatcaacgcaagttgcacaggtataactactgacaaatggcctccagaagttagagcaggcattgttaatttagggctatatgggttccaagagtcccagccaatgtcagactaggatcggtcaactcctggagttacgacttggcttgtattttgacattttttgtgttcattagttggaggatttgggtggcagtaggaatggaatctctagggtcagcatccctgtagtaggaatttgagtctgaaggaatccttgaatggatatcagtggatctataaaaactttaaaatcacggacaaaaatgtatgggatggggacaagccaataatatggtttaaatatttctaatcttttattttctggtcagggaaggtcttttattagcttctgttagattacgaccaaggatactcgattgaattgcaaataccagaggactaaattactgtaatatagtaaaaatgtgacttaaaacattaaatggattaaggagaaagcaagaaaagagtgaaagtggggaggggagttttcggaggggtggaacttcattggtggtacgggaatatatgtgaccttattatggaaatattctctatcacacacccaccttgaatctgtgtgaagagcagagggcgctttgctttactattatcttttttgctgtgcgatttccaccgtatcacttaatatcttccagttgtttcttcatttgtgttccttgtgttttgctactgacctcccttggagggatgttgtaaggcataaatcattaatgattataaagtgctttggaaatagaaagtattgcttcagtgatagcccagatgcacctaggaattgcagcatgaacagtacaaagcaaaaggcatgttgtcagaattccttttggggctccggatcagccaggccttccgctcacatcagggtgaattagggccatgaatctgaaagtacatctgatactgcttggcttgtacgtgctcttgttacaacattattttgacattttttgtgttcatttgttggaggactttaaacccttttctaaccaaaggaaaccaaagtgcctactgcaagcatttttcaaagatggtgtcactctgattgaggataaaaaattgatctactaaataaaaatgttggaatggcatgtttatcttacttgtttggccagatataagtaaggcagtgattcagaagaaggcttcattagaatgcaccatttatctaatactttgacagtcagtgatatcttctctctccctctgctgtctctctttatgaaaccaaacactgacctgtctttagcctacaatatcagatacaagaaaacagagaccaatggaagtaaataatccatcaagttagtgttaaagataagactagaaactgggtgtttcatctcccagttcagtacttctatatatctgagtattctttgatcatttctaagaagataccaagcagctttaatcaaacattcatccttcctaaaaggacctgagatttttattcaaagattccagaataccagttattcataaagctgcctgtccatgcatttagagtgtgatagagatcaactgtaacatccgtcatgttactacactccaagattgatttctgtggtctacttggtttgatggaaagtcccttcttcccttacagtctacatatctcctttaaatatgacttttatagatcgaggtgaatacatgattaactacattttcctcctattcatttatctatgtatagaaaaatgtgagaaaggagcaggaatctaaataaactcctaaattttcagtcgttgaggtatgcacagttcaaaagagatacttgtagactaaattatccagatgatagtaaaaattccctattttacattccagatgcagatccagcctcagtgatgaatacctaaatataattcccagtccttttatttcttatctttctccccaaggaacaggctcttcctcctactttggaggctcttctctctaatcgttttactagttcatgctcttttctccttggtactgtccaatctatatactctgttagattagaccatcccaactgagaaagcacagtgggatggagaagggagaaggcatggttcatttttgtatggacagttctgagtgattggtagggccagaaaaagctcttctgtgctacaggcttagggacaaacaaacactatgattgttaaaagatgttaaatagagcaatcaggggtttgaccgctcaaatgtagctgcaaccaggaccaatttgatgtgagctctgaggcccagtttttttcgtatagaaacaattatttttttttatgttctcccagagaacatcagccttgaaaacctgtttgtgctaaccagactcacagaggactgatttctgaatgtgagtgccactttattcaactgtaatgccactaatctagttttgcagccaccatggccctgccttttcacactttcttggtgttaatggatccaagatgtagaattagtgactagaagataagtagccatagaaaaagaattggaacagttagtgagttattcaatctgacctgtaatagagcctagaaaattattcctattcctctctgattgcccccttatgtcttagttggtcaggctgctgtaacaaactaccatgaactgagtggcttatgaacaacagaaatgtattcatcacagttccagaggctggaagcctgagattagggtgctggcgtggttgaactctggtgagagctcttttctgagttgcagactgctctcttgtatcatcacaaagtggagaacagagggatggagagctttctctggggtctcttttataagaacattaattaatgagagctctatccttatggccttgtctaatcttgattaccgccgaaagggcccgccttctaatgccatcacgttaggggaagggtttcaacatatgaattttgggatgacatagttatttaggctgtaacaccttataattaactgaaccatgtgtgttcattcatttaatatgggtttactatacttctcttatgtgccaattactgtcctaggttcttgtatttatcagtgaacaaaatagacaatgatctctgattttaattgtctgtatccagcagcccatgctgtaagagtattagaatattagttccattagggataggaccagcataatggatattgggcacactcctgttagtttcatgaatgaatcaaggctggctcctactggccaaatctgtgccctttgacatttcatttccaggctgtatatcagtgctattcaatagattattcagtgataatggaaatagtctctgtgctgtccaatatggtagccactggaaatatgtggctttgagaactttaaatgtggctaacgcgactgaggaattacattttaaactttacttaactttaattaattgaaatgtaaattgaattagctacacagagctagtggccattgtactggaaggtgcagtcctggctgatccacagcgccccagtgtctctgtgagattagagactgctgcttttgaaaagttgctgctcagaagacagtgcaatggaccattctggttgtttaggcatccagaaaccagactgttcctatgtcaatgagtaggagcacttgcttataataaataggaagttgcatagccaagtagggagacctagattcctggagatgatgtcaataggtggccacttatgcagatgtttactacttaggagatcttcaagggctcctaatgggatttcagctgtttgggaggtctgaaaagatgccatacataatcagaggtcacgaggcctggcctaaggtaaaaattttttttttttttaaacaggccacagtgcagtggcataatcatagcttgctcactgcatcctcaaacttctgggctcaagcaatcctccagcctcagccacccaaagtgctgaaattataggcatgaaccaaaaggtagatatctttaaacactaggttgggttttgggagcagaattcctgttcctggaaagactgttaagaaggaggcaagaccctcatctttgagaaattgtgacggggtggattttgagccctgggaacccatgcaggcaacttcccagagactagaactgagggatcaggaaagaggaagatttccagataaaggaacttattctcaaaagtatacagtgaacagcagcgaagttcacatattgttgagtccagtgagctgaactaggctctttccattcttcgttcatagagctggctgggctgggacctgggaatcagattgttccatctgttgccagggaaggaatgtgtgtgccgggggaaggaggaggtcacaatgtgttctctttgtgtttttagcaatttggtgtttctccttaaggatatttagcagaaggacatcatttcttgaaaaacactgcaatataaaacatgttataaatcctatcaaggtagcttataccttcagaggttaataggttaattctctccgtttacgatgactgtcctaagctttagttccttgacaccaaccacggtgaagtccagcagagatggaaacctgtagtgtgctgagtcaggagattccaatgggagtatatttagtctgaaatctctggggctgaaaatttaacattcaaagcaagtaggcaaagctggcttgggtagctgagtgcatggtcaggtgctagagagaaaagcagagattcagtttaggagaaccctgagaagttcattccagttctttccttgctgccttcacaactttttattggaccagttctatgccaggtgactctgtactgagtcattgtaaagtctttcaaggctacaggtaatttggaacttgcagctctctacatacttcaaattatttctcaaaaatctttagacttaaatgagttctttttctcaatctaccatttatatagccttattgtccaagatctttaatgacccttggcttgagtaccttcacatagcaaaggattctgctggagtatatgagttccaaggtatttttttctgatgaaaaatatctatcttggtttttacttattagaaatggaaatgtaagcactttgtactcactatataggccactggataatcaccaggttggtgcaggtgtgagggtgagtgtcagaaccccagagaactggttatgttttgaggatccatattcaggaacatataaatttatattgggaaaatgtaaatcaaaccacttgtactgaatgcttgactacactttcccatggtacacatcatcatttccttttaagacatgatcactccacttaaaattgtaagccattccttcatgtagtggcattccctgcctctcttctctgttttctccaagttttaatcacttataatataatatgatataatgtaatacagtataatataaaattcacttctttttaaaaaattgtcttatcactctttattaaaatgcagtctccatgcagaaagggatttttgttttttccactagtacatcttctaacttcaactgcttctgacacatagtgggcacacaataattaagtgttgaatgaaagaatgaataagtgagtgaatgaattttttggctgataggaatatacaacatatagattccaagacatgaaccttgtagatggcaccctgtatgagaatttctcaggattttccttgcaagtatgtcaaagactacaacgtactcaccaaccccatttcgccttccttctgggcatccaaccacacaatctttccatctacctctacatttgatgacactatgtgatagtgttctggccaattacatgtggatgcaagtgatggttgccacatcctggcctgaccatgagaacctgactccatggtccaccatgcttctcctctcctattaggcttgaatgaagctgagacccagggcatacttacatctctgtgatgaaggtggccaagtgcacaagaaggaaggttctgagtccctgggaagaaccatccaaccaggagcgctgccccctgccttgacacacacaattgagttttagcattagcattgttgtaataatgcaagaggtaaacttgtactgtattaagcctctgaaatttgaggtttgatcttttctagcagcaattaatgtttccttaacctccagcatgaaattttcatgttgattaaaagaagaaatcaagttttggaaaaaacactgctaaagaatatgagtgtgtatattagtctgttctcatgctgctaataaagacgtactcaaaactgggtaatttataaaggaaagaggtttaattgactcacagttccacatggctggggaggcctcacaatcatggcggaaggcaaaggaggagcaaaatcacatcttacatggtgggaagcaagagagagcttgtgcagggaaactcccttttataaaaccataagatctcgtgagacttattcattatcacgagaacagcacaggaaagacctgcccccgtgtttcagttaccttccaccaggtaggtaattgaattcccactacatgtgggaattatgggagctacaattcaagataagatttgggcggggtcacagccaaacaatatcattgtgttaccgaaataatctcagtgccctggtcacagcccattgtgtcagtttaaggaaaaaaagaattaactttaaaatacagagaaaaaaacattctgctttttctaatcagttaactgacatgctttcatttttatttttttaatgggttaatttccttcacaggacagaagcattaggctctggagaattttagcatgcacccagataatttcttttttaacttggccttcatattgctttcagaaaccacccagtgcgttgtgttataggaatgttttaaactcatggaatgttcgtgtcaactctttcaaatcaagtgtgccctcaagagagaaccaaaaatcataatcttttttcagtgtatttgctagaaatgtatcctttttcattcatctgctggagttttttatatttctctttgatataagtagtgtaacctgtgggccatgtgttattacctaggtaagctggcacactgtttttgtggggacactaatcttttacagttttttctctcccattagtttgaaatttgtagttctagcaatatctttcttggaacacacattaaggaaaattatgggccaggcgtggtggctcacgcctgtaatcccaggactttgggaggccaaggtgggtggatcacgaggtcaggagtttgagaacaccctgaccaacatggtgaaaccccatctacactaaaaataaaaaaaattagctgggcatgggggcacactcctgtaatcccagctactcaggaggctaaggcaggagaatcgcttgaacctgggaggcggaggttgcagtgagctgagatcgcaccattgcactccatcctggatgacagagaaaaactcagtctcaaaaaaaaaaaaaacacaccacgaaaaattatggtgaaataatggatcttaattatggagaatggaagggtcacagtagagaaactttcgaagaatctgttttcttcccctggaggtttcttttggggggacctcatcttggctggagcgagatgttataaggcagtgtccattcccctgcagccactcccaccctcttccatcctgaagcagtgttctcattgctgatagatgaaagaaaactgggacctccttgtccataaacttgaagtgagtctaaacgtgtaagattttcagcctgggtttcaaaaatgcatgtgaagaaaagtctagtgaacctgactgtggttaacttggagatttaattacctgagagaagagagagagtgaatacctttggctgccagaggcttggtacgccttgcttttggcatttgttttttcgtcattatagctttggttgctagtcttcaataaggctgcagtgatcataatgataatgttgttcacaggcaccctgtaagacctcatttacataggctaatagggctggagaagctcaagcaaaaattaataatgattaactgtgtttttatttgactttcaattgtgattttcttttttaattgccgatgcacttccataaatagagtcaacttttagttctcacctgagtgtaggtaaatgggaggaagtggtgagtggaaggggaaagccaaattgatattaaatattcccataacctttaatcacaaatgcaaattcgtgtttactcagatagggaattgaaagttcttgatgtcatatgggatcacgtattaggatttgagcattatgcagagtaatttgaatttgtattcatcaaaatactgtgaactaaatatatttaattgtatattattccagaaaccttcattttaaatctgtaggtacctaaggacaacatgttaaaatattcttgcattatgataaaaaatggtattctaggaatttctaaatagttttcattgaagcaacttagacttattactgattcttgatatcacagaaaaattaatgtgtataatagttgagattattattctttacatttctcccttgaactaattaactggtaacttaatttttcttctcctatcctctccatacattgaattccagaaatttataataatagcaaaacaaaaacaaaaacaaaaaaacctcatctgtaacatgagtaccatctagaataatgaaagaaattttacctgtatgatttaagtatttgccttcttgtaaatattattatggaaagtgttaacagaaatgatttctgatgtctaagcaaggactggttttctactttttcaccttgtagggtgggggtgggggcagtggtacaggggaagatgttaataagttagggttaagcaactcttttacagttacactatgacacaagagggcacaacaacacccctaaatctctaaggctggttgttgccataggctggagagcagagaggaaaaataactagttttagagacagataaactggagtttgaattccattttggcatttgcaagctatatgattgtgtgaaaattagttaccctttataacctttattgtattcatttgtataatagaaaaaaatattttaccagattgatgtgaatattaaatgaatgagaatttccagttgtctacctctgtgtgttgttacatatcaattccatgagagtaacacaacctgactccacaggaaagaacagtggaaacctcctgtttgagatctcccaggctcctccctatgcatcacttcaatgggttgagtttgatcagtgtcctttccctctaaaaagtcatagctgtgaggatagtagctttcagtgagctccgtgagtcctactagcaaattatcaacctgaaggtgtttttggggacccctcttcccaaacatgcagttggtattagaagtgaggaccttcttggagaatgtgcccacaaacatggctatctggctaacttttagcacaaatgaaaaccaaggttcttcactgtaccctctactaggcatgccaaacatttttttaggccaattccacagacttttcttggagaaacttgccaaaggtttagaagggactaataatctcaaataacatgtggcttcagaaccctgatacatctggtacaaacaggtggaagacattttagtgcagtgaaaatggtctaatgtgatttggaatataggcacagagaaaaagagactctgttagttggtgttgggtgcttaaattaggagatcatctggccttgaagctgaagctcaaactgaggcagccataatggtccatgtgcagcagagtgtagaaacagagaacatgaagaagaaaagcaacttgaagggagaaacagaaccagaagccaaggcttggcaggatgagagcagtgcagaattgatcactttacaggacttgcaagacccattatttctccctgtgtttccttatcataattttcctctgtctcttccaaacaccctgtacctaagcataagtgtgagggttttctcatttcttgtaatcaagagagtgttaatgaagacattctgaatgaggcttatgtgatttaaaaattgctacaaaagagaatgtgttaatatttatattcaaattgctaaaacacgtatcaaaatatctatatatatattccaaagatatcagaaataatttagaatgggggattcttttttcttaagtgaaaaatttaacttcagaagtatttaaaagaatgtaagaaatgcatagtaatacagcaagaatatgccattttacatatttttaaataatacattgcattgaaatactggtaatatcctttgttaaagaggttgtggtaaaaacataactctcaggatacaaaatcaatgtgcaaaaatcacaagcattcttatacaccaataagagacaaacagagagccaaatcatgagtgaactcccagtcacagttgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctgagccagaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgacaaaaacaagaaatggcgaaaggattccctatttaataaatggtgctggcaaaactggctagccatatgtagaaagctgaaactggatcccttccttacaccttatacaaaaattaattccagatggattaaagacttaaatgttagacctaaaaccataaaaaccctggaagaaaacctaggcaataccattcaggacataggcatgggcaaggacttcttgtctaaaacaccaaaagcaatggcaacaaaagccaaaattgacaaatgggatctaattaaactaaagagcttctgcacagcaaaagaaactagcatcacagtgaacaggcaacctacaaaatgggagaaaatttttgcaatctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgacaaaatgctcatcatcactggccatcagagaaatgcaaatcaaaaccacaatgagatatcatctcacaccagttataatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgtggcactattcacaatagcaaagacttggaaccaacccaaatgtccatcaatgatagactggattaagaaaatgtggcacatatacaccatggaatactatgcagccataaaaaatgatgagttcatgtcctttgtagggacgtggatgaagctggaaaccatcattctcagcaaactatcgcaaggacaaaaaaccaaacaccacacgttctcactcttaggtgggaattgaacaatgagaacacatggacacaggaaggggaacatcacacaccggggcctgttgtggggtgggggtagcggggagggatagcattaggagatatacctaatgttaaatgatgagttaatgggtgcagtacaccaacatggcacatgtatacatatgtaacaaacctgcacattgtgcacatgtaccctaaaacttaaagtataataaacaaaatacactcattcagtattggagattgtaatatgacactattcttttggaaaacaatttgacaacatgttttaagctgtaaataaaattatatctatcggcccagtaatcccactcctaggaacttaaatgtaaattttaaaaaagaaaaagttttaggcataaagacatacaatttaaatacaaaaatatgaagctactttattctcagaagggactagaggaataagttactttcactgaaattgatggattattatgcagccattacatgagaattattaagattatgtagcaacaagaaaaattgcttatattcatgacacaaaatgaaaaataatggagaatataaagttgtatctgtaccatgatagaactacatagtaatatgtactagtactaatttatcaattgtgcactagttttgtactttaggtgcatgatttactcaagtttcacaaccacactaacaggtgacactaatattattccattttacaaatgagaaatttagacacagacagtttaagtgacctgaagtttcatagttgggactgatgttctgtttcaacccaactgatctaatgccaactggagtactataatacaattctgatgcattaacccactggagttgacatcagactccacaagttaaaggctcagtcatccgcaagactctctttaattcagatgccatttgtactttgccatctgtacttgagcctgggaaggccacttgcacttataaccaactggctataaatatcgaggttcccacaaccccctcatgtatgttaatttggtagatcaactcagataattgctacacctataattacagtttattataaaaaatacagatgagaaacagccaaatgaagagacatacaggataaggttgggtggagggaccaagagcttccatgccctctccttgtaaaatctgggtgcatcttcccagcacatcaatgcatacaccacctggaaagctccaatgaaccttagtgtccataatttttattgaggtttcattacatagacaagattgattaaataattggccacatgattaaactcaatctctagtccttgccccttcttggagattaggctggtccaaagtttcaactctttaatcatgtggttggccttcctggtgaccagtcccctgaaataatctagcagctcagcatgagtgactttatcattaataataacaaagacaatactatcacttacgaaattccaagggcttcaaaagtttcaagccaagaactggggacaaataccatttatattctctattataccacaagtccctttcaggaattaggaaaatttattttttattcttgtgcaagcattaggcccctataaaataattatgatctaataaacaaacaaacaaacaaaaacactgggttctaactctgttctaacctttccaagctctagttctagtaatttacaagcactggtgttctcaccttcctgggctcagacttttcttctgtaatgactccttaaatgatattaggtgttgcttcaacttcctatcttccatcactcttggttttttttttctttgagcatggcttacattataattggatttagcccagatatcaggagtcactgggttcaaaccttatcttcatcatttgtaacctttgtgatcttgagccagttacttaacctcttggtgcctcagttttctcatttgtaaaaatgtgagaataatagtgcttccttcacagtattgctgagagaataagatgtaattatgcaggtaaagactttatcacttattctggcataagtatagtaaggactcaataaatgttctcaaaagtaatttataatgtatcaaaattttataggattttaagtcaaatctctccagtataaaagttgaatatatcaagggtctatagaacttcattcttgataaaaataccaggcatattaacaatgacctataatttaaacaatagccaggtgtgatggctcatgtccgtaatcccaacactttgggaggctgaggtgggcagatcacttgaggtcaggagttttgagaccagcctgaccaatatggctaaactctgtctctactgaaagtacaaaaattagctgggcatgatggtgtacacctgtaatcccagctcctcaggaggctgaggcatgagaatcacttgaacctgggaggcagagattgtagtgagctgcgactgcaccactgcactccaacctgggccaaaaagcgagactatctcaaaaaaaatttttactgtaaatacatatatacaaaattttcagtaggaaaataatgataatttgtcctgtagccaaatactgttaattcaggttacctaagtttctgtgaagaagaacatgttatggatgtttttgctgtcatgaaagtattacaaactgaattcagaatataacaaacttacttttgtatataggtcagaaaaggataacttggaaaatcccttatatgaacctttatatgaatagaaagaagatctgagctagtgactatccaattagtctagatgcacatgtgtacctacttaatgaaaccatctcatcaaagagtaaaaaaaaaagtagatttgtcttagaacaattctagttttatcgttatccagccatgagactttgacttctgtaacaaacaagttagaaataacagctaacataaaatatgtgacttgtgactaagtgagaaagattatactatatgatgctatccttaaaattcaattatttctttttttctatttgcttgactgtatgctataaatacaattaaaagtttgtcttaaaattcaattttttaaaaataaccaagagaacaagaatatggtagctttaatagaaatttcatttaaagcattccttttgctttttgaaattttgacctaaaacaaccagtgttcctattgtggcaggtacacaatttttaaatttttcttcacttgtgtctatgagatattaacagtatttataatatagaaataatcatcataaatataatatgaccaatatccagataattaataataattcctacacacattacatgtttatccagtacatataaggtacactatctttgtacttttatttcttcttatccacgtttcttagaatgtaatacatacaacacttggataaacatagcagtaatcctaataagcctaaacacaatatttttctgatgttgagataagttgatctatcaaggtaaaaatgatgaccacattcttactgttcattcattctttttttttttttttttttttttttcaagacagagtcttgctgtgtcgcccaggctggagtgcagtggcgcgatctcagcttactgcaagctccgcctcccgggttcatgccattctcctgcctcagcctcccgattagctgggactacaggaacccaccaccacgcccggctaattttttttgtatttttagtagagacggggtttcaccgtgttagccaggatggtctctatctcctgaccgcgtgatccgcccgctttggcctcccaaagtgctgggattacaggggtgagccaccgcgcccggccctcagtcattttttcttgtgttcattcagctaattcaaaatgagtgctccaccttcatgattttggacaaagcagaatattagttctgtgagaagttactgagcatagagattaccagttggtaggagagataagtagtatatttacacggctctaatcaaagatagaatgcattaaaagatgtaagtacaaagtgttgtaggaatttgaacatgaaggagacttagggggcttaagtgattagtaaagatatctcaattattgaatgactgacaagggagtttttaagtgacattctagaataatcctaactgttcctggacaagtgttttatcaattttttttttaagtttttaacgttttataacattaatacttgatcaacaaataaatatattgtcaatctctccaaatttaatggccaataaggaaagaaaatgcttaacagttagttatcattttgttcatataattatatatattcttctgcaagagatgctaattacttaaaagttatcttagcttgggcttctaaaacaaaatactacagactgggtgacttaaacaacattcatttctcacagttctgagggctaagaagtccaagatcaagatgtcagcagatttagttcttggtactggcctgcagacggttgacttctccctgtgccctccagatggcgaagaagaagagctcttgttcctttttttttttacaagggcattaattccaacatgaatgtgccaccctcattatttaatctaaccctaattacctcccgaaggccccacctccagtactctcccactggggattagggcttcaagatatgaattttggggtgacacaaacatttagtccatagcaaaggttaaggatcatttattcctcttcaacgtgctattctcttagtatggatatgaaataattttatgttaggggcctacggaagtgaaagctttattagcaacagccaccgacctgatttttcacttagaaaaactatacagttggtcttagaatttaattaaattacatttataacttaatgtaatttaattcaatcttagagtctacacaaagaagaaactgctcatcttccatagtcgtttctttattatttacttgctgactcattcattccactgtacatgcattgatgacttgatcttatgaatcagaaccttcaactgaagaaactgcttactcagaatggtagataatttgggagattttttaatttttattttcttggccatctaggagaatcaattatattaaataatactctggcagccataaaattatctgtagctcccaaagtagtcagcttaaggattgtttaaaagaaatgcaatctaaatattttcttattgtgtatatatttatgtgttaatatatacacaataatttcttaatttattaatttataagaaattaataaattttattaatttctttcctgctctcaagacttggaagattttaggtcaagttatagttatccaaagactatataaatcatatatatgctttggtatatatctatcatctctttctctatatatgcacatgtaaaacttacatcccttgtcactaattaaaagagaatttaatttttttaactttctattttgaaataactataaattcacaggaagttgcaaaaatatgagaggttctatgtattcttcagccggtttccttgactgattcattttgcgtaactaggtttctttaccaaaactaggaaattgacattggtaaaatgtgtttacatagttccgtgtcctttgatcacatgggtagattcctgtaaccactactaaacagacacagaaccattacattaccaccagtacctacctcatgctacccattcatagtcaaactcactcccacccacaccatctctaacacctgacaatcacaaatctatctaccctctctataatttggccatttttagaatgttatatataaatggaatcataaagcatgtgattttttattttggcttttctccactcggtataatgacagagagatccatccaagatgttccacatatcagtagtttgtttcttttattgcagagtggtagtcaatagtatgggcatatcatagtatccttaaccagtcacctattgaaggacagttttgttgtttccactttttgactattacaaataaaagttactgtgaacatttatgtgcaggtttttgtgaagatgtaaattttcatttatctggcataaatgctttatgaaccagcaatcatgtgattgctgtaacatatgcaatgtatggcttttgtaacaagttagaaataagagctaacataaaataagtcactaaatgagaaagaatactatattatactatacttaaaatgtcaattatgtctattttttctatttgcttgactatatgttataaatacaattaaaagtttatcttaacttttaattgtcttaacttttggttgctgcttcatatgataagttcatggtgcattttctaagaaactgccacacagttttccagcatgcatgtacaattttacactcccttcagcaatgcataaaaggtctagtttctctacatccttgccagcgttcttccccctacctgttctaataggtatgtagtactctctcctcaatagtcttaatttgtgtttccctaataactagtgatgttgcacagtttttttttcgtgtgtttaatttaccatccaaatatactcttcagtgagatatctctttatgtcctttgcccattttctagttggaccatttgtatttttactgttgagtttcaagagttctttttggatactagatatcggacctttgtcatatatatggtttgcaaatattttctctcagtctgtgtgttttctcctcatcttttaatagggtctttcacagagcaaaaattttacattttgataaagtttaatttatagatttttttcttttacagatcatgcttttgctgtcatgtctaagaacttttcacaagctctataccttgatacttttcttctacattttctactaaaaatttcatagttttatattttatacttaaatctacaatctatttgagttcacttttgtataggatgtgaagttgaggttgagatgatttatttatttactttatctatggatagccaactgctatagcaacatttgttgaaaaggttatccttactctattgaattgcttttgtacttctgtcaagaaatcggttggccatacatgtatggatctacttttgggttcactattacgatgtattgatcttgtgtcagcccctctgtcaataccacagagttttgattgatgttgctatataataagatttaaaatcaagtagagtgattcttcccactttattcttctctttcatcattgtctattctagttcctttgtcatagaaattttggaataacgttttctgtagctacaaataatcttgccagaatttttattggaattgtgttaaacttctatgtcatttagaaggaaattgatatccttattatgtcgattcttttaatctatgagcacagtatgcttcttctgtttttagatattctttgattttttttcattggtgttttatagttttcagcacagaagtcctgtatatattttattaggcttatacttaatgatgtcatttttgaggtgatcataaatgagattatatttcaacttttggggtccacatgttcatttatagcatgcagaataaaattgatttttttgttactcttgtatcttgtgactgctgaactcactcatcctaggaaaattttggagattccttggaattttctatacaccatcatctcctctcaaataaggacagtcttatttcttccttttttttttttttcttttttgagacggagtctcgctctgttgcccaggctggagtgcagtggtgtgatctcagctcactgcaacctccgcctcccgggttcaagcgattcttatgcctcagccttccgagtagctgggattacaggcgcacaccaccacacccagtgagtttttatatttttagtagagacggggtttcacctagaactcctgacctcaggtgatccacccaccccggcctcccaaagtactggaattacaggcatgaaccaccgtgcccagcctatttcttccttattgatctgtatgctttttattgcacatgccatgagtggtgagagcggacatccttaccttatttcagtcttaggaaaaactgttcagtctttcaccattaagcatgatgttagctgtaggttttttttataggtatactgtattaagttgaagttctcctctatattcagttttttgagtttttaaaaaatattatgaatagatgtcgaattttgtcaaattcttttcctgcatcgatacaatttttttttctttagcctattaacatggtgattacactgattggtaaatcagttctattaaaaagaacattttaaatagttattcaattcattattagaaattagtcattcttacataataaccatttaatgtagtgatcaaataaattgttgaatgtataggaaaaaatttaaaaagatatttaaagctatggaatctgatatagtgttgatatgattattcattattaaaaattagtcattcttgcataataaacaaccatttaatctggtgatcaaataaattgttgaatatataggaaaaaaatttaaaaatatatttaaagctaaggaatctgatatagtgttgatatgagagaagaaaggaaaggaaatgagagaagagaagaggggaaaggggaggggaggggaggagcaggaaaggaaggaaggaaagaaagaaggaagaaaggaaagaaggaagggagaaagggaggaagggaggaagccccttaggaattcatggtagtacacagttaagttgatttagtttctattcagctacctgtctccctgttattccttcgtttgtttgttttctgctaccacctcccacttcctttttctttgtaaagctgggtgttccctcccttgagaattcccacaggattcagatgcaggagacaagtgaccatctgcttacttagtggtgacacatgaaatcgtgtggtgtgcaggtagaaccatcctgttaaaaaatctaggagtctccaattcagcagtctgttaaatagacaagagtagagtaaaagcaagatgaacaatgagggtgaaatagtataatcacgtaaacctatgcatggtggaaaacagacatttaaaacccataagagaaagtttcgaaaggcaccatggcaatatattgcttttatagaaagatgctatgagttggtggcagaagtgaccaactgggagggctttctcactccatcagtttttaccaaatggaagaaataagacagtgcccactgagattgatcaggaaagccagctgcactgtgcatcatttgacctgcactatataaactcttctgcaggcaaacgttgcctccctccagcactgacctgcctgacatgctcagattgtattgctgcaagaggtagggaaagaaatttggacccacagactcatttggagcaactaaagctcaaatttagtgtaatataaataaatactatagaaatggaaggcaagatgaattatcattattatccagtatttttatagcactttatattttgcaaacggcttcacgatcccatataatgaatctgtggggggctagcggatgcatatgttacaagctacaaggaatagcagttagcacatccattcattatgttttgcttacgtttttattgtctgatttgtttacatgagctatccactcttcctttctttatactgatttttggaaactttgggtaattaataaataattataatagatacatttagatgtatttggatttaaatttccagatgtgagcctgactttatgtgaatatacggctgcatagaatgcaagcatgagaactgagttaaactaagaatatttgtattcttcataaaacaaccaacatggacttcatgattgtgcttcttattctttaaagattttccgcctttcttactcttgctgcattcctccatcccccttcctacttagttaagcactggatgccctgcagcagtgtattttaaaggccttgtgtgtattggccatctgtccagtttactacaaagtagctcctcttcgaagattcctgccctattgttcctgtgaactcacctgtgtttgtcagtacctgtgctttggctttttgtatagacccaggtatgcccctctgtccttccctctgtaaatattgtctagtttattaagcacctagtgttggagaaatggtttcccatggttctgttactctggttcttattgactatctttccataaaccagatcaaagtcttaatcctcacaggagtggaattcaaaactttctagggatttatttaataccaaattgatggctgatttgtgagtaatgtgaatggtctctcaaatctaccttttgatcagagctttacaagcctgtatataggcacgttatctcctccttttccaatgagataatagatagcttagagccagcacatagtaggcccttaatcactctgtgctcaccaatgaagggagcccctactgggatccttctatgaagtggaggttgtgaaagcattaccctcaaggttaaaacctagtgtagacaatgtgacatataattgtgtgacctcaaaaatacatttgatccaattctagtagctgcagaacaggaaaaaagagaagtctaaagtgagtcatgagagaaaagttcaaaatcccaaagtttaatttgttcacagctgttttactgtcaaaggcagaaagaacttcaacagtgcatttgttggaaagaatcacattttactctgattaagaatatgctgagacttgctttttaggtcaactttataattgtaccacacattagtttttaaataactggaaaaatgttctgtacttttaaattattctttggggcggggcgggggtcagaaatttaaggcagatgttttaaattaaagttagtgttttatagtgaatatagttatatttctgaatattgaaagatctatgtaaagatggtgtaataaggaaagaaaaaatcttgttcttcgttcagtaagccacaaacttggagcctctctatccaaacttcaaaatcctaagcctttttaataaaaatattggaagaggccaggcatggtggctcacacctgtaatcccagccctttgggaggccaaggcgggtggatcacgaggtctggagattgagatcatcctggctaacaggatgaaaccctgtactaaaaatacagaaaattagccgggcatggtggcatgtgcctgtaatcccaggtacttaggaggctgaggcaggagaatcgcttgaacccaagaggcagaggttgcagtgagccgagatcgcaccactgcactccagcctgggcgacagagcgaggctctgtctcaaaaaaaaaaaaaattggaagaaaaatattgtttgtaatcagaaagatcactaatcttatgctaatttttaattatatcaaaagagtttttaaatttgatttgataaattacatttctttaaaaaagagaaaattgattacataattaaaaatttaacctgattgcagttaaaggaagacaaaatggtctaaaattatatctactaggaaaagcagttgaatatatttctcttacctttagcttattctaagatgaaggaaaataaggagaagtaattgaaatgtcagattccagagtgattgttcatttcaagtggacaaaaacctttacttgctttaaacttaagagggaactactcaagtaatagagatataggaatgtaagatgatgactgacatgtagccaaaggtggaggcagaagagaacagagagggattattattattttttaaatttcagccatctctggaacagagtattcatcttcccactcttgaacattttccagcttgggccaactgtgtgtatccagtgaggtcttgtttaagacattcagaagaaaattaagttatggaagtttccaatctcctttttttcagtaatttttccccccactagtatccttccaaaagcctctaccatgctctgggctttctgctattaatatcatctaccagaaaaataaggtgacactttttgtggagaattaacattttgatagagacatttaaaaaatgttcacatattgttaaaataacattgacacatctttttaaagaaaagaaatcaaaatcatccatattctcagtatcaaaattcaactgttgtcctttctttctggcccttattgttatagtgttatctgagcaaagaagtaattgtgagatctaattttttgtttttaatagatagggtcttactctgttgcccaggctggggagtatggtggtgcaatcatagctcactgcagtctataactcttagtctcaatcaatcctcctgcctcagcctcccaagtagctgggactcaggcacctgccaccatgcctggctattttttttttttatttcttagtttctgtagagaaggtgtcttgctatgttgcccaggctggcatcaaactcctgggttcaaacaatcctccagcctccacctcccagtgtgctgacatgagccaccatgcccagcctgaggtttatttttgaatatagcattattatgtaaatgcctcccatgttgtcccatccttcataactttcctgttttgtcttgacacactaatccatccatttaatgtctataatctattaacagtttccttgtttggagacatttaacaacttgtttaaatttttttaaaattactgatttttttttttttttgagagggagtctcactctgttgcccaggctggagtgcagtggcatgatctcggctcactgtaacctccgcctctttggttcaagtgattctcctgccacagcctcctgggtagctgggactacaagcacgtgccaccatgcccggctaatttttgtatttttagtagagacagggtttcaccatcttggccaggctggtctcaaactcctgaccttgtgatccgcctgccttagcctcccaaagtgctgggattacaggcgtgagccaccgtgcccggccccaaaaattactgattttatcagaaatagtttctactcattttttttcttctgaattatttaattgtaataaattctcttgggagaatcaaagcatgatgaatattattcatttttaccattttattttcttcagtggtatcaatttgcagaactactaggtgttcactgacataagtatctttaaatgaacaaattttcaaacaccttcacagcaagcccaaagagctgatgtactcttcaaagatttctaccaagaaaaaacaaattcaggatcttctaagtatagaagggttttacatttttttttctaattctatcttctcctatgaaagccctgattataaaattataaaagcaaagatttttttgtttgctttgttttttttaaacaatatatattgtggacctgaggaatctgacattcccttatgtccacgaagaaattatgtcatttatttgttactctgattcttctgcattaaaaataccacatgtatacgttagaagcaatttcagtattttttgtcataattgcaatgagaagataaatacctttttaaactatattttatatatttttttcaattttagaggtctcacagtttttctaaaatgtcctattagaagtgaagggatcactttggtcctcatttgtttccacagcattttttcaacctaaggttttctttcagccagaggaccataaaacacatttctcaaaatatattgtagggaacactactagtatcttgagatgaaattgtcatatggaaaagaaaaagatccaatggaactataaaatgcattcataaactcattggttctgaaaatgtggttgctggaccatcagaatccatatcccttgggaacttcttaggaatgcagactctcaggcccacccccgcctactgagtaagaacactaaggaggcagagccatcaattggtgttctttaacaaccctccaggtagttatgcttttctaagtaatttgtaatgccattatcttaaaaaagtttctgagaagttccttaggggagagaaaaaacactacaacacgacaaaaacctctaaaccttgtttgcccaaaaagttgaccaaagaatatctattttctcttctaccaatcacaaacttttttttttttttttttgagacagggtctcgctctgttacccaggctggagtgcagtggcatgatcttggctcagtgcaacctctgcctcccaggttcacaagattatcctgccttagcctccggagtagctgggattacaggagcgcaccaccatgccctgactagtttttgtatttttagtagagacagggtttccccatgttggccaggctggtccctaactcctgacctcaagtgatccaccctccttgtcctcccaaaatgctgggattacaggcgtgagccaccacgcccggcccaatcacaaactttttttttaatagagatacagtctttgtgtctaggctcaagcggcagttgctagtttcaacctgagttgttaatacatttaacgtgggttcattagtgtttgatatatttcttgtggctagaccatgggaagaactgctgtccttttggtagcgggatacgtcattgcctgatgagttgattaatctttgttattctgcaatacctgtttgtcatgcatatcttagtatatgtgaatagagtatatgtctggtatgaattgtgccattataatggttcctgataggagagattctattttcatttgctaggtatttgagataacatatttactcactagagaggagtaaaaattaagtattaatatttaatgaacggatactaagtgagaaaaaaattagagcctttggactaaatatttattatcttacaagagcaaatagctatgttataaaatgagaatatgcaaataataaaatggaaaattgaaagtaattatctttacatgtgctgtaaagttgctagttgaatttattgcctattctttttaccagttcaaaggttagtgggaaaataccgttttgacagcagacttctgacagcttaataataatgatcaagctttgtgcattttatttaaacatctatagtcaacatgctctattagtagctctccttgtatcttttgcaaaaataagattttagggaaaaatgttatgttttatctcaacaaaaaagtctagtgtatgttttatatttgcatctcttaccctgtatgtttaaattacaaagaaattccttagttcaaatgagcatgaagttgtttggcaaactgagattacatagctacaaaacccttggtagatggtatctataaatagaagtgtctaacgtggaaagtgctctgaacaatataaacgggacttttgcaaaaagaagtggagaggaggaaagcctacagcgttgatttaaaagactgtaattagaattaggttccgataattagatcccagtagactgagttctttttcctcaaacaaacaaatcataaatgagtataggatgtcatttctacaggaatgaaaatagaaatggaattttaaataaagattgtgaagcaaaatgtggcattttaattcttgcacctggaatcatttcataatgaaatgcaaattaattctaaaaatctctgacctctgttttgctgattgcagcctaaaatcactcatctggttttgagaaaaagagaaaatgcatgccaagatgaaactatttagtatataccttggaattttataatgaacttagatgactgactgtggctaaataagtttacatttccatttttaagaaagatcggaaaccaagaatggaatacttggtataaattggggatgaagccactgtgattatctgaagtcattcattggcttaaaattttgttcatccttcactagtgagttcttatgggatgtgtgcttattgtatactctttagttctaaatttgcaagagaagtaaaactggaatctactttttagttttgaaaaatgtaagtctgagcttcattaactagcacttataaaaaagaagacacactccaattgacattttcacattgatgtttaatttaaataagaaccaatatttctatggtggtgagctgattgagaggtaaaagacctttaaatctccttctgaagcttactgcccaataatattttattttctatatcattttattgaccaatgttgtcatcagtttatctaacagaaaaataaaaattgcaatgtcattaaaaatatataccaccaaaaaaatacggttgatgcagttgaagaagtaaatggcaaattcacagatattcataaaacagctattgtataagactgagactagaatgaaaattttgtatctaatgaaaataagatgtcttcttctttatttatactcacatcccctttctaaaaggaatctgaagctctttacaataagaccacctagatttttttaactatgaatagagatgaaaaatcagaacacaggcaaaaagaaggaaaaaagcataaggtagggtggtaaccaagagactcaatgtaatttattataatttttatagttagtctctgagcttcctgggggcaaaagaaaatgaaacctgtatgtccatattgtcttaagttttaactgtaaatacagtgaggtttttgttagacttaatagtgtgcatatagacacacattcagtacatgttttctgatgccttccatccacaggttacctggttcaattgtcaatgcctaagtcatctttaaaattgctcagtgcttttataatattcataagtcactgaaaatagaacaaaacaaacaaaacactggcactttttcttcattttatttcactgttgaacttgataatgttggaaacctgagcagaataagatagtttgatgattggctgggctcttcatcacggcttgcctttcagtataagatattaaaatagtggttttcaaatcttatagccctagtatcatcttagaggtttcagagacaatttccaaagtaagtgggaagccagtttacccagaacaatttactcataactgctttatccagaataagttaacttttctctactttacaatgttagattgtattttgatttgctttgaaacaaagttctgctgaaagcagtttaataatcacttaaactggtggtgagtaaagaccaccaacagtgctatagtaaaaggaactgatagatgaccctcgggggtgaggtttgtgaaacctctaacaagggaatcctaactatggatggatagtttttataatgttagcaaccctctaaaattgtaagaaaatgctacatattttacaggcaattaatctagggggatagccaagagttttcttcggttcttgtattatcattaaattttagaaatggataaatattttttaaaaagcacctagaatggatttattgaatagttaataaaagaaataaaacattataggaaacattgaaatcccttttttaaaaccctccagacatatttctgttgttctcttctcaaacacaactactctttttaatttggtatgtataattcctgttttttacgctttcactacatatgtagatcctgccattaaaatacatgttgtgttaattgagtgtttatgaaaattttcataaatattttaccacaaatgtcattaaccatcttgtttcatcacattttattttattttttgtgtgaacacgtatagtttctagttcatttaattgcctgatgcagttctatattatgaatatgtcacatttaatcaattcatttcatctctatggaaaaatactaaagtactttccactcactcactaggtcaagtagcataacagggaacatctttgcacacatttttaagagttggactagactggaatgtaactaaaagtgtacttgaggctcacagagtatgcacatctccaaattgtgtttgtaaaatccaagttatcatccagaatagctgtacctgtttacattctcctcagcattgtatgaaggttcagggtttttggcatccaacagtggtactgtatattcagactttaatttttacagttgaatgggtataaaagagcatctcactgctgctttcaagtgcatttcccttatttctagtaagatatcttctcacttaatgtccattgggtttctttctgtgaattgcctttgtgttcattgctcatttttttccctagtaggttaacatctttttctagatgccatgtaggagttccttacatatttggtataataattatgtgttgccaaaatacatttattcccagtctggagctgctcttttaactttgtccatggagacagattttaaaattatgttttaaattttattgtggaaaaaatgtgcagatcttcttctttatggtttctgccattcatgtcttcacaaatccctcccaggctggatgcgataatgcatgtctgtaatcccagtcctttgggaggtgaaggtgggagaattacttgaggccaggagtcagagaacagcctgggcaacaaagcatgaccccatctctacaaaaaattaaaaaattagccatatgtggtgatgcatgcctatagtcccaattgcttgggaggttggggcagaaggattgcttgagacccagagattgaggctgcagtgagctgtgatcatgtgatcacaccactgcactccagcctgggccacaggagaaaaccctaaaaaaaaatccttttctataacaattttataaaattatcctgtcaatcctataccttcttttaaaaaggttaaaatgtttctatacctacttaggctatcaacctcacctggccagaattctgtgataggccatgtttctataaatgtacaacgctatttctgtgacctctttttgttgcattgatttaactctactccagatttaaattttcagtgactgtagttttataaccttgatgtctggaagggcaaaaccccatatatcttatttattatcttcaaaactgatttaaatattcttgagattttctcttctaggtgaattatagaattattttccttttttgttttttcttttcctttttagagacagggtgctgttctctcacccaggctgaaaggcagtggcaccatcatagctcactgcatcctggaactcctgggctccagcaatctgccagcctcagcttcccaagtagcttggactacaggcatgtcactgcacttagttagtatttttatttttagtagcaatggggtctcactttgttgcccaggatggtctcagactcctggcttcaagtgatcctcctaccttggcctctcaaagtgctgagattacagacatgagccactgcacccagctttttttgggcacttttcaagaagaaactttctggatttttattgaaatgtcattgaatttatagattaattttatgataattgttactttttgaacttgagtcctccaatccacaaacattgtatatttatgtgtattttgacattttttgtaaatatttgcagtacttttccttgtaccttttgacattttcatcttttacatgcatgtgttgtaacttcattttgccacgtctgaattttttcatttgtcttattttgatgttcattcttttgttgatttgtttattgtttgtttgttttccctctaatatgagaattcatgtcttttgtcaactctggaaaatgctcagtcattgttgcctttatctcattctctattctcattatttttgaaactcatggaagactcttgatatgcataaaatcttgcaaaagcttcagagggaaatatatgtataatttctatatatatatgcacacattatatatagatatacgcacatacacacatataagtgattttatcatatatataatcacatatgattataatacaatcccttatatataatcacatatatacacatatatgtatatatacatatgtaattacacttacatacatatataatcacttatatgattacgtatatcactgatatgtatatataatcacttatatgtgtgtatgtgtatatatagtcttatggtcgccaaattctcttttctatttttcaactacaccaagcccactttcgaccacaataatgctatttatatctttacatgtttaccttccacataagattcatttgaagaagagaacacagctttccttggtgccagctttccctgagtctatgtatttttttgttatacagttgtgttttaagattgtacagacagttgatataactgatctttggaaactctattctgaaagaatagagtgccactattcctgagcaagaaagagatgttttcaatttcatttcctgaaccttcccactctcccgttacacttaacttaaacaaatgtacgtacatcattgcatttataactatcagagatacaagtcagagaactggccaggatgttcattaatcatgtttgctggtagtaataaagggaaaatccttaaaagctatgttgtttgccttgtgggtgttagtcacataaaattcatggctttgccctaaactagtgcgcagtaaagaccagacaattgcttatcatgaggatggattgctttggcattagtgcttcctgacttaaaagaggggcttatttgttcagaaaatgggccggcattggatgagctttcattatttcctgcctctacttgtgtactcttgcattttgcaaaatattgccagtcttctgttattcaagtaaatgtttcaactgtctatataaatcatttctcttgatgcaaccaaattatttaactcagaaagtccatccatcaggtgcttcacaatttatcattattttaaagtaattggtctactcagtagcataacacttactgacataataaagtcatgtggattatagataaactcgtgagatacctggaacttggaactatcattcctatatagggccaaataatccactattgatttggaacaacaaggtgaagaaaattaagcctccccaattccagctagtattttaattgaaagagctccaagaaagactcaggtgctgtaattgtgcggtaatttggtatggcagcttctaattatgaagcacgaataagaacaaccttgggaaaaatctcggtatgccaagattcacccattgcagaagcagaatctgagccaaatggtaatttgtgaggttattaaaatgactattaaaggcttggatcagataccgctcaacttctgaactttgagttaactagaagttgatcagagttagctttctggagcttttcatttgtttctgtattttgttaaaagaaaaaaaatctgacttgcatgcttattgcatgttaagtactgtgctgggcattttatacattttagctcatttaattaaattatcataatgctatgatagttttagcatctaaactagcctaaaaagggctagttttaggccctttttacaaataataaaattgtgtttcagggaggtgagcaaatttctcaaggttatccagctaatcactattcaaaaccaggtctgtcttttcccaacgcctgtttacttccctctacaacaacagtaatgatgaatgaatgcatcgacatatgttcatctcaaggctatctcagtgctccttaagcattatctagtttgactgggaacttttttgaggccatgtggtccatgtttaccaaatgattcaggcatatctagccatccttgagaacttgtcagagcaggttaagaggttaagagacaggcaatattgttaatacttgttattaatacttgcttcagtattctccactttgtatttgtggcaattttggattggtaggtaatgaatagaagatagagttacggaatattagataattttataactctttggatgcttaagagcctagaaaagtatataaatatcagcagtgcaaggagaaggaagcaggttggatacagagagaacttggaccctttgattgctcagcaggtggttggatatcctgagatggggaagaaggacagacctcaatatctctgcattgactaactgggtcaatacagagctgcctaaagttgtatttaccgctggaaaataaaagtgaagaaatagtaatcaaaacagatttttatatgccttattgctaaaagtgagtattatagataatgccactaatttcagtaaaggcagtcttattccatattattaccttactcctaccactgggactgtgagaaaacactaaaccactagcattgtctaatttgctactacaaaaattacttctaacagaaagtgagagattaggggattataaaatgttaatgctggataagacttttgaaaccactcctgttttacggatgaagaaactaaactagagaaatgaattagctagttcaaagtcagacaactagttacccataagactaagacaaaaattcaaatgatctgacttccaactcagtgatatacccacaatatcatgccaacttctagttttattttaatgttctattcttattttttatttatttattttaagacagagtctcactctgtcgcccaggctggagtgcagtggcgcaatcttggctcactgcaagctccgcctcctgggttcacatcattctcctgcctcagcctcctgagtagctgggactacaggcacctgccaccatgcctggctaattttttgtatttttagtagagatggggtttcaccgtgttagccaggatggtctcgatctcctgacctcgtgatccgcccgcttcggcctcccaaagtgcagggattacaggcataagccaccacgtcaggcctctattcttatttttaatgttaatttctttaagtgtattacatttgaacaatgtaaaactcatttctattagaaaacagttagatttctagagtctcttcctactcactggtctccacaggggaaaaaaaggaagactgtgataaaaagaaaaagagaaaagagaaggaataaaaaggacaagaaaaaagattattttgcttcatttttagctatttatcctcagataaaattgagaactgaaatctgaaaaccgttaaactcatgacttacttttattatggaggaattagtttttccttttattatggaggaattagtatttctcatttatctttcagctctcaagtactccctgtgtgaattcgaacatttattccacttaaaaaattcacaagaaatgcccaaagtctaacatgtttccagattgggaatattttcactaatacagtactttgtcctcctgggtaagaaagaagctctctgattactggtctgaaacttagagaataagacaatgcttttcatgtaattgattcatatacatgggaacgaatgcctttgcaaagcagttatttctatgcctgacctacagagagtctgtagtgagccacgcatgtggtatcattagtcactgatgatgacaacgagaacaggaagattggagtggcaggataatcattctcagcaaactaacacaggaacagaaaaccaaacactgcacgttctcacttataagtgggagttgaacaatgagaacacatggacacagggagggaaacatcacacactggggcctgtcggtgggtgggggcctgagggaggtatagcattaggagaaacatctaattagatgatgggttaatgggtgcagcaaaccaccatggcacgtgtatacctatgtaacaaacctgcacgttctgcatatgtatcccagaacttaagctataagaaaaaaataaaagaagagagagagagagagagaaaggaacccaaagtcctagaaaaaagcatggggccagggggattcgttttcaaccttggtatgagaaaggctttctaactataactcaaaatccagaagcaataaaattgaaaaaaaaaaaaaaaaaggaaagaaagaaggaaagatgggtggtagagagacccagtagagggcagcatcagtaatccaggcatgaggagatgatactgtgctggaatggtgggggaagagaaaggtaggggcacatgctggagaaactttaaaggaaaaattgagatgtatgagtgattgaatgtattggagttaagatactgacgattataataatgtatcttgcatttatatgttatgttatgcatttatttgtgctccaataaagtctatcatatcattgatcaaaattactatatagtcttcctttgttttgagaggataatttatttcaggaagaagaaataaactgcacaaggaaagttcttctaagtcaatagcttatttaccaccaagattaatgacacacaatcactttaacagttaaaaagtatatgtgatttttatatatgtgaaactttagtgcaaatcaaactcaaacagaatagtaaaaacataagaattttttttcaaccttaactgatgcataagattatctggactataaactggaagactaccagtactcagaggagagaattcagtgcaacgcatgccagatttcataaaactgcaaagatgactgcatggtgactctcgtttcatggtgcttagctgccactgaggcatgtgaattctaaattggtcttcataaatgtgaaggaatgcctggaagtcaaaggaaagcattaaaggaaaccccttatacatgtttaattctcataatctgattggttatatcaagaggtatgactatatataaatgtattacaaatagttattgaaacacattgttacaatagttattattggttatatcaagaggtatgactatatatgaatgtgttacaaataagctatagttgctataatgtttataaattacacaacacctaaagtttaggaagtggatagcatcttctcatgagatggatagcatctttatatatctctgacttttccactgggcttcaaatgcatattaaaggacattctataaaattaccagtattccatcatttttggtctacaaaaatgtcagtttcacatagtttgacctaatatttgccactctcaacttgtcatttccacttggcatagtcttggcattacgtaggcatatgaaaatccagggtttgttttttttttccaccgaaacctgttccaaccacaggtggtccacagctgtccacatttcagcaaatgatgtgatacgatcattcactggatggctcacgtttcaaacctgggcataactctcacttcttttctccccaaactcacattcaattcatttgcaattgcttttctcttcacctggaaaatgtatgtctaatttgtctactcctctctgtctccaccattagcatcctagtttgtcattattttttattgaatttatgtaagagagtcctagctagtcacttagctttccactcttgccttcctctaactcaatctctaaacaagcacatgaagaatatttaagaatgtacattagattatgtcactcccatgctttaaacactccaagggcatcccatgacacatagaataaagtccaaactacatataatagttacaaggctctgcgtattgtgaacctaactttctgatttcttctcctactccaggattcaccatactcaaagtaaattggaaaacagatcttgggtctcttgggtcctcttgggtcctgttgttcccttttcctgaaagctcctctttatctttacataattggctccttcctgtaaatcaggtctcagcttgaatgacatatctttagagagatcttctctgacaacatattctaaatagccacccccatctgtcattctttatcataccatcatttaaaaaaaccctcagcacagcacttatcacaatctgagtgatagatgtcttattcatctatttttgtagcaggatgttagaatgaaagttttagttgggaaatattattttacaaagtgaacaagaggaaagaagctttcaaagtaggactagggagtcatgtggttgactgtaaaaattcctcatccacaaagaggaaataaaagaatcagaaaaatgaagattaggaaataacttagggaaagttttttttttttcaggtaaccattggagttccattatttaacaaattgaatgatataaacttataattaatgttatattaaaacaaagataataaatatgcaaaacgaatcacttcttaattatgttgttatgttttgttattatctatgctcttcaggtaacctaagtcaactggtaggaatactacatacacagtgatgtattacttgctgcatatcttcccaactctgtttttgataacattatattgtgcacgaaattagccatgatggaactgtttacaccaagaaattagcaaacaatatagattaaggttttattgtttgttaataatttcaacttcaaaaattgagaaaatattaataatgcagactaaacttagtgttgtgtcagtagctataacattgtgaatagcacaaaaatcaaagaaatattctagtattctaaagctagctaatataataaaaactcagtcacatcactgagaacaagtaaattcttgatacactttttcactctttcactttcatattactcattactgtaaatgaaaatacagaccaatacccacgttggaattatacatgtttatcagttccaactatagattgactacaggtacaaaaggttgacaagcataaatgtacttctataagaattaattaactatgtggaatttgcagtaaagagtattatatattttattattgactatgagttgtatgctatacctctttttattagcaaaatttataataaacttcatacatgtgtgtatccattatttttagagagctctttgttaaacatttaccagcacagcgctgtgatagacccactatctagccaagaggaggcaggttacttcttttttcaccttaaatcaagaaagggacactttactaaggccaccgagagagcacagactatatcccccacaactgggggaggggatactgtgaattggtgtcttacttcactttaaaaatctaggccaggcacagtggctcatgcttgtaatcccagcactttgggaggccgaggtgggtggatcacttgagtcccatctctacaaaaaaaaatacaaaaattagctgagtgtgatggcaagcgtctgtaataccatctacttgggaggctgaggtgggaggattgactgagccagggatgttgaggctgcagtgagccatgattgcgccactgaactccagcctgggtgacagaaggagaccctgtctcaaaaagactaaaaacaaaaaatctaaaaggtgacagatagccttgtctggctgttctaagaagaaaggctttagtgacttaccagcgtgggaagtggtgttggggcaaagtttgtgttagtgtttcctgtggaccagagatgagcctcacatgagacagattaggcacagggtgaatttagatcctctaaaaggaggctgcccagatgagtaaaatggatgtgtataaaggagctacaaatgactcctggatttctagagaagaaaagaaggtggcatcagtattactaaagggaattccaggtgacaaatccctagctgggaagggggaatctctgaagaagctttaatatgctaaaaagagaagggggcagctttgaaccgctgaaagaggagagtgtactgccagcttgtgacagtactactagtcacaataggactttgctgctccatttcctcgtgtctgttagcggattcacaagttgacgagcaggaggagaagtataaattgagaaaaaaagattaaaaacagcacttctcgccactccctcattccctagcagctgctttccacctacaacaggcctggcaatgaaaggctcctcaacttttcataacgttcactttttgaccattaaataaaactggatatcccaggagcagaggaagacccagctcccatccaataaactgaaggagatactaagagacaaaaatatgattgccttatgattaaactctacaaatcatgcttctttaatgaaagaattatatttattttccccttaaaattgaaaaatttaagaaagcagggcttcagtacataggagacacccagtaaatattaattgtatgaataaacgtagacaggaatgaatgattgctcattggttcttcctttggcacttgatgaagcagactcagagaagctgtatatataaattgcttttaatataaatattcttttggtaggaaaaggagaaagaatgagaaaattcaattctgaatgattaggagaaagacagaaatgggtggatctgaagaaagaaccactttcatgtgggaaaccaattcatatgatttctcatcagtggcatggaggaataattgttagacacttacacatccctgaaatgtgtcgtcagtaattaggacaggccctagattctagaggagggagacagaaatttggccaagaaatgaaggggttgaaaagttttctgagactgagggaaaagaagaaaggagaaacataaattcaggtatatactgcaaatatgtaagagcaaagaagacttcaggtgaactctagatttttattttcatgtgctcctctccttcaaattcagaagaaaaggacaaagctaaaactatatgaaatccttcgtctaaaatgacgaatctgaaaattccagaaggtaggagcttagtttcaatgagatgaagaaaaagcttctcattcatgaaatacattttaataagttgaaatttgaacaccaggtgtatgaaaagaactagaatttaaccatatgtgttcagaaatatttagcccacatattttccagaataatccccaaacatgtttaaggatataattggtaagtaagaaatttgaaatccctatcagagtttgccagagttgtctaagatgcattgagtactttcagtaaaccagatgctgcattttcaatccttacagcactgagaagatactgttctagttgaagttgcatgactcaagtgggtcaaagcttgcccaagttccctgagttaagaagtagaatttcaaacacaggttgaactaaccttagagtagggttttcataacaacattcgcttcccagtaggagttttaattttaacatgatgttccttttggatttaatgttattaagggacatagtggatgaggctgactataatttgctggctttcatataagcatcaaacaattgcatttccttctccctatcatttttagtcctttatgtgcagccttgcagcattgatctccaggaaagcttgtgttttctggtgcacttcccagaaacaaaatatgatatgtgttcccttttgaaaacaattgataagtttcatgttgacagaaacatttcattttccaagtcatttatctatttgtcataagaggaattataatagtatattggcttccataatccaaatccattccctttagtgtatttttttaattaatacttctctacttaaattctgatctaaaaaagtggccattaattaactcagggagcaattcagctatttttttttctaggaaatgggaaatctggtaaatggtttgtacttctactttgtcaaaaacatgtatttttccaaactgtatgagaactttaataacactccataaatttcatgcttttagtcacacttggaatggaggctttgggaactctataaccttcttaatgacatgttggcttggcctcagcactgtagcttcaacttggttcttaatggacattaacccatagtgcataggcttcaggtaacacagttggtgatttgtattttttttctggaaaggtccaagacagatccaatattatttccttttaagaatttatccctttttgagacagagtctcactctgtcacccaagcttgagtgcagtggtgcaatcttggctcactgcaacctcccccactccccaggttcaagggatcctcccacctcagcctcctgagtagttgggaccacaggtatgcaccaccatccctggctaattagttttgtatttttagtagagtcggggtctcaccatgttgcccaggctgaattaaaaatatttctcatgaactacatgaaacctcgtaagtgtgaaggcttcttgaggacaaaggttgtatcgtgcaaacctttacatatcctaaggcactaattctttgcccattcttgtaaccaataaacatttattcagctcctactatatgccgggtgttatattaacggctgggtcagggcacatacttatgaaaatagtgtatttatatatactatctttcaaataataaccagtacatttttacaattaaaatataaaataaaattattttggcttgtatgtgtgtctttcctagaaaagatttgctaacagtaaaataaactttatagaactatcattcactcttagttgcatcttggcaaatagtcaagggcccttccaaaactttgcctgtatacactttggattttaattagacacaataagacccccctccttaatctggctctgcttcttgacaagtcatcatgaaggtgtgataatatcacacaggaaattatcaaactgctaaaccaagtacagaggagacaaataaaatgttgatgcaacagctgcagagactgtcctgaaggttctgtaatcaatggtgtcttgagagtcgtatctgaggtagagtctttccaaatgcacacagtgggtggggcagtggtatctgaagtggagaaggagggcagagaacatggtatctacacatggcagattcaagttcatgcaagcaccctgaagacagagaatttgtcttgaataattttaaatttagcaagatggaactttaacctcataaagaatggaactcggtgagttttggaacaaaatgactgtttttggactcaaatcatagaaagcattctcctgcaaatgtaatatatccatttgtctttagcaggaaataaatgaatttatttcaagatggtgtcccagagaaggcctgaggcacaatcatatttaaactgtatgaatactgagtgacatgattgcatccagtgtggtctggattatttgagcaaaccatggggacatacttacctgtttatttccctacatctgtttatttccctacgtgttcttgacgttagtgtcgaaggattaccctgagacctgtctcagtgtcctcttgagaatggatatacacattgacataaattattaacttctccctagataggtccattaattttctgtgaattgttatggctttattagtttcccatcagttattcttggtctctttccattaaagagaaatccactcttacttaaatttgtgtcttgcactaaagttaaattcagccaacttcgttctgaatctatttaatcctaaaattatttatttaagtaaactttcatgtatcctcaggagcctcttttcctgaaaagaccaaagagaaactttccttaattaggcataaaataacagttctaagacttgttttataaatgacgatctgttctataaggttactgggtcacgagagctaaaatctttggtggtttttgaaaactgatacttgagggtctgaaaagctgctcggtttcagtctcacattgacaacgattaagatgttgagattccagaagtgaagaccttacacaaggagatgacagctgtcagtgtataatcagaaaagcagccatgaagtgataattcctctgtttttcttctgtgatgtcctagtagaggtgattttaagtaaaatagattacatgtcatggctattagcaaaggcaatagacttcaccacctttgccctgagctatgttatatctgcaagatcttcaacaatagttcaacttacaccaggaatatattagctcgttttcgtctatattcatacgttctactccatgtggctttctgacttttaaagttgggagggagtttaaaaataattttatataaccccttcactttaaagataaagaaagtgagacccagagaaagtaagttatcttccaaggtcaaagcacttctagcagtaaaactttaagagaccatttgggaaatttcattatgatttcaatggaagtcactaaaagtactattgagatagtcaggaccctggagtcagtgagcgatgctgaattgctgggtccagggctgatgaaaatgccactgaaactgtaatagcttagccaataattacattataatatcagaccccttgcaatttttgtgtcttgatcattgaaattgtaagaatgttagtaacagaatatgttccttccaggggtgggcctaacaccctattcatttttttccccttgtacaataaaagtggtgccacaggcatattgaccaaatcattagaaaatcaattactattgagttagagctgaacaaaatagtttgaaaagtatttaatttatcccttgtaatatctgttcttttaaagttcctgtaatctgtgatccctggctgactcctctgtgatccctgacagaaaacctcattttcaaatccttttttccccctttccccctgctatccttccaaatgagaaaatcattaaaggaaaagaaaaaagtattcagcacagtgagataagagcaaaccagctcaactattatgagagaaacgcctgtttccctaactaatcaaaattcacagtaagtgtgaggaaaacaaagccaaactggcagaaataatacagttagacttaggaaagacctagaatgcaggcatatctcataaaaaggttatttagaaataaatctgatggctgtgaggtgagaagttaatgttagcatagagcagaacctaaagtcacttgattttctgctatttctgaaaaggtcacctaggtttaatcatatattctactttcttccccttgccttccatttctcccttccttccctctctgcttctattcctctccctttcttccctctcttcctacctctctgcagtctgcacttttcccttccattctccatcctttctccttttattcctctcttctttcttccttctcttcctctttcactgtctctctttctccccttctccattccttttccccccttccccctctttatttctccctctcctttctctctcaattacatctttcttctcttttttctccccacttccttccataaaggaagctcttttgttccaccctctacaccaggtcctggagttacaaaaacacagcagccagacaccccacactcagaccttacaggcaggggcaactgacaagttttcagtactaaaatcatgtgttaagtactaaaactcagggatttttttttttttttttttgagacaggtctcactctgtcatccaagctggagtgagtggggtgatcatagctcaccgcagccttgaactccagcctcaaactcctgagatcctctagcctcagcatcctgagtaactgggactacaggtgcatgccaccatgtccagctaacttgtatttatttattttttttgtagagacagggtctccctatgtttcctaggttggtcttgaactcctgggctcaagccgtcttcctgtcatggcctcccaaagcacagggatgttttaaactgttagtggaggggaggtttcgctaaactcccccaacctagggtgatctgaaaggacttcttggaagaaataagacctcagttgtatcttaaggaagagtaagagtaagccaatgaagatgggagttgggatggaaaaggggaaggggaggctgaaaagggagagtggaggttcctgccatggtaaacagtgtgtgcaaatggggcatggaagaagggagggagggagagagggaaagaaagtaatacagagagaaaaacaccaagattcaaagacaccaagatgttttggtctggaacgtggatttcaggtccttatgctgatctgtctcccttaaatacaatgagtgccttagaaaggaaaccatattatttattactcccttaatagaaagtgcttctttacagtagtggatatgtttgacatattacatacaagatgcccggccaaatttgaatttcagataaacatcacattatttttaagtatgtctcatgtaatatttcatgtatatttgcactgaaaacatgatctattatttatctgaaattccaagataattgggtgtcctgtacagttatttgctagatcagcaaccctaattaccaagcaccagatagttaataaaagtttagtgaatgaatcactaagtcagtctaagatgtatataagaaagtgtcaggagattcaggtagacagctagtcaagttaaagtcaaatgtttaggagtcattgctggttattaaaactataggccagcatcacccaagaatgttgtgtaaagtgagagagaattaaggatgagtccctgaggaacaaaaagattcaaagagaaagcagaggaaaactggtatccaaggaagaaatccattcattaggaatagaccttggagaaagtgaggacatgaagaccaagaggagtgcacttcagaaaggaggaagtggccaacagggtcaaagaatttaggagtcaggagggtgaaaaacgtccattgatcttagccacgaaagtatcactggtggtttcatcaagtaggggaggtgtggatactagccagatttgggtgagttaaaaagttaaggatgggccaagtggagggagtagagacatggtacctgcaacctgttgcctctttcaagaacctagggttgccagatttagcaaataagagggtacccagttaaatttgaatttcagataaacagtgaataaaagtatagctgttactgaagaagagagagaggggcaatgcccatgggggcatcatttaaagatgagaagatccaggatgatcctatgtgtgaagaaggagaaggaagagtgaagaaggaagaaagaggaagaaaggaagcagaagaaagagtgaagttgaaggtctagaagaaattacagaaagaaaaatttaactctagggtcacagtctctcctctgaaaccgttgaagcctgatgccagaattttccctggaaaagtaatatggtttatattttctattagcactcccctgggggttctgtagaaaccccataatcaaatatgttaatatttttaatagaaaagtgtgaatatttttactaattaagataaaggctgtaaaatagcctcgtttcagtttagattttgctttgctgccaatgaattatattaaaagacaaacaattttggttttcagagctttttaaattttgtaattgatgataaggtattaagaatgtgctcagttctcttcttggccccaaggcaagatgaagcaataccgttaattatctcttaaatatatatcagtcaataatataactgttccttcccagtctactgtagggagttcagtgttgccttaaatgttcctggtactaatttgttttgcaaaatcagggtaaataatggaaaaacaatatttaaaacacaaagtaaagagaccagggaaccttgaggttctgtgtgggaaatggaagagagactgatgggaagataaaataatgattctcatggtaaaggggaaaagagagagagacaagcactggttgggttcaagagaagtttctgaggatcaggtcaaaagtgttccagccccagcccacaaactccttcagggtcttaagtcagatatacaagtcgtctctggaagagaatgatgaaggagctcaccgacagtccctgtcactcgtcctaggagggatgactattacggcagagtcccctcctcctgatccttctgccattaaggtcccaggtcaatgtcagcttatcaatgggatgttctccaaaccccctatgaaatacagtgccctctctccacccatccaagttcatcccccattacattcaccagtttcatttttttttcttgggcagttattaccatctaaataatgttgcatatatattgtttccttgattcatttttctctcaccactagaatctaaatctcttgagaactgacactttgtagccttcagaatctagaacagtgcttggcacatagtaggtgctcagtaaccatttaattaaacatagatgcagaatggaagtagaccacaccaacgctccatgaattaaatggatatctattacctgctcttgattcctatccattacagaaagctaaagaacttagcttccattttggggggaaaataaaagttccaacttttactaagcattaaaaaaaatctgtaggaatacaactcatttatgaatttcaaaatgtttgcattttaaatgcaaccagaaaagaactatttgaataagcaggcatttagaaatgtaactgcttctaatttgattggtcacataaattcagtttttttgcaaagcagatttatttaagtcagagaacttacaaaattgaagctcagcagtgagagttctccatcacacttcctaatccatgatatttcattgatgcattgttcatttggaagatggagatgacaccagtgtctgtgtgtggatccaaatatcccagggggttcaacagcacctcacttcatcaaaacagagaaacaacgagagagctggatgaggcacctaagatgacagctagaggtaactagatgagttgatggcaggtaaacgctatgataacaagtagaaaggagccaataaatactgggctggagcagctcaaagactcctgcctgcttctgaggtttggatgatccttctaacctttaaaagtgggactgaggaatctccctagacagtttggcacaaacatctgctcgatcagtgcaattgcttttgtgtgctgccttttaaaaagcaaaatatttaatggcagtaaaaaatgtgtaagaaatcatcctggagatacaaagttgtattctgggatttgatgattttgttatgtcacagccaagttagtatttttagttagccttgttaagcccttgaacaggtgcttggagctgtgtagaacatagaccaggtctccagtggtgaatctgactttgccaaaggcgagcaggtctcccggccacagccgtaagtctcaaggagtccatgtcttatggaagtttataaggactcatttctgccagccatggggttggatggcagttacaagaagggcatttattgggatttctgggaagtcaccaagatcttccattaacccccaaatgtccatttcttctttattttctctgattcctttgcttctttttcacctgtacaagttcttcttggaaactatgtagaattgtctgggtctcgttcattaaaagtgaaaaggccttcatcacttccagagttttgatttaggccaccgttgaagggcttcacttttatttgtaaaacttacctatcagtaagaaaaaagaattgagttttcatattaatttcttatgacaaacaaagcaaaacaaagcctagaggttatcaaactattatttaatgtaagtcagctcccacacattgcttttacatcattacctcagtacgctaggtcaagggtgctttgttgttgttgtttgtttgtttgcttgttcatttttttaagtggggaaaactatggaaatgggaagcaaagagatactcctaatggtttatttaattaattttactatttggtaaattcagataatgcacacagggccaactataagcttgaaagctggtattaaaggtaccattgcaagaagattctgacagttagaggaactacaggaaagtgtcttttcataatatgaaaaaagagatccttattcttgccagtatggtttgggttcactaatacctaattatccaccatcattgacttttattatgattggttttctaataggtgatattaatattcagtgtttgaatatgttccctattagcatgaggaaaagccaataatgtgacactaatatcatatttaatgtgatttattattttaatttttatgatggcttttgatcattccatatttttatattcacgtttcaaggttgttagacttttttttcccaattacttctgtttttgcataatcagtgtcattttacctaatagcatctctcttagatgagtaataatgctccatcatgcctctttaccaacaggaagattcagagatattaaagtgatttacctaattttttggaagttcctaacttctgttttgaggattggtgctttccttcttccttccctctatttctcccttctttttgttctctctctttcccttgctctcttccactcttcctcctgtactgttattttcctccctgtttttcttctttcctctctccctccctctctgtcttccttttctttcctccctttttattttttccttctagagtaaatagtattagaaaaattagtttctgcttttttaaaagaggaaattgtacagtgtaaagtgatcatttatattcaaggaaaatgctacctaggacatgccttatctcaccccagttctcggtgctgctaagagggtttgagaagcatgggataagggtggcggcaatgtggctgcaacagtgccaggtgagcaacccatgtccgcacgcctccactctcatttcttgtctggactcaagaccccagtctaagagtggcctataattctcctttctgattctctggcaacaggtgaatcccatgatccctgatgttgacatcaagcaaaagaagccatggtctctagccagtagattaacaacacagcatcttgggtgctacagcactaagataagcttaatcatcttccattatttcatgaggttgattggaatgagtgtgtgattggaagggaacagatggggacaaagagtaaactctacatctctaaaatctaactcaacatctttttctcaaacctgaccctttctccagatgtttttgtttctgcttcatttcagcattcttccttccagtcacgtgtgctcaaagtgccaaagttatctttgactcttctgtctttccatcccagtttcataaatttttcctttattctgtttgtgcaatccatctcttccactcaattttgcacctctatttgcttctgccctcccttcaccccacaccaactgttgaggcttttttctttctttggccctatctctggatttttcttattcaatttcatttcaatgtccgctgttagtttaatgtactatcttggccaaataagctttcactccaaatccttcagtgtttttctattagatacataataaagtaaaaatttcttagctcagagtataaggtctttgataatcattccttactcacaagtcctttggaaccatccaccttctaacaaggtaagcctgccttcttgattgctctctctctctgagcattggctattacgattatctctgcaagtcatattttcacacctgccctcttgtgtatgcatgtcccccccatgcacatatgcatgtacccttgcctctgaccttcccttcatattactctctgaattacaagttcctgataaatatcttaatagtgatgctgatgaagagaaagaatagaacagatttaaaggggaaacttctgggatggctttctggccagaggcttatcgttggaagtgtcatacttacccttttgccattcacgggagatttactaaataaatgcaagatggacaatgtcaaatcatatcaactctcctaacagtgcagcaaacgtaatataggattgtgatatagcattggtaccaaaaatgtgaaattatttatgaaaaaacattttctgtctttgagctaggagcatctattagaacaagaaaggaaaacaaatgcctacaattttgggtcttttcatatcaacttggaggcaaggacagtggcttagtcctcttgtaagatagcatctttcttccattgtttgttgcccaagctctggtagacctctcagctttttatggcctgccagcctctaccttttccccaggagttgtgatacttacagtattaaccaacaaaagggcacaatgttttacatcttaaattattcctcttgcacagtctgattaaagcttgacaatatgaaaagcagatgacagggccaaataaaccagccatcacttgaggtcacccaccattttccagtgtaagtggttctgaaggagtatcttttcttactttgaggttgctttagagacatatagctcaggtcttaatagtcagtccaaactctcattcacagagcattacacaagtgtattccaccctggtactttgttgggtttctgttgaatcccaaaacactgcttaaactcacctcaattacagggtcagcagtgcatctgcaggcaacatggcttctttgttatccctggtttgttttccctggctcagtgacagaaacttgacagtccagtgtaggttaaactgaatgagcattttgtagcataggtgctagtcccaagtctctccaaggacatagggctcaagtagagtagactttattaatgtccatcaaaggtgaacctagtcttcaaaatgctgcctgtccctccaggtgcatcaaagctactaattaccattcttccttccttccctactttggatgggcaatgaagaaaggagagagggtaaatgaaagatattctctttactctgtaatttgatatcacagtaaaatcctggaaaagatgttgttaatattcaccaatgaccattatccctgccacagtctacccactaccacatccaccaatctcagagtgctttgaacataggtttcaaacataagcagaacactggaagtatgtgccaaagaaaatgcatttgaatgtggtccattatttaggaacagtgagtttccaaccttatttgtctttctgttgtctatttttgtcatttcttttgtcctaaaacaaaaattatttttcttttttgaaacatttttaaaaattctataattatattaattcattcatttacttatttatcatttaattaacacaagggttggcaggctttatctgtaaagggccagatagaaaaaaattaaatattttaggctttgaagaccgtgcagtctctgtcacaactacttatatctactgctgagcatgaaagcagccacagatagtacataaatgaatgagcctggctgtgttccaataaaactttatttacaaaaagcaggaagtgagctgttgtttcccgacccccaaattaacatatttgactagctcctatgctttcattaccatgctagcttcaggggacacagatgaatagaactttgttcctgccttaagatgccaataggttaatgtttctggaaacaaggcaggccttcgacaaagtcacttttggtgtccttctatctctctgctgctccttttcctgccactttctcagacctagtactgtccactctgatatgccatccagatgttatgtaatgccatggtattacataaatgctctcccattcctcttctattgcaacttgctgactctcagcacattgtcttcaactaactggaagacataataaaataacgtacatcaaggagggaatcactggcagtagcttaatttgttcatccttcaggagttcttacatattaaaagaggatattttaaattcacagacatctacctctacttgtaaaattcccggcagaggactagaggaaatctttctgagcagggaagtccatgacaccatctaaatctcacagaagtgaacataaatttcctcctgtgactaatgaagataactcacatgtattgagtcactagcatagcagtcattgccctaaatcttccaggtaagatttactttgagctccctagtagctctatgagtcaggtgccattattagtatccccattttacagatgagaaaaccatagctaagaggggctacataacttgataaaagtcacacaactctcatgtgagatcgtatttgaacctaagtagtgagcagccttaatactgtaattatgaagaagcaagtcttctctaaatcagacatagttgagctctattatagaatcttagaagaggaaggacaattaaatattgcttagtataatcttattttaagaacaaggacaccagggctcagagagcgttttggatttgacaaagtagcttcagactgctggaagtaaaatgctgttcttaatgagttttttattttattttatttgtttttgtttgtttgttttggtcttagtaccacatggcctcttgacagtatagcaataaagggaacatgaattgattagaaaatgattccttcccgctgggacattagtctgtggaagactataacatgtgcgactttgctcttttatgctcccactcatctttaatcatgggcctactgggaacacctcattgcccctcattcactgggtggttgagtcttcgtgaagcaaacccacatgagttgttctatggaaggggagagcagaacggtgcattccatcattaaaatttcacatctaaacaccagtgcctgactatgctttctctgaatttcccatagggttattgaaagctctaacaaaacgtagttaaggcaaaagatagctgtctgttttataaagaatgtaaggaatttcccagtcagatggctcaaggaaaggctttacccgagcagtcctactttccatagcaaattccagttggttagagcaaacactgtgacaatatctattgttcaattaaaagtagccacaattatacaaaacataccaccatatggcatgtccttacatctcatgtatactgtagatactattttagcttcttgctttttctttttcttttttctttttaatttttttttattttgagataagagtctcactctgttgccaaggctggagtgcagtggcatgatcacagctcactgcagcctcaaccttcagggctcaggtgattctctcacctcagctcccaagtagctgggactacaggcatgtgccaccacacctggctaatgtttgttttgttttgttttgagagacaggttttcaccaagttgctcaggctggtcttgatctcctggactcaagtgatctgcctgcttggcctctcaaagttgggattacaggtgtgagccactgtgcctggcctagcctcttgcattttctatgggtgcattttcataatagctttttaaaatcaaggtagatcttagaagtgaaagaagatataagaattttatatattcttgagatataggaatctgatagtttcagttgtcataaagccagtggaaattcacagcttcaatgcgtacatcatgttgggaatttttctcctccactgtttctcatgagggtgggtttatagagttaaatagcaggggtatcttcaccaactccactgttggcattattttctttgaaaaaagtgtgcagagagatattatataaacaatatgacaaatcccttctccgtgggccaatttagtaaacttagagcagagaaaaactatagcttcttgctgctagaagtattacgcagaacacagatagctcttttcagtttcccataccgagagtcaggtaactgagtggtactcaattctcaaagcaacaagaaggctgaatattctggaaatccacaatgtagtagtaaaaatcaggtgactttggaactacatgaggaagaacaataaacaaattgctaattattccctgcctgccatcatttttatttactgagatttctattcctatctactttttgatttattgagattttaagggaatagaattttgggggaggttgttcagcaaatatactgtcaactcatatcattctcttgattttttatagaagaaattgaggtgcaaaaaggttaagtgctcagtattacattgttattaagtagtttagctggaatttgaatccatgtcttctcattccaaccaagagactttgttgactaaattaggctactctctatggtaagtatatgggcacaggtaggtgtaagagtacagttgtagtggtgttagtggtagtggtggtgaaggaagaagatactgctcatctctcctgataaatgcttacgagaatataaataacaggattattatgtcagttaagaataggcttacctgtaaacaacagttttctcacaattccagagttaagttattcagggttggtatggctcattagcattgtgaaaaaaagatctaaatatcttctctctttttgccgtcttcattgtgttggttgtggcttcatggggacaggatggctgctgcagttccagcaagcacaactgtgttcaagccatccatgtctttgctttcttgtttgtttgtttgttctgttttattttgttttgttttgtttttaagagatagggtctcactctttcacccaggttgtgcagtggtgtaatcgtacctcactgaagcctcaaattcctgggctcaagtgatccttctcgcctcagcctcccaaattactatgattacatgtgtgagccactgtgtccagcttcatattgttgcttctgataggaaaagctgatatttatctagagtccctaccaatctcttctgctttcatttcattaattatcgctgtgccatatgatcaccccagtatcatgggagtggctatctcccctggggctgggccctttgacttccccaagcagacagggttcagttaggctgaaaagggaggaaatggatattagacaggcaatacaaattgttgacacagttcctaatagaatacagtcaccctccttctacaccccaattcagaggtttggtttcattgtcaacagccaccatggttttatcctggtgattttgtcaagctgcagggaaataaaaggtagctgctctgcaaaaggtgacagaccctgatttactacctgatatgttgcttacactcctgtggtgtttttccagaaagaaaaatgaacctggccctagaagtctcactttgtggagcatatatctagcatgcaatactattctactatccctcctgtttcctcgagcatttcctgaacattcctctttggttattttattatttctctagaacatatataatttcagaagtcatctccttttatttgtgcctgttatccagtctttagcgtagctagatttgagccacccaaatgatggcactcttctttctggcacaataagcattttaagtgaaagaaagagtattagtagtctgagtggttgttttaaaactaaggttgactacataacaccatcccagatttaggccttgttgtgattggctttttcttgcactgagaaatggatatttaatgaccatctcactatgtcatagatgcacttccttaagttgaaaaggcctccaaggactcttcccaggagaaaaaagaaaatctgagttggagcttagcaacatccagttctgcatcaagcaggcctctctgctatgagaggggtcattgtttcaatcccctttgctgtggtggaccagcagctgtggaacccacccatgttcagggaccagcagcaatgaccaggaaccacgctggctgactcacacttaactgccctccaagaaaattcactataaaagaagtcaggaagttgaaaagaaagacggttttccttcacttagcttttctgcttaaggcttagaatcatcctgtatttgtctcctacattgaaacaacaaacctatttaagcaacctataaaatataaatagattttctgtagtgtagtcggtgagctttctcaggctgagttagtgtggcagctgccccagtttagcttctgcataggaaacaaggctctgctgaaaatgctgaaccccaggacaccctcttccttagtgtggctcagcacagatgcttgttgctttctgaaagcatccactgaccccatgacttagctgcctgaccctcctggaagtaccatgacacacttcacttttgttttgtctttttagaacttatgtcatcatttggggttgagcattttattgtgaaggctgcctagctcactgtggcatcctcagtgcctcctatccaatgcaaagtcaatagatatttttcaatttaaactggttttgtaagggaagccaggtatgcaggattaggataaaaacaggaataaggggacttctgggagcagttaatggttgaatggaaggggggttcaaggtgccatggctttgggtcttttctccattattttgagatgccatcatataggctacctttggttattcatcctattccattcccaataaatgaacacatttgcctttggcatatttgagcatgccctatcaaaccatgagagctttggtattaaaactctcctggtcggtgtccgggttttaccagaaagcactgactaagaaaatggagaagcatagttgcaggcctctcatttgtgccccatgagggagggaagagaaatgacagaagtctcacagctagagatctcacatctacttgtgtcccctttgttagatgtaaagccagccacatgagattacattcaccgtcggcaactcaggtaacggatctgaagggcagcttgttctttttttttttttgagacggagtcttgctctgtcgcccaggctggagtgcagtggcgccatctcagctcactgcaagctccgcctcccaggttcacgccattctcctgcctcagcctcccgagtagctgggactacaggcgcccaccaccacgcccggctaatttttttgtatttttagtggagacggggtttcactgtgttagccaggatggtctcgatctcctgaccttgtgatccgcccgcctcggcctcccaaagtgctgggattacaggcgtgagccaccacacccagccagcttgttcttaagaaaggaaagaatacaagccaaagcagagcaactatctttcacgggggctttcatagaaatgttttcatcggtacagtttggcaacatgacctccaaggacaagggcccttattccactaatatgagctatgatggcttagtggttaaaacctggagccaaaaagcctgggtgcaattacagaaccacactttgctgctagatggtgctgggaaaattaccaaacctctctgtgtttttcatctgaaaaattgggatgttaatggtatctatgtcatagggctgttaagaggattaaattattaaacaattgtaaaatacttagaatagcaatagggttatagtatacatgtttgttaataaattaccgagcctgaataaccaagggctttgaggccgactatagaaaacaatagagaaattgtagttataggatccaccaggtagatttcagagctggacaaaggtgaccaggcggtcagatggagaccttgggggaatgatcccagtgatggatagttgagatgcagatcaacaactgaggctgggcattctacaagtctgaaactagcaaggattgtgtgaagtttgtggatgttaagaaccttaaatttcctaaatatcatttattctttttgaaacaagatttgcctgtggaaatgctgtgacattttccaagctgtgcttcccctctgcaccactcatgacctcatactccttggcggcattttccaggtcttggtaacctcccttgaaaagagaaatatagttcagattcgcagcagtagtctaagccacacagctgctatgggtcaggggagatcaattacatttcctggggttctcttcaatgggcggtggtcttgtgcacacggcattatagatactcatccttggaacctggcttgttgaaggttctccagaggcaagaggaagttaaaagataaacttggctgtgtatatcctatttcataactgcctaaatagtaagcatgctgactggcaagaattagaactataataaatgcaattaaattgcctattacttgcataattgagaactataaatattttaaataataaaattgtgaaaaatttctctactaatgctctgggaatgtcttaaatctgtaaaggccaggggattcatagggatggctgaatatgaaatctttccattcatctctttgagatcaaatatttttcatgattatttcaaaaggctccaaaatggaaaagagtgaatatgtgagccgccatgagaaaggaagcccagaagagtgagtacagggtagtttttctgggaagatgtatttaggaaatggggcaagagcaaagaataaagaagtgcaaaaatagaactaatttgacactgcatatgtgtccttctccgttgctgtacatccttttttgcttccaaagggcataatttgatgtgattaaataaggccttctgctttaattaggtatctcagtccttgaaaattctgattaactttctgtgtatggaaggcaggagatatttaaatatgttgagagaaatacaagagcaatagcaaactaataatctgaagagaggtcctcttaacaggtgttttttttgttttgttttgttttttgtttttttttgttttgagatggagttttactcttgttgcttaggctagagtgcagtggtgcaatcttggctcattgcaacctccacctcctgggttcaagcgattctcctgccttagcctcccaagtagctgggattataggcacctgctaccacacccagctaattttttgtattttgagtagagacggggtttcactatgttggccaggctggtctcaaactcctgacctcaggtgatccacccgcctcagcctcccaaagtgctgggattatagctgtgagccaccgcgtctcaccttaagaagtttttaatactcgtacataaattcaaaaggagaagtggtatttgttctaatattttctataattcagttttaatatattggcatatccaagtgtgtttgtgtaggtctgtgtgtgtttgttagagagagagagagagaaagagaagaagaaggaggaggaggaggacgaggaggaggaggagagagattgtattattcaattacagcagacactgttagttttctgtgtaatacccacttttacttctttgttaacaatgaaatctcaattttatttgggatggaaatgtacccaggtgtgaaaaaacacatattttccagactcctttgcagctaggtgtcattgtgtgtcatggttctgggccatgcggtctaagtggaagttttctggagattttataaaaatttttgtctcttaatatgagcagttgccctgatttcttgtcctttcattcatcttcttgcttggaacttagcccatgagattgcagatggagactattacaatgaaaggcccatcctaaggatggcagacagaaataagagcaagtccagggcattaatgaatttgtagaactatgtcttcaaccgttatgggagaaaataaattcatatttgtttaagccactcatgttaactataatggtgcctacaagggaatgtataaagcaatagagcaagaggagtatcagcaattttcattcattaaagatctacttccaggactcaaataggcatgtcttatatttgatgcctattttggtggacatagccattttgaaatttacagagatccaacccatgctacaatacaatatttccatctttatagtgcttgagagtacatagatgggctgtagacaactaatatgtctgcatacactgtattcacttttggaataattctagtttttttgtttttactgagtagggacatcttgatagaaatttattaacaggattttgattttatgtaaaatgcatttaacttattttttatttgctgttttctcaatatcttatatatttagtattctatgttatattttaagggaatcttattggcacaattgtttttaatgctactgtgtataaaaaagaacacattttagaagcaaattgtaattagtaaaccaaccaatgttaaatgtttaagaaactgtaccagggaagaggacatagtacaattacagtagtactgacaattacggtaggaccacacatgtggatgccaatttatatttttacccactgcaacctctgggccaagaggtgaagttaaaaaccagtctctggctgtttcagagagttactactccacctgcttgtaaaattctgtctctttgaggtttttgccattgaactacctcccctgttatctacccacttctgcacactaactttcactgaccaaagactttcacttaaacccacagtcttcctttctctctattccaggccttgctgtcctcctgggttatttctgttttcatgtgtgcaacccattcagtagcattgactctcatttgtgggatatcatatcgttccatccataaagagttcagaatccacctccaaaagatagaaactccatgaagaaatagccaaaaagtagcaagagtctaaatatctatcagcaaaatgtagtatatttatacaatggaatattattcagtcataaaaatgaagtactgatacgtgctacaatatgagtgaaccttaaaaacgttatgctaggagaaagaagccagatacaaaataccacatagtgtatgattacatttatataaaatgtccaaaataggcaaatccatacacacagaatgtgtattagtggttgtcagaggataagggcagggggtaatgaggagcgactgctaatgggtatggggtttctttttgtagtcaaaagtgttatggaattaggcagaggtggtggtggttgcacaattttgtgaatatacaaaaaaaaaaaaccacactgaattttacactttaaaatgattaatattatcttatcttatgtgaatttcatctcaatgaaaaaggagattgagccagttatgttgctaagtttggaggaggtcaaagcaaataaggtcttctctttaccctcaaataactcatactgcgcagaggggacttccaatgggcccagcaccgtggtgtggcccagcctccaggagcaataggatttcctctcagatgaggatctgtgtaggatcaaggcagaaatctctactgaagtctgtttgtgtcacacacttgtgcatgcctgccttggagtctgagctctagctttgtcccagtcttgtcgccttctccaccatggggactttgcacttgtactcctttctgtgggaatcctgtttctttactcctcctgtctcgttaattcctcccaccttgcagattttagctcacgtgccattgccccagagaaatcttcctaccccgaccttcatagtcaggttcaatcaccaactgtccattctcttgctctcttgaaattctcctttgcaacagcttttaccagtttcccacagctgtaattctttcactcagttgtcttttcctgccagattttgaagttgttgagggtaggtactcttcaaaacagcaggcaaaggtagtactcagcccacttttgctcaccaacataacttcagcgcttcttagtgtctgacacgcagtaaggactcagtgaggacatgatgatcagctgagtgagtgtctgctactgtctacccagctacccaaagacatacgccgttagggacttccgagaggagaggtttttcccctctggccttgacaggtcctttcactgccacatcctttctcctctaagttgccatcatttgatcatcttatcctcacaggaacccagtgaggtagtttgatgccgttgtcatttacatttgaatcacctgcaatgcaaagtgaggataggatgactaaatgattaccgtgctcagggaaagtgtccagcattattttattgggctgttaggtcatgtccagtttgctcactcgaatacttcatcatattctgctgccaggcctataaatgtcaaatagtaacaacccttgacctcctggcccaaagctaagcatgttaccagatgagcctcactgaccttctttaatatgagaatctttaatatggattaatcatattataattatgtatttgttctttttattagagtccttggggaatgtcttttaccgaagaaatgttatcttacagggtaataagaccaaatgggcttttattttttaattaaaagaagatgaaaagttctgcttaaaatacttttaaaatgccttcatcttgaaggtaaatggcagacatgtatcattttgcacttatataaactttactaggctgggcaattgaactccaaaatgaggctgatagctaatagaacatttgtggaggagacaaacaaattgtccagaataaacaaagcttatgtttatttttaattgatagcagctgagcacagggaggtgtcattagctcaaggcacagatcaaactcattaagtaccctggccctcttataaatcatgcgacgtgtcgagtcttgaattaaaccaaacaagagaatggttcagaattcttcccttgtaccagcagaagcatggttggcacaaagacccttggagaaagattgagcaaggctgttccccttagtaacttctgagcctacgcagtgatcaacataggtgatttgcctgttcggagaccaagaattggagccaagtgactggttccgagtcctagctcctgcactcccctgccatgcgcagcacctgctatcggtaccttcccgttgcccttcagcctactcagggtgttactacccggctttttcacttgctggagacttcctgcaactcaggcctagaggtgttctcttgctgggaggttgtgctttgttcagttacaggcgagccagaaatgcagagttagccagctagggatgggagttggtgggtaaacacccttgctaaatcacccctcaatggaaaagttgtgttctacagagttcctcagagcacccccaacaggatggagcaccagcagccacagtggtaacctgttcactagtgtacactctcacttttcttcttcacagtgctttctgtaattgcctcccaaataagatactttttccaaaatcctagtctcaatgtctggttttggggatcccaacttgagaagctctataactgttccttttattcctaggacagtgttaaggaggctagaggtgggtagagaggcagcctagcacggtgcttaagaggacatgctctagaggtggactcgctggccacatcctgactgccactcactaggcacccagcctctctgtgcctcagtttcctcatccacaaaatggggtcagtgataataagagtacctatttgatgggcttgttttgagaattaaatgaatactaaatttatacttttgaaacactgcctatcacataataagtgctcaataaggtcaggtgtagttactagaatcacagaacatcagactggggaagaagtttacagattagctagtgcaacctcttcattttccatgtgaggcaactgaggatcaaagagacatggagtgatttcctcagggtcacacagctcatcagtgacagcaacaccccaaagtctctcagcgcagtgtcctccatgctgcgaaatcagcttcaggacagtcctacttccaaatactctgttaacaaacagaactcggtgtggtcatttcaatttgctgggctttttttcttaatttaggcaatgcaaggcaggaatgtgcaggcattatgtaagattttgaggagtccatgaatttaaaaccagaagttttttaaggggaataaaataaaaatcaacttcacaatgccataggcagaatgtcctcttgaagaatctaagatttagacacaaatactgtcttctgcagagtcctttacaaacttctgcttaacctcctggcatcaacggacgacaggttctggctgtgcagagtggaagtcccttagagtatttgacagcatttatctgataacagctcccagccttggtagtattcacttgtttatggaggtttgtacaagacagaataaaataaaaatgcatgtttctataccagccctttgctttttaaagtcttttttatctacggttccatgcaaagtcacatgttctcttcttccttttgatcttaaatgaggaaggggcaaagtgtgtgaagattccagaagaagtgaatcggagcaaagtcctcactaaatgaaagcttcgtcttccattcagccgctgagatcagtggaataaaaccacattagagatgatccccctggcccttagcctccagagagggcatctttcagtgacagtgaatgtgctgctatataaatacacaaagcattgtggaaaggaaagagctctgtggtatggagacttgtcaatatttgtccgaaagtcatgtttctattatcttcaagtatgtctggcaaaggaaatctggagggaatcttttaagaggtaaaacacgttgatttgtgaaaatgggatcattttatctcttctgcttcaaggtaagctctttggtttcacagtaactagttgccaccagatcaagttggggaatatttattcttttgcttcaattcctaaaagattgatattaatgcattaagcctctttttttctttatactttcttcttttctgcaactgataattaaagctataagaaaattaaattactattattattattagaaagctcccatgctagccagttctggttggatataggtcagctgtgtacaaatggacacactgtgaggctttgtgcaataatataaccactacttgagaccaaatgatgggtgatacatatcctaaacctctccctcatcatttttatggttaaattacaatgattgagcatcaagcttgcctaagatttgactactctacttctttgccttattttctgtatattaagttgcagggaaggtttttactttgcaatttatttttcctcttgaatagtgattatgtgaagttctaagcatcacaatgctgcagtgtataattcttcaaagcaggagaatcagagtgtagcaatggaatgcagaaaaaagcaatacgagaaaggattatttgtttgcatctgtaagaggataaagatggtttgaacatttgcttcatatggcactgatatgagcatacttacctcatttgaggtgaggtttccccagaagcagacagtgagaccagtgaatgcatgtagttgattttggaggtgatgctaggatgcactgataggaaaatgaggaagtgatcatgagaatggcaggatccgatacagttgcattattaaacaagttcctagaggagggctccatccccttgggattcttctgatggactgcatgagcacatctagaattgtccctcttgatatccatcacctttcttccatcacccatacacagccagagagtcacaggggcttgcaatgagaaggcactgatgtacatgggaacagtgagctttgaggggccacgggtgaaacatcaacagcgtgtgttaagctagaatgataactggctggttgaactaagtaaacaaatccaagtgcaaccttggaacctgggatattaaactggctgccaacattgggcctacctgttttctgtcttggtctggatttattcctcgtttccttttatttctttttctttaaaaaaaatcttttttccttctagtttctctataagattttttgagaatgcgtagatatacatgatggaggaataataaaaacactttaaagcaatagatgattcttaccaaacttacatggataaatgtaataggagacacaatttcagctgaataaaagccttactccaccactctccaaaccccagaactgttgtacagttagctttttagtacttacgactatctaatggatcttgacaaagagaaatataccatagcattgcattaatttttgagcagatagtatattttgtaattagatttaaaaaaacaatcatgtcttttgttgttaatgggttaccttccttcggtatatttgatgaatatcatctctcatggctgctcctgagtcagtctcttcagcaacctgttcctcctttgttactttgtttctgctcacaactttcagctccatcaacagtcatcaagtccatttggcaaatattgttagcctctggtagtggcgacaatacatagaggtgaaaatattctactgatataccactgtcatattaaactctatgttgcaatacaagcaattctcagactgaattctgtcacacacacacacacacacaaagcatcaatgaggaagtagccacaaaatagtcatccagtcttatcctgtaaacttagtgatgttcctccatctgcaagcacgcttgcaggaaaaccaacacgccttgcaggaaaagttcattttgagttgccaaacctctaggcaaaccaggctgtgaagtcacccattcaacatatgatcatgagaccagacagagctctggacctcggcttggctcccaagatcttattgccagaggctctagattctcatatatctcgtgcaagagcaatggtgccgtacaatctttttaggcaacaacatatcttgaacaccaatcgtttcaccaattgaggcatatttctaatatatcgtttgcttgttagctaaacttatgctattcaataataatagtggatgatgtagtcatctttggagggtgagtacctgattagaatattacatgttaattaattgccaccaggatatgtatttacacacacacacacacacacacacacacacaaagctgagagagagagaaagagatttttaagctaccaacacagaaattctttagaaatcatgatttacctttcctgtcaaaataatttgaaatttcctattgttaatctgaagtttcagtaaagagaattttattattcttcacatatagtatttctgcttttactgaaatggcttgctttaggaatttgccagaacagattttatctgccaatgggaaaaaaaaaattagatgttgaaagtcctgtttgttatcccgtcatcaaattcctcttttcaggtaaattttgaaaggttgcatcctgccagagagattttactgaattttctcatctgtctttgaaagctatactttatcctacagataaaactatgattgcatggatttgaacaagtcttatagaatcccttacatataatgtttagcctaataagattggtattggaattgtccccaaattatttagctagtacataatgctatatctataaattgtgataattttatgttttggctacagttgagttttagactctgtatgcagctggggaaaaagtatgacctactgggaagcatcagtgttttcttgcaagctcattcttcattttccaacccataatccccctctgctactcaaggaagctgaagcccaggattaatccatcggtgtccaaaggcctgcaggaggtcaggcgcagatggtttaatccttggtgctgcttggaatcatgggagtgggtgttggatggaagtgcctctgatctagctcttgctgtgggtgtcttgcacctcttgacacacctgtggctgcctggaggttgtcagcaccacccaccactctcctccctgccttctccgttgtttagaattcttgctatctagtgggtgacaaagaatgtctgaaaagttcagttgctaaatggatcaaaattagtttctcactagttctccaaaaggtgcaagtgctgttggaaaaagagctgtaaacaatattagttgttgctgccagttggagcctcataacaccttataattttatttctgttaatgagacacatgaggatctgtggagttcagtgggatataattttgcatatgcattattaaaaaaaagaaaaagaaaagctgacataagggagataaaagatcaagaagcgaagaatttccagctcatttaatagagacattgaatacccttatgcattgccttttgactatgccatctcttgtcaagcaattataaatacttgtaactaaaacattaaagcatagaggttaactaaacaaagcatcagcacattgcaggctaaagaaaacccttgtttaaagtgatttccattttgattaatttatccagataaaccatcaatttcccaaagttggagactccgtagatccagactttgttttctacgtgaaaactgacagttctctggaactgtagcagagaatatggtaccatttaaattatcgagactgtagggcaaaatttcaggcctcttaaagccagaaaaatggccccagtgagctctctcatgatcagttcattcttctgggaatctcaggaattactatgtctaatgactttgccagtgggtctggcctgtgtaattaagatctaaatatatctctatgttcattctataactaaatttcttatctggacaaatgacccatttatgaaagctcataaaatatcatagggagtcattacatacttaaaaatctctctaataaaatgtgcccaaagatggtcatatctgcattgctaataattttccaaaaatatgccttaccataagtaactagaaaatactgcatattatcattcaagagaagaaaagtagaataaagatccattagtattaaaaaagtatctttccttgctttaatttagcgaaaatacttgcatttttcttctgctctttcaattcctggatgtgctagcacagccaccatcacatcaacataatcttgcaagcttgtgcattcactgcagaaggcaaaatgtcatggcatttctttatgaaaatataaaacttttttttttgacggggcaagtttcgcttcacatcaaaggtaaatgagaatcaaggttgaaattgcaggcacttcagaattctgaatggaatactggagtgaccagactaaaggaaatacaccatatgtaaaggaaacattaactctggtattttattcccccttagtaatttccgaagttattgattagtagctctaatcttatgaaaatggttcattgtgtctcattaaggatgacttcatcttaccaaatcataacaaggaaggagtggaggtagagatagtagaggaggatgaaggaaggaagacttcccctcagttagaaactacacaagggagaaaagttatatgtgattggggagtgttatttaatgtttactgagagttccaagaatctttagtgggattttaaaaaaattgtaagttatctggtgatttatggttcaacctgaaggcaggagacaaaattcatatgtttgtgggattttttaaagttcataatggtctatgccttctaataatgacaaaattcttggaagcctctcagatcactgaatcatagtctttagaggtagttctcagaaatcactctatacagctctcaacctaagaagagccatttgcaattctgacaagaaacgataccttagcttttgtcttagctcacacagaaaagcacctgaccaattgacttcctcaccaggtagcatgcccatgctattatatatgtatatatgttaacgtacatgtggtttatatcatccaagtaaccgaagtcaaatggtcatttaatatagaattggaggcaccatagagcagctgagtcaagcctaaactgaggttatatatatcattagatttttttaagtacaaaagactaaaagtgcatttctttcacttttactgccacttggagttaagtttcctgtaatttgcagcataggacactttactgatataagggtcaccatcagtacagggatcagaattgtgaaagttcttagtttgaagaatcagtagtctaaaactcttgctactcagactgtaatcccaagactgtcagtattggtatcatctgggagcatgttaatcatacagaatctcagaccccaacccagactcactgaattagaattttcattttaaccagatcctctggtggcttgtctgcacatttatgtttgataattattctggctccaatttttggaatatattgactgtggtctaagctgtagacgtgtcatggacaggtagaaaccgataaaattgccccactaggaaacaattgagtctgtgataatgacactttatgtgaacagaaggacgcatgtgcttatcaggatgagaggagttaggtatttaaaaagggcagtattgttacaaggtacaagtatagagcacacgcttcatcatccagcctcttcctggttatccttaacctctgtgtagcttttgaagatctgccacttcaggtatccgtatacgtgaaaataataatgccctactccttgccttcccaaggttggaattaatgcaatgatatcatgaaagtagagcctgaagtagaattattttctatttacttgcttctaaatatgtccacagatcagtaacattagcatcacctgggaccctgttagaaacataatttcagcctgccccagagaaacggaatcagaatttgcattttagcaatatgcctaaatgattggatacacattggcttttgacaagtgctggtccatggcactttgtgaaccagggaactccctgtacctggagaagtttagatgatgcttgggtgagtcccatcaaaaatggtggagaggggagccatgtatggtgcatgcggaagttagaacaaataactacagggccagttgcaattctgagttagatatgtgttcttctagaaaaacactgaaacaaagtttaaagtgatctggagtggtcaaaggaataatttacagattttgcagctggatgtgagctagagatcccatgaagatatgttagttccaaaaggaacacattttgtagggtggggaaattttggtcagttctttggagcttgtgggaaatacatctctagtgaagaagtcttgtctaatcattggcttcttacttgtcctcaaaaatgttcctcaattacattaagtgatgtttgttactaacaaaactgtcattttccatgttgaaggatgtgtcccactttcagagaatcccaaaaattaaaaacagtggagggagaggaaaagtgatgggcagaaatccttccacacactttaaaggaatataacacttggctgtagtaagttttatctgagatagagttacaatctgctatggataatttttattttgttcatccttaatcaagatgcaatcataagattgtgatgaaaaattaaattcatcactttgtgaaattaaacttttgatgaagtcaaagtctagcagaactagtggcggctaaaagtattcatcaagtcaatacttgctccatccattcagctatccattcctccttccatcttttcttccatccatcatccatatatccatgcaataagtgaccttattacctttctaataagaatgacaatctagtgtatggactaagttaactccctaggagtagaaagaaattcactctctactcttagtgaatcctaggtttgtcacattttgcaaaaccaaatcttctcatctttatggtttgctcatctcccagtgtgggagccaaccctggcccgctagagcatttatttagtgaatggccagctgcttgctcccctccttgtggttgctggttggattaatgcagtgaacactgagaaatgtggagaaataacttacctcctggggcctgagctgtcatatctccttgcagactggctgctccccatcttgttctttttgctcatttccataatagactctggttgataaaactcttcactgtgattgatggtccacaaagcacagccattttcaggccacgagtagcaatttttaacttgggaaatatgactacaatcaatttctttctccttttcttttcttgctttcttttattttagtcatttctacagggtgtgtcctttagacatctctttcttggtcattattccctaattaattcccttgttaaatataaagtgtgcattagccttgactgatgtcttcctttgtgactaaggaaagaagaatttattacctttacgtattgaatcaagctgcataatcacaattcatttgtttaaagccctcattcttcataaaccatactagagtttaggccccctgcagctgccaagaggatctcacctgactttcataaatatgatatggagtcaggtgtttgcacatgtaattggtttaaaaagtggctgtattggctgggcaaggtggctcacgcctgtaatcccagcactttgggaggccgaggcagtcggatcacgaggtcaggagatcgagaccatcctggctaacatggtgataccccatctctactaaaaatacaaaaaattagcggggcggtgggggggcgccggtagtcccagctactcgggaggctgaggcaggagaatggcgtgaacccgggaggcagagcttgcagtgagccgagatcgcgccactgcactccagcccgggcgacagagcgagactccgtctcaaaaaaaaaaagaagtggctgtactcacatggaaacccatctcttcatttatgtaatgatttcaagttcacaccatgaaatcatggaggggatgaaatggaattgcccagtttgttgagagaacatgccgacacttcaagggataaaacagacgtgtcaagactctgcaggcgtgaaatctgcatatgcgttggtaaactagcaacctgctccttctccaattatgtggttctgtgacattagtaaacacagaaaaggaccttagctcatcccagggaagagagactgtgctggatatgagaaggatgcagtctgggctacaattatctggtgtagccatacaaaaaaagggaaaaaagctttgattagaaatggatagagtaatggttcgtaaagtgtggtcctgggccagatatgggggttcacgcttgtaatcccagcactttggaaggccgaggcaggaggattgcttgagctcaggagtttgagaccagcctggacaacacagcaagacctcatccctatgaataataataataataaatattagatgggtatgctggtgcgtgcctgtagttcccaactactggggaggctgagatgggagaatcacttgagtcccagcagtcaaagctgcagtgatgcatgatcgcaccactgtcctccagcccaggtgacagagcgaaaccctgtctcaaaaaaaaaaaaaaaaaagaaagaaagaaagaaaagaaaagaaaaaaaaaagtgtggtcctgggagccagcaacagcaatatcaactaggaggttgttcgaaatgcaaattcttgggctccaccgcagaccttctggatgagaaactggtagttaggccctccaggtgattctgatgcagctaaagtttgagaaatactataacggaggatatttttcttctgtttttttgggagaaagtcacactaatcttcagtttgaagacatgtttaaggctgttaagatctggtaggtggcacatagaacggttttcacactgtggatgctgaaaaagaattctcatctctaaccagttctttctcaaggaccgaggatgctcaagatgaattcttctctttcccttcttcccttgacctcactgactctgttctgcagtggaaagtgcttagaattctgagtcaaaggatcggggcttctgtctgagcttttcttcttaaccactgtgtgactctggggaggttactcacccagtctggggataagaataataataatgctttctgtcagtcttacttggttattatgaaagacaatgaagcccacggaagctgtagaatttacaaggtggtatctttcttcctacttgttaagctttaacaggggaagagactgatagctgaagctcctgagtattctgtccatttctatgatcttccagtaaatattgttgaatgtgtattctctctccctcctaacaactgttcagtttattagcagcctgtcagtgagtcccggaagaggatttgaggccaagttaggtgagaaatggttgattgctctatccatagcacctggcccataggttctttggaacctcaccactggagcctgttaagggttgggaactatttctctctgagaccgtctgtgttgctttgtgattggttggttggtgtgaatagattttcttaaaagcttctcctggaagttagaccttcaacttcctaattaagagacactggaaggtacaacttattaagaaaaccagggattgactcaaagccaaggatccataataacctccacttgggtttgtttaaaaaaccttcggaggcactggacacgtgaaagacagaatcccaaggaacactgccttcttcttaaggggcctctcactgaatcctttcccagttgtttgtccttggcagtccctcctgggttttaatccaggtctcaggggggcctttcttccttcttgtggctttataaagatttacctgcttttcctccttcttaccaagactagctggttataagcaagtgctctgtttcctctgaggttctgccaaaataaccctgcaggtttattttgctttaaaagctctactgccagccacaccaagggaaataacaatatcaaatgtcttaggttggtttcctcagaagcagactctgggataaggatttgggggaaagagatttatgacgaagtggtcccagaaaacacaacaggtgaaatgtgaagaagtgagagtgaaaggaagagtgggtattggggcaaatcccaggtgattacccaaggccacggggttgctctccagatggtgaaggtcacccttcaacattgtccccaccagggcaagggcaaggaatttgcaccctcccattcctcacccatcagtcattggtaaagggctgcccctggggagcatttgattcccgagctctatgtgcactataaaagttagttccagcatccaggggcagtcctctggcagttgctgtgaggggggcgtatcatggacaggggtgaatgggcttggagaaggatgaggcaccaactgtgtcccttagagctatgctgaggaatgctcccaggtgtatctgtcctccagagctcctgcaatcagccctgtgttcttgttcccgattcctgtgtgcaagaggcttcttcttgtcatttaaacctcttcttcagcccaggaggcccccctctcagggtcagttaggcctggcaatggccatgagctgtgggccttttagtctcgagtgggtaatttacttctcaggggatttgaaaagattgcctcttatgtcaattttcctcgggctctgcaccagcaaagtcacctaagggcgtccccctgcacttcccgcctcttagtgccaggtatgcagaatgtgcctgatacatgttccttaattatgaggaagatggagaggggatacttacaaaattagaggtgattaaggtcattgaagggtcaccatttggggaacattttcttccagtagaagctttcatattgcccaactgatttgccgttaatatgagcagggattttgttttgctttgtttttaatctttgtttcttccctttgcttctatataaagggagtttatagatgtaaacattctagaacaggatgcacattctcttgggtccagcaggtttatggagacctgttctccttttcacatatgtatgatttacagtaaaacattcctacaagtcacacaagcaagctcaggcaaaaatcaagttcttccatttgctggttccaacattttgtatcctaataaattcatggtgaaactaatccagctgtcttctcggaaaataaaaagtttgaaagagggctgctactattcatggccatgtaatagtttgttttatactgcatggagtcgaatagttataaacatgaaagcagctggcaataaatgactttacgacagctatttcaaaggtataatgaagaaaacaaaaagaaaccaagttattacttataattatagtgcctcagtgagttcgcacaccacactccaaacacttcactggccgtttctatgtgatctcatgcacagtctcctacaaagaaccttggcctttgggtcagttagccttgtgggtgggatgggcactgtaatagtgtttgcacttttgaatgcagtttttgaaggagacggcatccttttactatattcacccatgcgatggggaaaaaaattgaattattgactattctccactgttaaagagattttatattgaaaaaaactttaagaggagcaatttggtagtatttttaaaattttaaatgtgcttcttctttaacctaatggttaagtgggttaattttatttctaggaatagatcctaccagaatatattaggtagaaacatctagagtgttggttgtaacgctggatatgggagttcttgcctggaatcccagcactttggcaggccgaggcaggaggattacttgatgctaggagttggagactagcctagatagcatagtgagaccctcgtctttccgaaaacttaaaaaaattaaccaggcatagtggtgcgtgcctatggtcccagctacttgaaaggctgaggtgggaaaagtttaatagtttcagtttgaggccaaagtgagctgtgatagtaccactgcatttcagcctgggcaatagagtgccgtccttcctctaaaaaaaacacaagggtgcggtggctcatgcctataatcccagcattttgggaggctgagacaggcggattgcttgaatccagaagttagagaccaacctggccagcatagtgagaccttgtttctacaaaacatgcaaaaattaaccaggtgtggtggcatgcacctgtagtcccagctattcaggaggctgaggtgagaggatcacctcagctcagggaggctgaggctgcagtgagccataatcctgccactgcactccaacctaggtgacagagtgagactctgtctcaaaaccaaaacaaaacaaaaagaatatgggttgccaggttgcatgttacagcaaaatttacacacagcctacatattcatcaatgtggcagtagttaaataaacatagtataatcataccatagactagaatatgctattagaaacatatgaggtagatcaatatacactgacattgaatgatctcctaagacctactacatgaaaaaaggcaagttccagaacataaaaaccaatgtaagctccaatttgtatagaagaaaaatatggcgatgcttgtatagatcttataacttaatcatttattcatttatccacacaacagatatttattgagttccagacaccattctaggtgctggtgatacagcaataaacaaagcaaaggtcttcctgggagtttgcaactcaggaaagagggaattgatgttggggagactgtgaacaagcaaacaactgtgtgtcaggtggtgatgggagttgtaaagagatacaaagcaggctaagcaatagagagtaatttagctggaggctaggaagacctcttcgaggaggtgacatttgatcaaagatctaaaaggaacaagggagaaaaccagggagtatttgggaaatggagtatgccagacagaggtgacaacaaggtcagtggccctggagtagaatcatgctttgtgcacttgaagaacaaaaggagaccaatgtggctggaactcaggagcaaggaaaaagtggaagggaggggctaaggaagcgaggattggaggttatggttgtgattttgaattttattaaagcatgatgggaggtgattacagggttgagttgaggaagaggacatgacactatttagtctttaaaatgtaaatgaatgcagcggaaggattctcactctactcttggcagtgatggcctcaaggagggtgttctcagcgaattagaggagagaaagcgtgtggctgtaagagaactgttctcactgagatctgcctatacctgtcttgttttagccttgtattcatgtgttatttgtgtaattaaaaaatagaatcaattactctttatacgagataaagaaatcctttagtattcctttctgtgaccttggacaagttttctttcttagcttttctcttctccatgtttatagaaagtgggcaatctgtttttgatcacaggcttgttcatgggaatgaatcagataatgcacatagagctctgagcccagtgctcagcacatttcggtaattcaagaaatgacaacaattattgctgcagtgctgctgcctcccatgtccaaacactgtgaggcattcaggatactataaaattgcctgtctctctatcacctttatcttgagctatagagaaggataagaggctgtttcatagcatcacagaatttaatagccaaataagccatctagcccagctctgctccttttatagatggggatagagaggtgctgaggggatatactgttggctcccagacctgtagctagtgagtgacctgtgcttgtgctttccatgtcaaatctttatttcctgcattggtattttcctaactttggtcatttacattccatcttctggtttacctaatattctaattgactctttaagcaattttattttcaaaggaaactttgtatcattgtcataaatggaaaacaagcattacttgttatgatagattataataacttatagttttagcatagttatatcattgccattactacagtaatgctatataaccagcactcaaaaactcagtaatgtgcaatagtaagcatttcttgcttacatggctatgggttggttggggcacagctgatctgagactgagtttactacatctactccacttgtctgtcagcctccctggaccagtagctacatgaggcgtgttcttatggtatagtcttctcattgttctcctccaaagacaggaatttaaaagttgaaacctaaatgtcacgtccattattatcccattggccaaatcaagtcacatgctcaagtctatcatcagcgggatgaagaaaaatatatcccctctgtcttagtcagctcaggctgctataacaaataccatagtctgagtggcttaaacaacttatatttctcacagttctggaggctgggaagtccaaggtcaaggtgccagcaggtttggtgtctgtcaagagctcttttcttggtgtgtagactgctgtcttctttctgtggcctcatatagtggagaaagagataatcttcctggtgtctcttcttataagagcactgatcccattcatgagggaagggctccacccttatcccctaattacctcccaaaggctccacctcctaatgccatcatattgggaattaggtttcagcgtatggatttagggcatggacacaacattgcatttatactactcccctcgtggagtgtcttactcggttcgggatgcataacaaattactatagactgtgatttaaacaacaagcatttatttcttacagttctggaggctgggaatctaagatcagggtgccagcatagtcagattatggtgagagccctctttcagggctcaagttgcagacagccaacttatccttgtattctcacatggtggaaagaagagctaggtagctctctgacctctaatgtcctctagtggcactaatcccactcatgaggcctccaccctcatgacctaatcacctcccaaaggccccacctccaagcaccatcacagtgggaccagagcttcaccacgtgaatcttgtgggggacacaaacattcagtctattgcagaggaactgcaaaattatatggtaaagggtatgtgtagaaggagggatgaagacttgggaaaaatgtaaatatcacatttaaatgggtaatgtccatctgtttaccacctcaaaatatctttcatactcctagagttaggcataccatggtttgaaaatgctgaagtatatactgcaccctagttaacggcatgatggcacaacccactatgctgataaccaacatgtagagaaaagagtggggccaagcacagtggctcatgcctggaatcctggcactttgggaggccaaggcaggaggatcagttgaagccaggagtttgacactagcctgggaaacatagtgagacctcgtctctacaaaaaataaaaacaaattagccagatgtggtgatgaatgcctgtagtcccagctacttaggaggctgaggagggagaatggcttgagcacaggactttgaggctgcagtatgataggactgcaccactgtactccagcctgggcaacagagtgagaccctgtctctgagaaaagaaaaagaagggaaagaatggtattctgaatttcattgtttctaagatgcacatgttctcatattctaacttacttgaactaggataactcttatatttgaggtgttttacaatcacacatagttgtgatgaagcttctctgcctatacacatacacacttggttgtcatttctggcggattggctgggcaactgccatcccttgactttcagctaaccaaccaattaggggccgcctgaggaggaggtatgtgtcttgactgttgtctgaaaccctttgttggaagctctggcatgaaaaaagaaagagctacgcgcaaaactttcagagagggtggcagtggtttggaagaaaagtgcagagccaacagtgggtcagtcattaaggactggagcaacaccatcattcttgagggtatgaggataaaactgtggaaaactcctatctatgactctgagttgaaaagtgattcataagtactggatcctgaatgtgaggaagttttaggaaacaaacaatttatctcctttttatccatgctgtagaggaagatgtgcttaaaaattatctacataaatcaacaatagcaatttcaatgagtatgcaatgaaaatcctaaatgataagaaagcatgtgttatattttaactggtggagctttctcttcttagtggtccacaaagtaacacaaaataatggtgtttcttacaattgacagcttgcttgagtcagtgaaatgtgatatataatgaaaaacacttaaatggaaggtatatcaggtagcatggttttgcttgcaaataatgggaaatctaactaaaactgactaaacagtaaggaatgtgttggctaagcaattgaaaaattctagaggttaagagcactttacagttaatttacaccaacaggtcaatggtggtcaataaactcttcatctttctattcttgtggctatggaggggaaggtatgctgcttatttaggtcagtcagccccttccgatggagctgaaggtggagtcatttctacccagactgcaagactgctgtgtaaaagtggatgggatgacgatggatgagcaagagagaaagaaattcccactttgcaagaatgcctaaactgagaatcaagggtcagagagaagcaagtggtagggatgatggcttagggtttattgtgtatgttttgagacactgttagggtcaagacagagaaggctgaggagcatttccttccttacccttaaattacttagacagaaagggaagaaatgaagacggactttcaagggaatgggagacagagtctacagccttaaggatttcagtgcttttcactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaggatttcagtgtttttgcaaatctgcttgatatcaacatgttgggctataaaagtatttcccacttggtggcccaacctataatttcacataagaaaaaattctccactcttaagtcaaatttatttttatttttattttttaagacacggtctcactcctgtggcccaggctggagtgtagtggtggaatcatggctcactgcagcctcaacatcctgggctcaggtgattctgccacttcagcctcctgagtagctgggactacaggcatgtgccaccatgcccggctaattttttgtatttttagtagaggcagggtttcaccatgttgcccaggctggtctctaactcctgctctaaagtgatttgtctgcctcggcctcaaatgatttttttttgttttttgtttttgtctccctagaatttctgatggctgggtgctcaggcctgattagcatggagacatattgctcctgaagtttgctgaaaggagaatctggaggctcacaaatttggttgctaatgtcattctccaaattctagaggtgattgctgagttatgtgcaacacctggcatgggttttggtacaatttatcattcctccatgggatagtatttgcatggaaggtggttatattaaatgcagctttgaaataaagaaatctcatgctactcacttctgatggccccatcagaagtttattatggcagagaacacaaactatgtgctgcaaaagttgttagtttgcttgttcacttgctctttctcaatctctctctccctgtctctctctgtctgtctgtctctctctctctgagtaataaaaaatgattaatggagtaggcttagtttagatgaattctgtgcaaagttattttacataaaatgaatttttttccacaatactctatttccatctctgctttatcattgcctttttgtttgaattaatgcaataatattaccaaagtcatcctccattacactaccatttgctcccacattcaaggcaacgatgtcatttccagatgaaactatttgtccttgttaaaacagacaaggcagttggtacattcagactcaattactaagttgcatgattgattccaagacagaactgagagctaaggcaaatgaaacttgtcattaactgtgcagtatgtttttcttctgctagatctgataggagaaagattcacatagctggatctaagagggaagcgaaagggagttagcccagatcagttcccagaaaacagactctaagacagagtttagaatgctagatgtttattaaggagtgcccttaatcaatacctggggaagagagagagaggaagcaggagtaggctgaaggagaaggtgagctggatgtagacccaatgatggaccctacagacacagtgaggaactctgaagctggaaggacccttcagtgttgtactgatgagccaaggtggccaggccttataccacttcattgatcagttactggtgtgaactgtcctgagcaggagcatgattctgggtgaggtggctttttatagctgaggcagtccttgaaaatgttgatagttgaaggctgtctgctgggttctaggtcctagactcaaggtcagtgattctcaacaaggggtgattttttccccctgggaacatttgacaatgtctagaaatatttctgattagcacaactggagagatgctactgatatctagctggtagcatccaggggtgctgctaaacttaccacaatgcacatagcctccaagaacaaagaattatctggtccaaaatatcaatagtgctgaggttgggaagccttgctctggagcaacagaacctggtggacatcacagcatccatgccaggagtcatcactaatcaagatattactacttctcagacacaatgctcatgttctttatttctcttactccttctacaaaccctttgaggcaggcctcagagtttccatttactaaagaaaaaagcagtgctcagagtagttcagtaaactgacccacgttatgaattggaaggacaccaagatgtgaattaaagtgggccatcttgttgaaaacattttgctatcttctggctttccctttgaaagagttcagaacatacaacccaaaaatgtgcccctctggcacattgactattttgagtcaaaggcacgtaaaaaaagggcaggtgcaagaagaacactcttgcagtcctttttaaaagcaggagataaaatttccagttgaaatatatcctccctgtactagaagaaaagtgtcattcttatcatcaaggatgggaagttgaggtcactggaaatctgtccaaacacaccttgttaaactaactcttgtctttcttatcacttcacccaattaactaccctagcccaagcccctttaccttgtcacatcttcataatctactactctttgtccaatttagtatatgtgtttaactttaactgcatctttcagtcatcattttcttatgaagcctccaatgccacatacaacttgaattaaatacatttgtattgtattttttttcttgttgatctgtcttgtgtcaatttaattatcagccacaactgaaaaactctaggaaggtagaggtaaaatcttgccttccctacaccttgagggctcaatgcagaggttgtcaaacattttttttttctctccagacatgagatacatgatgctcacatgttcagtttgctcccatggaattcctggggctcaagctgtaaactcacttttatcctacttaaaaggtacagtggaacatgactggcatggcacaaatatggggatgaatctgaatcctctctgatttgtatttttaagtagactgttcctgaactctgagtcctttctaatcgtaacaaatatatagtaagcttgcagttgattttcatacggagagtaacgcctattgatagtgttggtgaatgcctgtaaagagactacatcactttcagagtctgtgttacactgttgcttcatgatctgtatcactgaatgattaagtcatttaagaacattcttcagatgttattggcacctcaagaaccgtcagaatcaaagcattgactcataaatttaatttaaaaagagcagctactatgttccagaaactgttctactttctcattataaacagtagaattcactattaatagtaaaggcttccacaggagcagaaaaaagcatatatcattttacagacatacagttgagcttaacaaagtcaatttgtactctctctgaaacaaaatcacataaattttgacgtttttaatagagcatcatgcaaagggaataaacaaacataggctatgcaatagtgttaatagaaataaaaggcagtacacatttagccaaaagatataaacaaaaaggacttagatcttttattattattgacctcaatagtaatgttagttattatggtccatagcagctgcagtttttagattctagcatagtgccagtaacttaaaaaaaaattctgtcattaattccaacagcacatttcttttttcactttttattttatagatttagggggtacaagtgcactgttgttacatgaatatactgtgtaatggtgaagactaggcttttagtgtaaccgtcactctaacagtgtacatatactgtacccttcaggtagtttctcaccccttgcctccttccacctttctgagtcttcaatgaattattctactctctatgtccatgtgtactcattttttagctaccactaaaatgagaacatgcagtatttgtctttctgtgactgagttatttcacttaaaataatggtctctagttccatctatattgctgcaaaacacatgatttcattcttttttgtggctgagtagtattccacctaccatcttttctttatccagttctccactgatggacacttaggttgactccatattgttactattgtgaatttgtattgtattttttttcttgttatagatagcactgtgataaatgcaggaatagaggtttttaaaaaaataataatttcttttcctttgaggagatactgagcagtgagattgttggatggaatggtagttctatctttagttctttgagaaatctccgtactgttttctgtagaggttgtactaatttacattcccaccaatagtccacaacacatttctgtatggtgggcattatcttccttttacaattgaaaaatacagaccagaaagagtaaaacagcttggttgaatttacacagaaatcccttggcagagaaagttgccatacccagaccactttctatagctagaaagcctaatttagagtaaaatgtacatttatatttgtcaattcatttttttcaatcaaattctctgaacactgctaagcaaaatatggcataagcagtactgtgctggtaaatgtttaaagactggctgtcaaaaaaggggtacatattatataagcttcttttaaattgtactgacataaagaacatgtagcacacaatttacatataataataaataatatatgtaatactctttattatacattctaaatagttttttgattttcacagaatgcttttgttgaattttacctaaaatgtgtatcaatagccagtctgtggttttaactgtcccacaatatgggtcatgaatgttaattgatgttttcagattttaagcaactgatgtgacatcaggtaccatggagctggaaagagagacttgtgtagtattttaccatacacatacgacagacacacataatctcaagagcataggtaatagtcaaatgtgcaaagtaattagaaagggatgagttctgactattggttatctgtgttttgatataatttatttcattgtaggtttatataatttaatttcttaataataactttaacaattgcctcacaagattcctgaaaacttagcagttggttctcgtgagctgatgtaactgctgatagggaacagttaccagttaatcaaatatccccatttccagtgtcccctactccaactcatagctctgaatatgtaagtagagggcatcccattatcaaacaaaatagatgttgagaaagatgatgttgcgtagagttgtttctttaatattcattgttatttttgtggtttattcacaggcatttccctgcatctcaacaggcatttatggtaagtgatacagcttttgatgatgtttgtatttctttattttgctgttaaatgcagagattcagtgaaaaaataagaggttctctgatgaatatattttgctgtgatttagagactaaaaatgctcgtcaaatcccattaaagaatgtcatgaggctattcagattcttttgggttcttgaatttggttatatcgggtatcacatgaaattatttgatacattgtggcttgatgtcttttgttaaacaaaaaatttggttccagtaggattgacttctaatattgctttgtttaatgaaatcaaatttcttctcagtagaaagcataatgtacatagagtttagcagtatcattattttgttgctatttacaaaataatagaaaaattaaaatgcatacatatgcatatatctgtgttttcaaattttaaaaaagtccaaagaagtgacttttactaaatatgaagaattttaataaactgcaaatttttttttctgcatagtgatggattgtgttaagtagtgaatgcctcacttacagatggaagcaaaatgtttcttaatcacttgctttcactagcctaaagctctctaaatattcttccacctacctacaagaacttttttatactttttttcagaccattaataagtctgttttataatgttaaagattttctgatctaagtgaaatagattacattctttctgaacttaaacttctcacatggaagctgtcagctgaagcacaaaatatgtaaaaatctaacatatatgtatatattttaaattcattattacaatgaaggactacctagattgatgtcaaaggtaggagctttactttttttcttcatctggtatttcttttgaaggtcttgagcaaaataaaatgagaaatgtaggcctgaaccaaattaagtgggaaaggattttgtcacactatttaaaaatttaaggtttcctccttcaatttaagccttcttcctctccagattcccctacagcctgtctttgtggaaacaggatgagcactgggctggagggggctaaactagaccatctgcacaattatccccatcatggccattctttctgcctcacaaatgcccaataacaaaccttaaatatttgcttaaaggaagtattatgtacaaagttatgcctggcaaataccctaactctttatttcgccttatgtagagtcaaaccaaacttcattgcagaaatggtttttattatgaaaatgttctttcattgcaatcttgattttccttgccaaaaaaacaaacaaaaacctaatgcctacaccaatactgtatacatcattttctatgtttattaccttgtcagagagttgaagtatgttttacttctgagaatcttatggtaatgtgttaagagcttcaaaaagggaattgatgtaatatatatggtatactataagtaggggggtggtgggaaaggaaaacagaaaagcaaaggaaaatagggaaggaccataaaattagaggctccaatatgatcatgtcaatagatgcagaaaaagcaattgataaaatccagcatcctttatgataaaaaccctcaacaaaatgggcatagaagggacttacattaaagtaataaaagccatatatgacaaaccaacaaccaacatcatactgaatggggaaaagttaaaagcattccccatgagaactggaacaagacaaggatgcccattttcaccacttgttttcaacatagcactggaaattttagccagagcaatcagacgagagaaagaaataaaaggcatccaagtcaaaaaagcagaagttagactgttgctgttctctataatatgatcatttacctagaaaaccctaaaactcacacaaaaagctcctcaatctgataaacgaattcaggaatgtctcaggataccaaatccatgtacagaaatcagtagcactgctataaaccaacaacaaccaagttgagaatcaaatcaggaactcaatccctttcacaagagctgcaaaaaaaaaaaaaaaaaaaagataaaatatttaggattatacttaaccaaggaggtgaaacatctctacaagacaaactatgaaacactgctgaaagtactcagagatgacacaaacaaatggaaatatatcccatgctcatggatgggtagaatcagtattgtgaaaatgaccatacttcctacagattcccatcaaaataccatcatcattcttcacagaactaggaaaaaaaagctgaaaattcatatggaaccaaaaaaacagcctgcatagccaaagtaatattaagcaaaaaaaaaaatctggaggcatgacattactcaacttcaaattatactacaggtctataactaacaaaacagcatggtactcctataaagcaggcacatagaccaacagaacagaataaagaatccagatataaagccaaatacttacagcaaactgatcttcaacaaagcatacaaaaacataaattggggaaaggatatcctattcaataaatggtgctgggaaacctggcaagccacaagtagaatgaaactagatcctcatttctcacctcacacaaaaatcaactcaagatggagcaaagacttaaatctaagacctgaaaccataaaaattctggaagaaaactcttctagacactggcttaggcaaagaattcatgactaagacctcaaaagcagatgcaacaaaaacaaaaataaataattgggacctaaattaactaaaaagcttctgcacagcaaaataaataatcagcaagcagacaatccacagagtgggagaaaatatttgcaaactatgcatctgaccaagaactaatacccagaatctataaggaactcaaacatatcagcaagaaaaaaaaaatcccataaaaaatgggcaaaggacatagacaattctcaaaagaagatatgcaagcagccaacaaacatgtgaaaaaatgctcaacctcactaattatcagggaaatgcaagttaaaaccacgatgagataccaccttactcctgcaagaatggccataattaaaaagtcaaaaaacaatagatgttgtggtggatgtggtggaaagggaacacatttacactgctggcgggaatgtaaattagtacaaccattatggaaaatggtatggagattccttaaagagctcaaaatagaactaccattccatccagcaatccactactgagtatttatccagaggaaaagaagtcgttatatgagaaagacacttgcacatgcaagtttatagcagcacaattcacaattgcaaagatatggaaccaacctaaatgcccatcaaccaatgagtagataaagaaaatgtggtatgtatataccccatggaatactactcagccatgaaaaggaatgaaataatgtcttttgcagcaatgtggatggagctggaggccattattctaagtgaagtaactttagaaatgggaagtcaagtattgtatgttctcactttgatgttagaactaagctatgaggatgcaaaggcataagaatgatatcatggactttggggacttgagggtgacgggtgggaggggtttgagggatgtaaaactgtctgttggatgcagtgtacactgcttgggtgacaggtacgccaatatctcagaaattaccaccaaagaatttttgcatgtaaccaaaaaccacatgtacccccaaaaatgttgaaataaaaatacaatttaaaaaagtttaaaaaggcattttacttaatcactataatacaaaaaagcagaagaaaacacattttccaatacagtagacataacttaaaaatattcaagtatctcatgagatctgtggtatatttatgtatctataattcattaacaattcatctttcacttaataataatatttatttgttccacacacaatgtaataatttaaacacacacacaaaagaattgttagatcatattatatggacatgtttaactgtattgtgaaataccaaactgttttctaaagtgattgaatcaatttatactcctacccactctacccactccatttgaagatcaccatgttccctgtcctccccagtgtttggtattgccagtctctaaaattgttgccaatttactgagtgtgaaattttatcccattgtggtttaaatttgcattttcttgattattaataaagtaaactttttaaatatcaaaaacaaaagagtctccagagtggacagtaagaactaactaaaatctagagtggatcatggtccattttaatctgtgaagaatagggatttcaccctagagagagtaatgtggttcaaaatataataactgattcagtacaccattgtggcgaatgggagggaaatagtgaagattgtcaggcatggcattaatagtgtgagtcacattagctggcttggagggctgtcaccaggcaagtttagtcattttcacaatgctaggtcaaagaaaatacttcttcagtcctggctacttgtctctttctcctctgttttttggtaaatttacaagtgagactgatatacacaaaggtcgcatgccatattgcttttggttagtccccctggggttgaaacctaactttccttttagcttcataaccttctgtttcagtaactttagattgctatgtctctgtggtttatagaccattcagcattatgcaacttgaaaattacttcatatgtcctgcattagtccgttttcatgctgccgataaagaaatacctgagactccgtaattcacaaaagaaagaggtaattggactcacagttccacatggctggggaggcctcacaatcatggtggaaggcaaggaagagcaagtcacgtcttacatggatggcagcagacagaaagagagcttgtgcagagaaactcctgttttcaaaaccatcacatctcatgagacccattaactatcacaacaacagcaaagggaagacccacccacatgattcactcatctcccacttagtccttcccacaatatgtgggaattatgggagctacaggaggagatttgggtggggacacagagccaaaccataccatttatggtttatagaccattcagcattatgcaacttgaaaattatttcatatgtccctggtgaagttacagctttctcagtccttgcttctttcccaggatctgtgtattacagactagttttcttgctcttatttgaagccctcttcctccttcattaaccagataagttttctttcatcttttttttattagggtttgacgtaatattctatttaaagaaagtggtccatagctgaaaagaaaaattttacaaagcaaacacaactcccaacatttttgtaagtcatactagaatggaggtagagaaggtttttagaatcatttcctggtggcactctttttctttcttgttccatattccaaatctcactagaattgtttttctaaaataccacttggtgcgtgcttcccatctgcccaggagcctttgctcatattctattgcttgcagattgatgttcactcttcctagcctgaacaatgggcactttctatatctccataaactagtgctttcaaaatgtgtgagagggagggaaattggtgtgctaaggatgtaaattggtgtgctaagaaatttatatatgccttttcctttgcatctttaaaagggggatttaatttatggcagttcttaaagttatttgatgatagaaactagtatatcctcaacatttctctggactatgttttcttcagaatatagtttgagaaatttcttggtacccattcatcatggttatatcttctgtgacccacatgtacatgatctgatgaatataagaacttgccattgcacagtgaggtccaatcttgggtcccttcctgaaacttactccttaacacctcttccccaatgcacacacaccaaattcgcacataccatcaccaccagtgttgtctatctcatgccccaaacagaaacatgccaagcacatttaagcagactgaaacatttttaaaaagttttattttaggtttgggggtacatgtgaaggtttgtcacataggtgaacttgtgacacaagggtttgctatacagattagttcatcacccaggtattgagcccagtgcccattacctttttctgctcccctccttcctctcaccctccaccctcgagtagaccccagaatctgtagttcccttctttgtgttcatgagttctcattatttagctttcacttataagtgagaacatacactatttggttttcttttcctctgttagtttactaaggataatagcttccagctgcatccgtattcctgcaaaagacataatctcctttttttttatggctgcatggtattccatggtgtatatgtaccacatttcctttatccactctgtcactgatgggcatttaggttgatttcatgtctttgctattgtgaatagtgctgcaatgaacagtcacatgcatgtgtctgtatagtggaacgttttatattccaacaaaaattagccatggtagtgggcatctataatcccagctactcaggaggctgaagcaggaggattgctggaacccgggaggtggaagttgcagtgagccaagatcacaccattgcactccagcctgggcaagaagaacaaaactccgtaaaaaaaaaaaagaatgatttatattcctctgggtatataactagtaatagaattggtaggtcaagtgatagttctgctttgagctctttgaggagtcgccatactactttccacaatggttgaactaattcacactccgaccaacagtgtgtaagtgttcccttttctctgcaaccttgccagcatcagttattttttgactttttaagaatagccattctgactggtgtgagatggtatctcaccgtggttttgatttgcatttgtctaatgataagtgcattgagctttttttcattggcttgttggccacatgtatgtcttcttttgagaagtgtctgttcatgtcctttgcccactttataatggggttgtttgtttatctcatgtaaatttgtttaacaggctgaaacttgatctgcaggaagtcttccttaggtatgccaacccttggtggtcattatactttctgaaatttttttagcatttgtgtcaggacaattatcaactgcttcctcatgttgctccatagattgctgtttatatattctgtgctcacagccagtttggaatttaaagagcaggaattcacttctgcatatcctttgcacacccagtgcctagcaaagcactgtgtctctaggagaagctcagcaaatatttggttcatgacagcagtgattgtaatccaaattgttgcctaactgaagatatagaaatcagaattcttgattggcaaaataacaggtaaagaaagctacccagttggtattttcttaatgggcaaacatttctattctaggaaaaacaaatgtgtttttaaaaggcattctcaaactggaagtttgtatttgtaggtatggcagtgtccaccctgtcaaggtaaaatggaaactcaagaacttattcagttagagagccaaactaaatacagcattttacttcagttaaaatagaacccctttgtggtttattacagcccatggaacaatggtcactcaggaacatacaggtcagctggccatccaggaggccctgttctgacttctccgaatgtaccccagacccagcccatctctccagtagctgccatttctcacacacctgtttgctttggagttaccttcacttttagatttatgccccaaaagtccactgtaatcctagttctgctataatgaaattttgaggatggcagagctacctttcaaatggattttgttatttaatcactgagattattttataacaggataatttcaagagtgagcatacccatttcctggaaactcggacctcagcatcacactcacagtgtgtctggaggacctggccaggcgccagtactttgggggtgctcaggaccctggcagctctcctagctttctctccctctgcagccctatagccacaaaccatcaattgcagtgaaaccaccttagcctttttgtaaggcacagcctgaggaatatcctccatgtgattaacctgatttaaggaggagacaggatgagagcagacactgccttctttgaagttcccctggaagaggccagacttttccactctgacattcagtgagcactgttgctactccaacgtgacgtttccaggatggttccacagggcaccagaccacctgcttacactcaggatgaaaagcctcgtttggtcaaataccaaagaaagccctgtgctacttttggaaaaatagatccagatgaggctttcagggcttgaaatccctagattcctgttaaaattttgcactggcctctaaagcagtctctaaacagatctgaacctccctgatggacatttcagatctcaggcgtgctttctgccctttgagccctattttgacactctaatgctaataaatttaacaaaagaggctagacataatacatggcaatggaatttttactgagaagtgaatggcaaaaatgattttagtcaattttatgagagtcaatatagttaacagaaatcgactcctggctgaaaagtgtattccgtgagtacttaaaaatttggaaaatattttccctggaaaaaaagaaaaactttgaagtttgctttccaggtatgacgtggcatatgtagagaggaaggaatttcagacattgagttattggctgtaaatgtgaggaaaaattgaagtgcagcatagcttagctgaagcagctctcgtgtttatccaatatagttttgttatcaacgtggagtgcctgtttctatcagatcacctggtctctttctgctatccaccacatgctggcaggctgcaactttctaattgaatccctcatttgcattcaagtttgctctgcttctaactggtaaaaaggagaccagcgcaatgttatgttaaccttgtatctacttggcaaatatttttatcagtacatctgtctagagtcacagacatgacttggaaaaaaattagggcattctccaacggcaatgccaagggcatgcccttcatcagctttaaatgctgacagatttgagaaggtgtgacaatcattgctgtgcatatttacagaggaaggaagagttctcttatgtaatgcattgggaaccagagcaaaactgacaaaattatgcaccccttccttttatcaccctaatggctctcctccttcctttggcttttttctcttccctttgatatttccatttgctttaaaaacttactctcaggtggtctaatgatgactcttttcactgtcgtaaaatctctgctctggcaacctaagttttttatcttgtcaaattattcccactgtaagaaatgttatcattcttggcaaagcaaagtaacattagaatcagtgtaacttacttcccttgggaaaatgcagtgctggggccaagcctatctctatcatagctcgtttgaatatcactttatgagctaacacttttgagacagtggagagacaacttgacagacagcaaaattctggctattcaattgtttctaaccctgagtgcttatcatttggacagacaagtttagctaacattctcattcacagaaacattgatacatacatcccagaaaatatggtacagactcctctcgtgctctccataccctacccacgtctttaatattaaaatgacatcaaactaagaacccaaaggactaacttcactctggaaagtagtctcaagtgaccaactacaaaatatgctagttcagtgtacataaaaatggcagtgaaacccatgggcaggattcctctaggggacctgacaaaagagatgaaaatcctggaaacttagtttttctggaatgcagaggcagtgagaaaccagtgtcagtcttcctgatgttctgttccagatgaacaattttgggacttaattaaaagattaagtgtttcactatgcaatatatgcatggaagaaacttgtatgtgggccctctaattatataaaaataaataattaaaaaagaaaacaaaaattaaaaataattaagtgattcaaaaagtaataaagatcacaactgtctgactgtttctggggtttggatgtgcactcccttgtagttgtgtcaaggtaaaagtgattgaagcctggaaggcatcactgaattcccacccaccccttcctcagatgtatcacttattgttatgctataatttttaaaaaatgattttctgaatagacgaaacattgaaacagtaagccttttaaggaaatagaaaaactatgctaggaaattacagagccaatccattgagcagtaactctgggaatatctttcaggtaccttgaaaaataggagcactattaagaagctccttctaaagaactgttttggagtgttgaagaattgtccacacttggactttgatcactgaaataatttctacgtccttgcttgtttttctcatctagtcttgaatgacattccttttccttgctccttgtacatacttgtgtctaaagggtaaacgtaaataaacatagccctcttcaaaaagaacttcaaaaataatttgacaggtcttagagaagtcaaatgtgtttagctccttaggacaatgacttttatgtcaaatcctttttggtcaatgatactcttttaaaaatgtattgtgaaatgtatgtgaacaagaccatattagttagggtaaagttaaactgttctaacaaaaagactccgaaatagactggcttattgaatatcatgtttatttaccactctgctaacaggaagcattctgcttgtggaggatttgttccactctgtcattcaaggagccaggaatctaccatggtgtcaatgccttcccgaaggtattggtctcatttacttacccgccctggtgctggcaaaagatgtgtatatggcaagcacaccctctgtctaatggtccctctactcaaagtagcattcatcacttccactcaccttccatttaagagaaattggtcttgtgaccaatgtctgcaaaggaggttggaaaatttagtctagcttggggtctacacatctgactacaattctattacatggaaagaagggaatatcacattttgatggacttccagatatttaccacccaaagagaaaagaaaaacaaattaaatcaacaggttgctcgtagataaattagtttaggggcagtgtcagccacccgtaatgggtacttgctttgcaagaatatttggtaattttgatagcatatactttattaaaatgtctttataatgctgagtgcttacaaatttgaaagtatgaaatttttaaggcataaggacagtgatctatctttagttgtcagacactatatttagatatttagacctcacctcaattgtttacattttttggtaccaaaactccttgcaaaattttcagatacatcagtggaaactaaaatcaatacattgagaatgaatacataattgcattatttattacattctaattctggcccatttccatagaaatccttggaggcatcaatcgcaatttgtttctgcaacactctaaggctgtggggccacagtcatccataaacataccaggagtcctgagcagatatggatttacatcctgtgtacctaggaactctggggaaatgtgagtttagggcagagtctgatcatagttgagtggaaatattacagagaaagagagagaaaatgatcatatgaatatgaatctaaatctcctgggtagtcaaaggaaatctccttagaatctttagagctgaagataatagttcatacctgtttcccatttcagccgtgaacaacagggagagtttcctacaagtgactgcaaattgaactgaaattaacaaaatcgacatgaaattgcctcactttgtactttattgacctgacttcatttctaaatgttttaaatgaatccagttttaccaaaatgttcctagatcttcttaagcaattgcgtttttggtaaaatgcactttccctttacttgagatttccattctggtaattgtgacttagcttatgaaactgggctctaagttctgtcactgttatattccagcacctagctcagagcaggatgcagagtaaatcttaataaatatctgtttcatggctaaaaaatacataagcagctctccaatgtaaggaggctactggcctgttctgtccactctagagatcatactctggattcaataattactgagtctatgacaccctggtttctatttttttacttactctaaggaatgatttcattcagattttaagacgataacaggagagtcagttaataaaaatagagcctaatcttttagatgtggttaatttttaaagcggttttattaaactgtaattcacagagttgcacaacaaccatcataatctatgttcatcatgcccaaaagaaatcccacattagctgtcactccgtcccctctctctcaaccttgggcaactgctaatctacacttgatctctatagatttgcctgttttgggtatttcatgtaaatggaatcataaactatgtgatcttttgtgactactttccttcatgtagcaaaatatattcaaagttcgtccatgtcatagcatctgtaattaatctctttttattagtgttcctttgtatcaatgttccacattttgtctgttcattcaggatatgtgcactgtttctactttttggctgttgtgaacgatgtttagatgcagctcatttaagcataattacatcgctaaatatacgcactataaatgtaaaacagtggtgttctgtagttaatttttagtcttccttgctgtttccattctttggtcctctagtttctctcaggcctctccaaagctacttttgcttgatggctctggtgtcctgctggcctatgcagtgatgtaggtttcttgaaacatggtctgtatctctgtgtgtagtcagtctgtacacatcgcctcagagttctcttagagtaccaaagaacatcgtggaaggagagcatgtatcaaagtggctttgggcatggatttcaggctccgatagatctaggttcaaattctgagtctcttattagctgtgtggcctcatgcaaattgcttaatcttcctaggccttaataacctcaattctaaaatgaggttaataatggtataattattgaggttttttagtatgaggttaataatgtaaaatgaggttaataatgaggttcatataggtaataatgcctatatcatggggttgttgcaaagattaattggataatgcattaaaatgcttatcatagtgtcatatataaacacaaacatttaacaattatttttaatagtaacattattcttataactactgctgtcattattgccctgccactagattctgagttcttttagggcagggactttgattattttgttcactgctatcgcttagattctagaactctgtctatactattgaacaaatacttcactatttgaagaaggctttacttttgttctggatgataccagtcagtggtcccttatcatgagagccaccttgctttctgtttgcttgaatttgctgcttttatgaaatccaggtgtctcatctcagccacctctgagtcctgtggtatagcctgtgagttcagctgtctggaaatgaagtctgtttgtaacattatcataccacactttatacataaccactgtagccaattgtttaaaaaatagtcaacttgcttaagcacttccaagctccctaaaatctaactaagtcctaagaataaaaaggaaacattttgttttgactgtaaataaatacaagctttccataagagagagagagagagtaattatagttatttgtggtctgaaatgtgaagttatgtgttgtaagacagcagattcttacggacaaaaccaaatcatgtttctgtacatagattttaaatgcttccttccaacccaggggacccaggggagtagataacagttgccacttagcttacagagggaaaaagtccaatgcttgcgtttcgttggcccaaaatacccggaaagcttgcacagtttttcatttctaagatcataggctcttagaactgaaaggcattttggaaatcatacttgtcctagatccttattttcctggctgggaaaaatgagacccagagttgctgagtgacttggctagcaacatccaactagttcatatcagaaccaagaccaatgtgttgtccagccaatagggtgaaatagcaaggggagaggtctgggaatcagacaatcatgaaccccaggatggtccacttgctgacctcttctttgaactgtagttccaagcttcctcatatgttagatgggaacagcattaatatacaccttctgctattagaagaaaagaaaggatttgaattgaggcttttccagaactgagtagagtgccaaagatttgtgtcaataaatgtcatgatggcaatactttctctaggtccccattctctcctctgtgtcttcttctacccaaactgctgcttctagccaaatcctgtttatatggactaccccaccttcagccattgggttcatcatcagtgacttctgaagactgactgaatatagaaaatacctgcacacccatccttctatgcatcatatcattgtttcttcctctttatcatgaaagatcctttatagttaaaggtgatgcatctgtatcctcagggtaccaaggcataggcagcctgtgcaagggaggatttttgttcttgttgaaataaaacattgtattctaaagcagaggcgttttgcaacctcattcttaaaacaaaatgcttaacattactcactagttaagtaattttatggccctcccccaataaatcttgtacatgaaccctcaggaaggtgcacatcccgtggtttatggtgcctctggcacactgccaacaccccagtttgaaaagccaggcattcaaccaaacttgcgaacgccagcccttgcatataattacaggaacctgtgaaagtgatcaccggcagctcaggggctccaagcttccgcaagttctgaatcccttagcaagccggaaagatctgctggcgctgccgtagggaaaggttagcatcctaaattatggcctttcaattttttttcaactttgcaaatattttatcttctcatccttagtgaaaaagatagaagtgcacagttgctgttttcccatgttgtttatagaaggaaaggaggtctcaacagctttttccatccttcataaaacaatgaaaatgtgcctcgtggccaggataaaacagtgatatgcatcgagtgatccaggaaatgtaaaaatacttgacttgaaagactttttaaagatacctctgcacatgttaaaggcagtggcagtactgggacctaagagtgtgcgtgtgtgtgtgtgtgtgtgtgtgtgtgtgtgtgtgtctgtgtgttgtataggaagtatcccagtgcagttcttctccctacaggcctcactcccaactacctgtccagcctaggaagaggtaaaaaataggaattgtggtgagcatgggaaggtggtgaaggagacaagcaacaagagacagaaatgccaagaagttaaagcaagctggctgcaagctatggcagggcaacaattcctgggaaggcagagcctggctagcagaggagctggggcctgcagattggtcggtgcctttgctttcctgctgtttccacttcgtgttctttgcctcctcttcacactaccaactccttccacttcacacgttctatctcaagtgaggcagtgcccatctcaaaggggccacagtgttagagctgctaaaagcaactaggtaagtgggaagatggggttcccttattttcctaccaggctctccagccccagggctgccatggccacttctccagctcccatctcacttcctaccctaggcctgccataatctccacccagctttctttccaggagtgaagtccagtgtccaatcgagttgccatgctggacaaactgaccttgaccttttctatcccagtgtattatcttgtctctagcagtagccatccttaggaaaccccaggaaatgctatgtttgcttaggacactggaaacatggggtaaaatcaatgaagctgttttgtgttctgccgcagggtgaagcaggaaagaaatctaatgggggagtgactcatggtaagagatagtggccctgtctctcaggctattagaaggtaccaaagaggtgaatacagactggttcaggcctgtgtaaagcccaagtatttatccttgtgagaggccatgacatttttcctccagttccccaccctagaacctacactcttctaatccccatcccatctctgcctcccctttccttggaatacaatgttacaggctatggaattcaccattagtaatgtcaagttgtggaacttccattccttctgcttggaaggtagaaggcaggagagttccctaggagtggagaggagatgctagaagcccaatccaaaattccaagaacatttttcttaggatgaagactaccagcatggctttcaagccctagagtggtcttaccttgtgcctgactctctttcagtctgtcctagcaggcattttctctgctgtttgcatcctcagcctgcagaactcttactgcccatcttcagctggttaatggtggttaacaagcaaggcccctggagggatgcttgccctggcgtccctgagcagatcaaacctccttattaccagctctcatggtgttacatggctgtccttcatagcccttaatacaatcaaagctttatatttattggggtgattattttatcaatgtcagtgtctggttttcctcaccgttatgtcccctgctcccagcacagtgtttgacaaatggtagagagtcagtaaaatcttgttaaataaatgcatacatgttcctgtaaaaaaagaagcactatggtctatcttcattataaattaagtcacttttgggcttgtcctgacaacaaaattataatgcacagtattatcttgtgagaatatgaattataagtttcaaataatcaagtgggaacaaacagttttgaatatgaacaacatgtaagttagagttcttatatttaattctagggatatgtttatcttcttttcttataggacatacaaccaaataagtgttttgtcttactataaagatccaggattttgatgtttgcattgattatccttacagtcatcctaggctaacagttctgcaaatggtcatcttttctcttagggaccatccctaagaccttgaataactcagagcagataatcaaactatctaatgatcactgagatcatttatgcatcaggatttatcaataaaaaataaaccctttgaggtactaattgattttttattcccatccccaaaatggcagctcattagtgtctagtcaccagaaaactggggaccatgtggcatccctgtcccctcaccgtctaatatggcacctgttccatggaacatactgaataaatactcatggcattgaaatgaatcacacctatccctcactgagccttggctaataattgatcagagagttcatgatcaccacccatccttgagagggctcctattaaaaacagcagcaacaacaacatgtgactagagcatctgaacgcttatgtagcactgacgttaacaaggataacaggagcttgaggggcattttttaaaaggagtgcttttaatcattaaagtgagatacgcacatgctaaaaaacagtaaagcaatataaaaagtcatcaaatggtaaaaatctcttcccaattaaaaatgccagtatccctcttaagaggcagccactgttgagtttcttatgcattttccaaaaaaataatattcacttcatatataagcctataaatataaccaaattttcagtctttttattttcatggtttccaacttagaaaggccttctatttcaagattatttttaaaaattaacccaggtttcttctagtgatctagtaacattttaaacatgcacagaggctggacatggtgtctcatgcccgtaatcccagcactttgggaggccaaggtgggcggatcacctgagatcaggagtttgagaccagcctgaccaacgtagtgaaaacccgtctctactaaaaatacaaaaattagctgggcatggtggcatatgcctatagtctcagctactcaggaggctgaggcaggagaattgcttgaacctgggaggcagaggtttcagtgagagcaaagattgcgccactgcactccaacctgggtgacagagtgagactccgtctcaaaaaataaataaacatataaaaataaaataaacacacacaacagatattaagccattgatttatgtatatatgcatatatacacacaccatacaggtatacatagatatcacacatatatacctgtatgtctatacaagcatacatatacattatatacactgtatattatatatagtatgtttacttgtctgtgtgtgtacacatacatatagtgaagtatatacctaaactactaaaggagaaattttatatatattacaaaaagttataaatgcatgctcttacctatgtatattggtttgaagaaaaatataaaatacttaaaaaagattttaggagtatacataactttaaagaaacatataagtactgcccatttctttcccaaatgatacctatttttataaatttctttagactcaataattataaggtaattttttatgattaccttttatttatagagatatatattatagttttaaatgcttatatgtacacacgtattatatacaataaaaaatgtattacctattttgtgtgtgtatttttgtgtatgaatgtgagagaatgtggtgtgtgtgtttctatatgtcagttttaatatagtctccaggcagattttaggactttatgactttctttttaaaccttctgtctatggaataattgtgttcattgcttcatctatttcttgcaaaatagtgacaatgagctttctcccactgactaaaaccagacctgttccacccattcccaccccacaaatgagcaagtcatgtaacatgagaataaattaatagtgaagccctttgacagttgtacctcaggtgcttctgatgtgcaatgacatctctcagaattaaacctaccattgtcagtttgtcaacgattttctacaagtacaaaatggaattgcgtccatctcactcagatttggaagcaagtctgattatgggacatactgggcttgacaagctaaagacagatacagacattttctcatttatgaatctattcctttgggacattgttaaaattttaaaaaggtcgtatcttctaggaggggataagtaacataagttattttgcaatagctatcaatgtgaaattttgtattgtcttttggaagtcagaggaagaaagatgggctgcctcggtgcattttccatttgcccgtgattagcatgttctgaacatctcagtgggagtcagaggtatgcttctctttgggttttttcagtgtgaaggatggaaggaactctttcacacctttcatttgcactgttaagacttacatcagaagtacaaagcattttaaactgacagaataaaaagcaaacttcagagcaactttcctgcctatggtgctttccaaggatctaagacacatgagcaaatctcctgaagggtggtaaataaaaaaaaaaaaaaaaaaaaaaaaaagagtcacctttggccctttcttcatctttgaaatacactcgagaatgggctctctccctctgaggctaaatccagtgtgccctggagctgtcagacctgcagaaaggccctttttgccaagcagtctgagagaagactagcggtaattggcaatccagttctccatttccattgtacagccatccctgacaaattaatcacaatcaaatgttggctgcagcaaggggcaccctacacagcaggaaagaaaaatgaggcctcacgctgatctgacagccgaatctttcaactcaccccattagactgaacaaggggacgctgtggtttgcctgtcactaccactacccataaacaaactgctcgctctgcatctcaggacttggtggatccagtaaggccttccttggggcccaccaggtatctgaacaatcagtgcttcagagaaaggggaagggcctcatcctggtgagaaagaggcgctagatagtggcatagtggcataggagactggtgaggacaccgtggcccaacagaatcctgaagtgatgaatctcaggtttgacagtgggttgaggtctgctgcaggctgtaacggagtgtctgtctgtgcgcttactgctcacctgttgtctatcagccatcagtcaggtagtgagaaatccagccctttccatccactgtttagagttcacttatcgggcaagcttctttgttcaacataaaaccaagaatctgaaaataccttaaaatgttatttatatacttgcccagtctctgtagtaaagtttataagccttagtcacagaagagagtctgaggccctcactcttattttaggcataattttaacaagtgtgtcacagcctatagcaaattagaagatggcaggaagatcctgagaggtagatgctgacagtaaacagtgggataatactgaaaggtgacccaaaaaaagatagataagtttgtttccctgcctgccagtagaatataagagaaaatcatattttgaaacgcttggtcttttttaaaagacaaatgcttactctttgtaaaagctgtgtaatgaaatgtccccgtgatgttagatctgaagtggaagagtctctcttctctcccatctcctctgtaatattcaagatgtggtatataactgaatcacatcaagcaagaataataacgctgcctctgttctgatcaagtttacccttactccttataactgtgggcagtggcattcacggctctgccatctggctctcacaaaactcagggccaggggcttgtgggtaggtggtggaatgttctaattcctggagaagatattattattcagactgtataactgaatagcatcagtttctctaagtttttccatttcacctctcccagacaactgagtataaagaagtataattaaaatgttggctttcataaatgttaaagccacatttaaaacatttctcatctctaatactaactcagaaaactacttttctccctatatatttaggactagagattttgtcaataaaaataatggagaggatttgaggtccaaattaaagcaatgtatttcccagaactaaactgagtgtgtcagtggcttgtccaaagtcttgtagaagccagaccatgaacacagcatcaggacctgctgtttagtctttattcagaggcacataatttggtgttcttctgatgactggtttgtttttgtgggaataaaaagaatacagctgaagggatgtacctgaattgctgttttcccctttctctctctctctccctgagaaagatacataataactttctaaacctgctccagcagtctaaagattccagtgctcattggatcatggatttctcattttaacctttctctttctccctccctccccctccaacctcctattcagatgtgatcttaccagaaaatgcaattaatttaatcattcctaacattccattattttgatttgtttttaaaattatgtttacatcatgatccagttcaggttaaaacgcttgtacactgactgaattgacgcctatctttaagttaacaacattagttactatgtcctggaaacctataattgtgcctgaaatcttatgtgttatttgtaattctcacaacaatcttgatagatcagtatcattttccttattgtacaaatgagaaatcgaagaccctgagaggtgacataagtagcttaggaaggggctgaggtgggacaaggacaccacctgacttcagaggtgtctgaaaacagtccttctctgggataaagaataccgcccagagaaacattctcctgtcctaaaaagcaccatgcatgttcaccaaagcctacccagcaagtgtctggtctgaagaattctccttttctagggtctatgccagtgcttctagttatctcatggcgagagaagcttgtagcccccagagtgggaggtctctaggcagctgtgagatttgtgctggagtgtggatattagacccaaagccatgggctttttaacattggcctgtgtctcccacgcaatccgagctttatgcaccagatcgttactctgctgtgaaaatgaatattgggtttatggagaaagctaaacggttgggaaggtgtgtccctagccaattgtcaatagaggctgtgagcttcagaggaggcaattgtaataggttttcagttgacacacagttatgaccaaagcctttgaatcatttttgtgtgctttaactattgtgtgtttgttcagctgtatctttaataagaacagagcattattagcagtttttaaatcattctttgctgtaggttataagcatcttgctgcggtattcttttcaaattattggaatctctctttccctgccttacatcctgccctaacactgccttcccctctcatgttcccctaacaaatgctatatccctctcatttgacatattcaaacacacacacacacacacacacacacacacacacacacacacacacacccttattatacaacttagtttccggactgcaacagttgtctagatgtttctgagttaggaaacttgttgaatcgatatgcaggtcttctctctgtttaggtctcatttacccatcacacatatatttatcaaatatattcttaaggtttccttctccaatttcatgagagacagcctaacattccaggccaagtttccagcagtcacgctggctctcttcataaatctgtaaaataaaaatgagctttctcctttgtgaaatctcttttttataagcttaatagagacccagacaagcctgagggatagctctgttgacctcatcaagtttcttgcagcaggatgtctctgcgaaagtgggcttttaaccatttcgcatactttgaactgtggagctgacctagctgtggagaggaattgattaattagcagtgatggtggatacttattaagcaccacgttgtgccttttgccttgtgctgtgttagatgtttggtgtatattaacccctttactgtcgaaggccatctgtgtgataaacatttactctcattgatgaggaaagctggcttatggtcacacagagaccacaagtaccagaatagtggttggaccaaggcatcccaacttcaggtttcacccacgtagccaacagcgagaattacatcctaccaatgtttagagactttcttcctgtgcatcttcagagacactgggcgtgcaggcagtagagaagtatttcacctgtcaccaatgggcccatttaacagaaaaacagcagaacactcagcattcctttttaaccagctatgtcagccatgatttagataatgagtgtgcatattggtcctacctctgtgtcatctgatttaatggagattccagttagtggcagcttatccggttactttagagactgattaatgagttgtcactgttttattggatatcggtcatcagaggcaggaatacaagtgtctctagcatctgagcaacccagaacattcaacaagtaataaatgaaaacgtcagggccctttagatgtgtgatttatgtacatacccttggggtactacacttactataaaacctacaatgcaatccttatccaaaattctgatggttttaatgtttaaatattctgcttgtgaaatatcatatggctttgagcaaataactgtcaggcctgtcgaaatctttttgtaatgggaagactgtgaaattatagttgtgaaatttgatgattttgaagaagaattaattactgaagtttttacagcagattcactttcattacccatttttctttctattgtaacgtctgtgctcggttttcctacatggattacaaccttctagatgctgactgacctctcatttcagctcatttttttaagatgggaattgattgacattttcaccagtcacgctggctctcttcataaatctgtaaaataaaaatgagctttctcctttgtgaaatctcttttttataagcttaatagagacccagacaagcctgagggatagctctgttgacctcatcaagtttcttgcagcaggatgtctccgcgaaagtgggcttttaaccatttccttttaaggaactctgtgtgttaatgataattgtggtatcttgacagtaattgctgggacaactggaaacctaaaggcaaatactggtagtcacagaactgtttgagtgcctgaaagagaaaagaatctctttgaactacctgatccaactctcccgacatcatccatgccccagcctctagaatgactgactcttcctaaaacacatcctttgcttcagttcctctgggcctttgcatacacagttccttcccctgggagaatctttctgcagatgctatctcttccacgcaagcagtttggagttctcttctgctgatcatcacacccattaatgactcttccttgtagtccctttgctgtttgctatttggatagacaagagtgactgccttcactgcattcaggcacaactatttatgattaggaatcaaaccgtgcacctgcacacaagctccctgaaggcaagtagatagtctttgcacctggtaaataaaattaagtgcttctggtgtgaactgagtcttcaggaaaggctattaattcttactgccaaattcagctagctttcatggaacctagaagcagctgccggggaagttgtgactttggcttctctttccctcattttccctagagcagtagttttcaatctcagcttccctttggaatcacctggagagcttaagaaataccaatgcctgggtcttacccctcaaaattctgaggtacagtggaatggttccttgtcgtgacctagacataggatttgtattgtctcccggcatattctaatgtacagccagggctgcgatcttctgagctggtgaacgtgaagtttggctgtcccttcatgggctttatagttttatctgcaggcctcactttttatgggcagttgacctcacctcacttcattttgtgtgatcttggccagacaggctagcacctgcaaagactgaggtatgaaaagggaatgctattcatttttctttcctttcttcttttttttttttttttttttaaaaaaaaagcatttgacttttgaatatcccttgagctggatgtatgaattaactaaaattattatggttgtcttctatttactgtatatattctgaaattctagtgctcaaattgtttcttctgttaacttttgacagtattagaagatttagaatttgataaggatttcctgccttgactattctgtatcttagatgtttctattttgaggagctaaaatggtataatgatagatctggaagttataaaaccttttgctgttcaaattgaccgtaccaaattgaccatcatctccttgttctttctgagagttagatgcataatcaggcataatctcataatgttaccaatttatttcatgtgattgggtccaagagttacagagtaactgaaatatcccaggtggaaatataaggcaactggatttgcctgcccagagaatgaggagcctcattcacttgttggaaatgcagttttatctgagctttactccagtaccgtccatgatgactgcaagccagaatataacttgactcttttcatgtcgttggcagaatttgttaccaaattcctctgcctttagttgtataaatcatcccctttagttacttccctgttttatggctaatgctctgagttatttacccatttgaggacataatgctctagttgaagcttaaataaatcttgagtccctaggagatgcctggtgtcctataatgattcaatcttttagagttgcttagactgggacttgcatcttatctcttgttctaatgatttcatctccgtgaactgtggtttcccttcttccataaaatggagataacataatataacctaacagggttgttctttctgcaccttaaatgaaaaaaaaaaaaagaaaaaagaaaaacaagtctaagtacctagggccgcatctgattcataaggaacccttccatagtacatcgtaggtattttttagttctgtttttctaaactcaatttccagttacatttttccaattatttcccccagtaaaaggaactttgggctataaatatgaattatgctatataatgcttggtttcaaactgttctgagcatttccaaagatgttttggataataaagcatgcatgtgttttcatataccattgccttgcagatcaaggatgactattccattcacacaaatcacataggaaccaactcataaaaaggaaatggactccacctttttctccataggaagttccctataatagtgagatcacagcctcatttttatggtcaaactcaggacgatatttggattccccagggaagttaactttgctttcatgaagctgctgaaatataatccaagagtcaccatcagtgataaaatcatgggcttagaattgaaaagctggagttaacactccaggtatttaacagccagttaaataccaacattcttattgacaaatttagcactgaatcagagaacagccctaagcttataaagattataagattctttgggacagataaaggcaatgaactgtttttttgtttttttgttttttttttttaaaaaaaaaaaagattgtgccatttattcagtaggtgtccactcagtactacctgagattgtcattggtgatattcatttagttctttcaaagttccatgggtatttccagagtttctgcctcatcgtatacaatggctcttctggacctggcagatttgggccaggatgcctggaggaggacagcattgggcaaatgcagagaagtaccccttcacctgcacctggcctttataattttaacccctcagtggtgcgtactgtgtgagcagtggagagtccttaggctttcagcagacgttcaaggtctgcttggcattttgaaggacaagtgaatgttgcagttgtgagcctgatgcagacatttcagggagttcctagagctgccagtgtctgtttgattgaaaggatagaagttgaaatattatcagaaggccacttggaggtctgaggaaatcagagtggaaacatttcttgagggcataatatctcaaaaatgttactaatatttaaagctgggaaatttgcctttttaaaaatttttccatgataaaaatttgtagagagagaataaaatctcttttagctgcagcctcttcttcattactatctatgcattatcgctgctattcgcccaagtctctcctatctcctgccccctccccgctctcccctttagagtactgaagtattatggatgctcatttggtgttaggatgtaattatccaaggtgaagaaatttagcagaagctgtgtgctgcctatttaacatctgaaacagcttcttaatacctgccatattaatggcagcctttttccccccactatccttgtatagaagcttccttgatctttccaggaagctaaatgctctccatcctgatcattaactaataattatccaagaaggtttcagtcttgattttttgaactgactaaagaattacggctgcctgctaagtttctaagagcgatggaagaagctgggcgaggggaatgggaagtgaagtatgaagttagtaggggtcttctgagttcaaaaggcttcttgctccttttctagacagttttcctctcccgggagcctatgggaacagtaagaactcagattatgattaggatacaaagacagtccttgtggtagatatttgtttccatttctcagcatttgtccttgttttttttttctgttttcacattattgcaccaaattttcttttgggggccacccttctccaccctcagtccaagtggttcttatgagtttctatctctagccacaaagatgtagtttgtgacccaaaactggccatagtaacagatccaggaacacgcctatgacagaaatctggtcaacaggttgattctacacttctagctacagagattgtttcagagatgggcacattgattcccctagagtgatgttttgggtaactactggaaaaagacacgactattgtttctgctgtaattgaacccaggagaacgaaggtttgtagttgttttcagccactctactcccgtttgaacccaagagtgatgtcaacatggataaaacaagaccccagaaacttttcataagaaggaggtgcaggtaacacatcccttttcagtgtttctattatttcctgtttacttcctgtttctgccaggaccaattggcaacatccttcaccctggcagtggcagttggttccagattccaccctccaacccctgtagcacctgagaaccaggcttgagtttctcctcaaaaatattagcaccagcaggcagcacggtttccacagaggtcttggtcccagctccttggggacctctttcaagttctagagcctccaatgccaactgaacagtgctccttcctcagtggtctgggtttctactgtgtggggacactcctctaggttgcaatgatcaaaacttcttccctttgatccaccagcccttagaatggtagctgcttcctgctttgactgcctgttagctcaaggctccccttatgccttttcagcccttcaaaacctatgtaaacaattccttctattacattttcttttaaaataactgtggtggtttctgtttgcctttcttgacctgactgacacagccctgaaaagaaggaactaccaattctatcaaattcccatggcctcatagacatttgtgtatgattggtgatcttttctatgaaatcaactgttttcagaatgagctctgcacaccctagagaaaacctaagtgtgatggagaagtgagggtagatgtggagaagatgaatgagtccacttttcttcattataaatagcttccctttaattatctctctctctccatatatatatatatatatatatatatatatttttttttaatagatggggtcttgctgtgttgccctggctggattgcagtgagctatgagcatgaccatagttcactgcaatcttgaactcttgggctcaagtgagtctcctgcctcagccagcagagttgctgggactataggcacatgccaccatgcctggctctgtattgtatgttttggtaagatttcatgttaaaagtattccaaggatgttctctttggatatttatttattttaaaaaagtattcatttactttacgagaatgtgttaaagtaacattgtctagctatttgattgaagttgtctctttctactcctgccagaaataaattctccctacggtatgtgtcaataaactatgtttatcttagtcttaacacgttctgtttaatattagggttatatgttacatttttcttccctacttgactgtcctctccaggaaggcaagaaactggtctgtatcattaataagcacttaacaaggacataaaagtccttagaatgagtctttacatacaagctggagtacagtggacaagttagttaactctcttttagcctattggtttattttaatacaaggataataatacctactttatacaaattgtatgatcatttgaaacttaaatgaaatattaattattcttattattagttgttctgcaaaacttctcattgtcgacattccagcacttccactcacttggtcctcagaaaatatctattgaataaaatgaactcttgcagttactttgccacatgacaagccacccagaaacttggtggcttaaaatagcaaactgaggattcttcccgaattgctatacattttgtttatgcattcaaggtgtaaatggagccttttctatgtaaaaacaaccaagctgtagacttctttgtgtaaatttactgtgtaaaaataagattttttttttctttactattaggtcaactagcctcatttacatcttttattaaacatactcacaactggtggtatttttttcctttatgaacaaagcgaaattatagattccacccaaatcatgttggaatcctgctaggtgaaaattatatgtctgtaagagctacgtggaatctagtttccagatggaattcccttcttgccaattttgggaatattctacaaagtttccccttagaaaccatttacatgaagtgaaaaatttactctaggaaaatgattggagagaatgcttgtgaaatgtgaaggcatgacttgcatatggacagtatacacattcatagatattttacccgtgccgttgagatagctagtaataatgtgtgttctcattgtgtttgctcttgtctgtagagaccaccagaaactgatttagcctgaggaatatatttcaaactgaaatttttattgtaaagtaattgcaaataacgtgtaattaaaagtgatgagaaccccttacatttgtatagcatgtttactttccaaagcacgtcatgacctcttgcttttataattctaaaaaattcttgaaagataggaaaggcaagttctattaatattatatttggacaaagaggcaaatagatattacagctgagtattcttaaatatgcaagtgatattttgttttgttgacaccttggtttgttgatttgaaagcccagtgcttttgatttagcttcaggtttggtaaaaaaggagaacagtatttactgaatgaataaacttcccctttgtaacatatttgtgtcacaactctgcaattatacaaagagactgatgtctgccttgtgggaactataattgccacttggacaagtttcatgtggttgacattaatagaccatgctgattatgactgacaaccaggggttcttaaacttatccagtaaaagggttttttcccctaatatcaaattcacaagccactattctatagtaataaaaaggcaactatgaatttggtaacgtttaaaaagttatttgcattttattaactacaactaatgtatacatttgtaaagtagtaacagatgtatgcatgaaacatgctattcatgataaaagctagtcttcatacacataggaattctcaaaactcttgaactaacccagtgttcccctgggagatcatggttaatgagttgggaagctttggcataactagagatagccattacactacattccatgtgtcaatgccaacaggaggaatgaccgcctgaagaggtgtgttgaaaaggattctgagagctagtttgggttcagagcaaagagtactgtcattaattagtgatgtttgccagaggaggaggaagtaatgggtgggaagagccaaacatttgccttacctgacttagactatgtggaccacttgactccagcaaaggataatggagatgaccactaatatctagatataacaaaggattaatctaagaagtcagttaaaatatacttttaggccaggtgtggtggctcacacctgtaatcccagcactttgggaggccaaggtgggtggatcacttgaggtcgggagttcaagaccagcctggccaacatggtgaaaccccgtctctactaaaaatgcaaaactagctgggtgtggtggtgcaggcctgtactcccagctacttgagaagctgaggcaggagaatcatgtgaacccgggaggcagaggttgcagtgagccaagattgtgccactgcactccagcctgggcaacagagcaagactccatctcaaaaaacaaacaaacaaaaaactttaaaaactactgtaaaatataaagcttattttaaaataagcacatttaaaaacaggttacatttactgaatattttattccaaacttcccctgctattaagcaccttgttcttgatcctacagcttgaggaaaacctctgtttttctctcaagacaaattgatgattgaagtatcctagtcccttctatgattttagccattcgatgaaggatctttgcacccatcagttgatactcactcatgttgcagccatctcacatagcttgtagtttttgtttgtttgtttttttccagaaacaaggtctcaccctgtcacccgagctggaatgtagtggcacaatcacgactcactgcaaccttgagctcctaagctcaagcaatccgcatgcgccaccatgcctggctaatttttaaattttttggtagagatggggttctccctgtgttgcccaggctagtcttgagctcctgggttcaaatgatcctcctgcttcagcctcccaacgtgttgggattacaggcatgagccaccatgcctgacccatctaactggctgttcttttcacgaaagacaagtcattccctgacaccatttactcagaaatgggagggagtggagatatggagaaaagtatctggtagatgactttgctctatctgtgcaatatcactgtttatagacatgcatttccctaataatttaagtcacttgccctatgaactagccaacctgcttcctcactggtttttgaaatatctttagagaaaaaatattccagtgatatgtttaatttatatgttaaccattcttggaatctcccagtcccttctaaaactcttttgccttagctttatcccactctgactgtattgaagataattaaacataatcacatcatctgacccttatgtacctgttcagatggtaattgtctttcagaactccatcttaagatagcaccttcttagccgtccctggaaattaattgctctgcctctagatcggctttgtttctatcttaattattgctctgcctgaaaagtctattttttgcttgggctttttgaggtgaggatacatgtcttagtcatccttgtatctccaatgcctcgaactgtgaatagctcctggtaaatgggcataaacactgggtaggactgacactcctctgaggcacttacctcccgtggagggagacctgatttgatttttttactctctttctaccctcagcatattccccagtaaaagctagcttgtacctttttctttacttgatatactctctccctatttttttggagattatatcactttttcaatactctatataggtagagtcataaataaagataactaaggtgaatgagatttgccacatttatatgtaggaatttctaaacaccttagaatgaagtgcctttataagaagaatgaggcctactttcatgggatatttaaagtataaatgctatttttttattttgtttttaaaaagatgtatctaccatgatacgtcataactttagaatagtttttgacttttaacatgaaaatgaaaaccagcatttagccactcaagccatgttcctgaaggggagccaggcaaggtggagagtgatgatggggtacagctctgtctgtgttaagagctttcaggtgtcctggcttcagcaaggttctggcccaggccgtgagacaaatgcttggcaatctcgggatggagtttgcagagcaggcagaattttctcctcataactttagaacagatgaatacacatttcctagattccttgaggggagcgccagctcagggctatccatagtccacaatcgggcagggtgttgggcttcaattcttctctaagcgtgtgaggcatgagaaaacggggcaaccctgcaggtcgggaggaaggggtagacatgtggctggggctccacaagagtgacggtcatttcatcaacatccaaagaccttgcatgaagatctaacctccatcactgtacccacaagtgctcccatgtgcccaccttacctttggtggcatctcttctttcgtaccctgtggaggaaggtgacttccatggccacacctcttataccatccatatttactgagcccatgcttaatgtatcagacagggtcctcagctccgtggacacagtgataagcaagtaacacatggctccagctgccatagagtttttaccctagtgaagggaaagtaaacaagtaagtgacatattttgttaaattctgtgtactgtaaaggaaatgaaacagagttatgtaatagagaaggacattatggagtgagggtggtggcagggggttactttaagtttgatcccagactttcttgatcagaaaaagtcgtggctgggcattctgcacaagtctttgcatctgtgtgcttattctttcattcatttgttcattcattcattctttcattcattccataaccataaatgctttgatctatttagctcattgcctggcattgttaacatatacagattaggcaggcttccaaattattttagccctgaggatatattaattcattcaattaaagtaattattcaagtactgtgttgacaatcccacctgcatacagccattggtatggggcaaaggctggtaaaagaacacaagatggtgtgattcatttagggtctgacaaagtgaacggtggcatttttatgaactggatcagaatctaacaaaatgcccggaattgttaagctcctcacactgtgatttggcctatgggcatgtcactggaaccagtggtctcatcattctttgctattccttccctctatttttctatatcataacaattccagtctgatttctctctaacatacttcctgtgaaaacctttaaaacaagggcttggagagatactaagaagaaaagagactgtattataattacaaagtgaattttatttatttaaactgattatgtgacagttgctactctgtaagcagccctccaaaattatttttgtcctctgaaagaaggtatttcatggctagagaagctcctaaagactctttaaggtttccctagagcctataaaaattgaaattttttgttttactcctgaggaggaacattccttagaggcccagcaagtctttatagatgcaatcataatttgcagctatttattgcaaatgcactgggtgctgaagttgggcattgcagcagatactgttgctgtcctgcccatggtcctcctgtctatgctcaccatgtccatacaacctgacatccactcaggagaaagtgtgttgctctatgaaggcattctctggctgctggaacctgctctgctgaagatcaggcaagtccagaatgccaaggaattgacatccactacatcccagctgtcctagatccacgagtgatgggattggtggataagtacccatctcctttgctcctcagacaagccaactccgaagtgtatgttctataccatttcccaaagtttcccagtgggctgtagccctagctgtccacagtggcaactgctttgtccttcaaatatatttgtttgcattatcctccaaataaattacttgtgctgaaatctctgcctgaaggtcagcttgtggaagagccaaactaagacaggtacattgcatacattatctcagttaatctttcctacctctccaaggcgaaacattgcactccccgttttacagatgagaaaactgggattcaggaggttatttttttctctctctctcattccaaatattctctgtctctcctctctctcttattccaaatctccttttctttatattttattgtgaagaaagtggccacagtatatggtctcttaggaaggtgcagccatgtggttaatgaattttgcagcagaagaataaatcaaatatttattgattcaaattggtgtaggcatggtaaaaaaatgtgaaaagtagaactttgtttattcattccacaaatgtttattttctgctaccaagtgccaggtactctgtttcttcctgagtgtatagtggcaagggagaggaggccctctgagaacagcagactgcattctaatttgtatgaagttcttactgaaatgaaagtttctgtgatgttaagattgtatgctactattcagtaaatgtctagaaagggcaatctgatttccgagcttctaccatgatgccagttaggtggctatatgtcagaaagcagagtccaggttctctctttttactttctggatagacctttactctttagatggcaaattttatgttttcctcccactagactataaatgtcttttgtagataatgaatatgtctgccgctgcattgaatttgaataaggactaatggccagtatcagaacataattaaatgcaggatccacatcaactaacaaaattagatgcaggacccctttcaaaagtacttgtgctgaggaagtactgaacatgtcaagaggatacttcctccatacttctattcaattaaaaaaaaaaagaaagagaaagaagctattgatttcagttagtgggaagaaattgggtttagccttgatggtgtcttaactacaaacgaaaccaatatcctggtgttgttcctgttccattcctcatgctctgatgatttcacagttgactagtgatttgcaccttgcttcaaattacttaggatgtattatggcattatctatgaaaacagtttgactcaagaaaaaaaacagcttgtagacaaagagagaagctcagtggctgtgcagtcacagagcagagagggcttaaaaggtttgtctggacatggaagcaccatctttgtgtcaataaggtgagtttgttccacacactttgccttttgtgtgcttcttttattttttctattatccgtcttctgctgttcttgcatcctttctcctcagatagatcttctgtatcaaaaggccatgctctaagccatcttcctttctcttcctcctccctgtcagcaatctcaatctccatgcaaagtatcactctgtcatgcaataagacattgtccccaccttgggaacatttttgctctcttagaagtattagaagatggaaaaatattcaagacccaaaggatgaacccataataatggaatttctgttcactttgcaagacctccaagaatggaaggggggatatttttgaaacacatttctatatagttcctatcattttcactgagatcactagaatatagaagatatttaggagctcatgtagtgaacactaaagccaattgctgacaaccactgattgacagctatgcattcaacactgacatacgttctgtgaggaattaagaaattaaaaagaagaaaaagtaatacatggtcctgatcctataagagattactgctggctaggaaatgtatataatatgcacaaaaacgattgatgttaaaatctgttgattggcatagtcagagatgagcaaaagaaaggaggtgggaaatggggatgatctgaaatgaaaggtagaattcatttgcaggaagaaaagaaggtagcacaggtgagggcatggaaactggaacaaacagggtacacatggaatactgggatgtggctgaactgaaagtccatgttggggagttgtgaaatacaagtgggtagtgagatcaatgtcaagctacggagggcctgggatccacaaagatgatggagcttatgggaagcagggccccagtgtgtccttaggcagggtcatgcctggcagttgggtacaaaaggggctggaagcagaggagggggagagaaatccaagtaaggagaccgactgagcaagaatccagtccacaagaaaggggccttgggcctgggcgatgccagtgggaatgtaaggagccatccaaagagcatgtccagaagacaacaggatacattcaagatggagaacgcatcagaagggattaagggggtttatgcaaatggccccagacacctcatcccaatattactcctagcagtaatgtaccaagcaccgactccataccaggccctattctaaaggttttctttttttaacttattttaccctcataatgatatgaggtctctttatttccactttctagaggcacaggtaagttaagcaatttgctctaggcctcaccaaaaaattagttgaaaacaacttagttgtcaacttgacaattctatagtttgcccatatttctcagaagtaagtctatttatctttctgtaccatttttattttattttattttatttttttgagacagagtcttgctctgtcacccagattggcgtataatggtgcaatctcagctcactgcaacctccgcctgccgggttcaagcaattctcctgcctcagtctcccaagtagctgagattacaggcatgtgccaccacacccagctaattttttgtatttttagtagagacggggtttcaccatgttagctaggatggtctcgatctcctgaccccatgatctgcctgcctatgcctcctaaagtgctgggattataggcatgagccactgcgcccagccctttctgtacaattttgaataaacttcccttcttctcagcctcttggatgtttgtttcaccttgtcactgtaaaactgaagcctggctttcccctgaggtaccatctcctcctaaccttcaacaggggttggagggggaaactactcctttgtatgtcatctccctgccacctgcggagtacggaggaagagccagggcatcccttgcacttccgggccactttcttgtcctgcagagataccaccaatcccatcttggcttgtgtccacaaccctcatgggctctccctttccaccctcactgcctccatctgtggtggtccagggctgtttctcagtggcaggacactggccaccttcttgcctattcttctctgccattgtttctggggatattacatcctgatgtagcagttcctgtattcttctgcctctatttcagccgccatcccagaccttgccttacctacagcttctgcatcactgtgattctgaacatagaactcctctctgccacctttgatctcttgtcctccctcacttccttctttgccttctctcagtccttggctttgctgatgctctgttccctggcatgcttcctggtctcccaactcatctctattcttgggcttataaaaagttttttccgcctccttcatccatcttggatcctatggttgattatatcaacaatggtcttgtatgtgcccctttctcctctttgttttttgtcctttcccttctttattagtcacttagttctcatccttggggaaatactgctactcatattttccaattctcttccaaaactatcaacatagggatgacaggccagctgtattttcccatcacacatgctctccttccacacttgaacttctgttgcttctcagctgggcccttaccacttatcagtactcctagggatcatctctaatcacttgcctactacatccttccctgcattcaatcccagtgttccctgctccactcaaggaatggcagttcaggaaagagtactcattataccacccattgtgcgaagcatttgatatgattgcatatattcaaacctcaacctggtgtaggtagtgttattctcatttttttcatatgataactctgggactgagacagtaacttacacagaactcaaaaaaaactttatgtttcatgtctgtttgattcccacacctgtgggttttcaggtcgtaataaagcctccactgctgacctgaccttctgccaagtttactctgtagattacttagtttctttcttaaatgagataaatgaacctgtaacatgggactttccagttccttcttcttttccaccacattttttttgtatcttcatccatttccttctccttcttttctgtctaaaagaaggaattatcccctaatcttccttacagtcagctcctctgcctttgttatggattccaactcttctacctctttctccagattgatgatctgtcagttatcctcctctttctgatcacttttcattcccccttccaaactaaatatttttctttcacagcaaacaaatctgtcctcttacttaaaaacaaacaagcaaaaaactacttttcttgactttaagatcctgaacaagcttatcttctacctttcctaaaactccttgaataaagagactacatttactgtttttaccatctccccgcaatgatcccaaatcattttcaatgtggcatcttcctctttcctgatcccaaaccatttccttaaagtatataccaacaaccacataggaacagagccaacttctgtattctgggtgctcatttttcttaagttttctgtagctttgagtgcttcaacactatctcttcttttttgaaaaaggctttctcttgacttttctatgttttcttggttcttttttcacctattggcccacatctttcccaggtgctctttcctagctaatcttcttcctttatttccattttgtctctctttactctttcctttaagtaatgtgtcttacttaactgcaggcttagaagactatacccttctctaactttgacttttcaagtgaattcagtttggacatctccttcatttgtttcactggcctcagatttactttgtctaatactaaatctatcatcttatttttctttcccttcctgttttttttctattaataacaccattattcaagccttaaatcccgttgctcataactatttctttcaccttgttcccacatgtaatttgttgtcaattattttccagccttttttctctccacatctgttgaatatttcccaccttttcccctcttgctatcatccaagtttattctatttcctatcatttcagtacttgttttattaactagtttcttaccttatgttccaatgttctttcccataactaaacttggtgcagtaaaatccatgccttatgcttttcgggccctgtacctatgctcacagtacctctacagaatcttgttttctatttcttatttaaatcccattattctagggagtttgccataaatacatttcttccaggaaatttttctggtcttctgttctctgctttttatccctaatctggtaagaatctttcttgcccctaaactcctaaaacatctttttctcatacttctagtttattgtcttaatcctaatagaaaacaatagcaagaatgaacttttgagcccctccacccaaattgactcatctttatcacttactagctgtgtggccttaaactagttatttcacatctctgagcttcatattactcatccaagtaactaaaataataaggcctggccttcaggtatattgggaagattagaaacaatatatggcatggtccttaacagtgtgtttggcccagaaccaccattcaatagatgttgagtgaaacactttctctaggtagagtatggggtgctgaagagtatgtacagactagggtatagagtaggcattcaaaaatatttgcacagtgaaagggctgggattataagaggcaaacatctaccatcaatcctctgtcagttttaaaatctgtccaccagatatcagagaagaataaaattagactgggtgaatgtctgacccatttatcatctatcagggagtaacttttgcctgaagacatccccccaggacaatagaaaccagcattctaacattgaatttcaactgtttgtagtgaggacagccatccctggtcccattttctgagctgagtattaaatttactgtttcctaagcttgaaggaattctacacttgcatgcattttaaaaaataatagctattggttgtgctacagtgactttgccaattcccttagtttccaactctgctaatatccatcctgctcttaacagcttcctgacttgtttcctttctctagtcccagtttgcttttctcttcacaagtgatatccacgtgggtttactaatcagatttgcatgtttttcaatagcacactcctcaaagtgtccgttttctatcagctaaaagaagcaaaattaagatcttttgttttccaacatagaagtgtgtctgcatgttccagagtgtggttttggagttcagactgcctagatttgaatcctggctcaagcccctgttagctctgtgagtctaggcaaactcatgccattgcggacctcagtttgtttctccataaaataggaacgagaattaattatgtctaatctgaaatagtatcattgggagaacctaaatgaaataaggcaattgaaaactcttaagatagtgcatatctcattgtaagagctcgatatacattagctgttaataacaacattttatcataaatcatttataactagcaacttcatggttgatttatgctttagctttccaaattgtatttctatttattcattctacgtttgtggatgtttatttttttgttggtttgtttttattatcccttaggatgaaatttcacttaatgagcgaggcttcatgttgtcccaactacccaccttgcacagcgttgacatctgagcggggatagtgtgagcaaaagataatggactagaaagcatctcacactctacagtggagatcttctctcaacctctaatttggtggttctcatctttctttgctttttcctgcttcagaatgcctaatgtactcccatcaatatcagtagctggctgattttcatgaagtacagattaaaaatgagcaatcggaaaactgactcagttccagggtgcctgccagcatacacagtaacttcatacaaatcagagaaaaaccaccctttgggaacagaggcaaccccataggtgcgtggcttgacagtttaattgcttttgtgcaagagaaagtagttcgttcttaggggtcagagtggggaggttgtcacccttgaacttgaacacagaccttggcagctgaccctggctggatgtcagccctatccactccttgacttagcacaacctgcatggaggccttgtcctgtaggcatatgtctccccacagcaggtaggaatcaccgttgtactcggaggcaggatcgcttccccctcgcccctacggtcagctctctgtacctgggggatccgcatctgcagattcaacagttgctgattgaaaatattcagaaaaaaaaaataaataacaatacagcaattaaaaaatagtgcaaataaagaatatagtatagcaactattaacatcacatttacattttattaggtattataagtaatctagggcctattttaaatgtttaagaggatgtgcataggttgtatgcaaatactattccattttttatcagagacttgagcatctgtggtttcagtgtctgtgggaggtcctggaaccaattcccttaggataccaaggtaggactgtatagtaacatctgctctgcacctcaccatcccaccactacaaggtacctctttgttgcttttcctggatgatgaatctgcaagaaagtttgaaagccatgctgatgaaagtttttctgctggcattaaagatgtggcaagctttctgttaggtaggaatgaaaggtggggacaaattcttttccttggcaactgcatgagagtatccaggaaaatcacattcagatgggagatcatttaatgcagcctatggagggtgaaaacagaactacatttgtcagcatttacagccatcattgtgttccctcagcaaacctccccatgctgcagcagccacaccccgcagtcatccatcatgctggctgaagagccctggccgcctgccacacacgtgccaaggggaagccccatgccccgttagtgtcagcatgtgctgtgacttgtaacaaagacaggaatgagtcctcgtccagatagccatgtaatcctcagagaagagtgcactgtggctgctgcaggcttgcccagaaagtctcctaccatctgaagggtaattctgatggcagaaaacattcaatcccactattcttagcctgactttctacttctagctttttcaggctcatcaaaccctctaaaatcatttgaggagaagaaaatgttcttcgttgcgttctataagggaaatatattgcaaaaaaaggaaccataggcgaacaaagaaagggaggagatggggccacccctattcttccattaaatttatgtcactcagccttgagagtcaagcaaaatgtttgaggccaaatacatcttttattaagttgtaatacaaagataagttatctagatttttgactgatttggcacttcacaatgttatactttttcgaatcccaaattctagcaactataagatgccactgtaattttgtatacctttagaatacattaaatatgatacaatgccttattaccccttaaaatttgtattttatatttatcaaaagagcacttttagattcactttagacacaggcttttgtgacatatcactctttcgcacacagaaaaggaaaatgaaagtgaaataaggagaatgaggtattccttagccttcataaagttggaatcttctgaatcactgtgctgctcaaagtcactgatagtcaagttttcttttggcataggatttgcctctgtgacatcagaaagtattgatgatgtggcctctcctgaaaacaaaacaaaacaaacatacaggcttggttttccaattttaaaactatattgttgttttgcccccccccggtaagtctgtcaactgagcacagtgtagtttttacatccttactttggtgtttccctgagctggtagagttgtatttgagacaaaataactattcattcaattggattgctgcattctacttcagtaacagagaagaaaaaccagcaagatatccctgtaaagcattgctatggttttggaatcctgcagataaaatggaatgtcttcaggtgtttgaaaatctgggtcatatgtctctacttgggaacttgaaaaatgtttgataaatgtgtttgatttcaagatgatggtgtttcttttggtttgtcagaaactggctctgatacatatttgtaagaaagaggaaaaatctcgaattactcattagactatcaacaatatgcccattctttgaagtctgactgaaatcctttcttctctatggcatcttctagatttccgcttggactgatctccactgtatctgaatttctatagtgtttttgctccccttttccattccttttctctatttttagtttttttttttttttttttgagacagggcctcactctgtcacccgtgccggactacagtggcgtaatcacagcaaactgcagccttgaatttctgggctcaagtgatcctcctgcctcagcctcccaagtagctgggactacaggcacgcaccaccatagcaggcaaacttcttttgtatacataggacatcactatattgcccaggttggccttgaactcctggcctcaagtgatccttctacacatattttacagctgtgaacctccatgcccagcctggtgtattattttttaaatcagacttttaaatcagatttttaatgaggttttttttcatcagattctgtctttggatacctgttatattatttttaaaatttgacgggtatgtgcgagttttaaaatttgagacaaaaagttggataaaagacatctgagaggcaatccctctcagttggacagggagaaaggagggagagaggaggggagtaaacccaatgaagggtacattaacaaatgggttattgctgtggcaacaagggttcatttttgttggagactgtggtagcctgaactatggcctcaaaaagaggtccgcgtcctagttcacagaacctatgaatatgtttccttgcatggcaaaagagactttacagatattgatgaagttcaggatattgggatgggaggattctggatgatccacatgggcccaatgtgatcgcaatggtccttatatgaggaaggcaggagggtcagagtcagagaagacaatgcaccgtaacagcagaagcagagggagggaaggagatgtgatagtggaatcagatgttgcagtgacgtgaggaaaaagccatgagccaaggaatgcatgtggcctctgaaagctggagaacacaagggcatggatttgctccagtgcctccagcaggaatgcaatcctgcccaagccatgatttttgctcagtaaaattcatttcagaatattggcctgcagaactgtaaggtaatgcatttgtgttgttctaagtcactgagtttataggggggttgttacagcagcagtaggaaaccaatagaagggttcatttttctgagaaaccatatggaccaggcttcatagctgtgccagtgaggttcgaggaggctgaggtatttgcccatcaattctcatcacttactggataaggattattcccagaggtggcagctttctatcggttctggcttgttcaagctgtgcaccctcctgtcccctctaggggccagagaaagtctttagaaagacaggtctatataaaataagatgccataggcttgtctacaacttgtctactgatgatgcatgtgacatgtgggatggatcaagggaagatgggtgcactggaattacctgccaccatgtgtaagtacgtgtatgcatggttgcgtgcatgactgtgtgtgtgtgtctgtgtgtgtgtgtgtgtgtgtttcttcctccccctttattaagtttttttgagcctagacgttctctcccattgaccagagccccaagcacagcacccaaatctgggaaaaacacttcttgaatgattgggtggcagaatgtgacagcctgtgaatgtcacagtaaataagggagttggctattttacagtgatgtcttctctaattcttaaattaagactgtgcagagaaggaagaattgctattccttggaaagattcaagagactctggagatgctatgtagtttggttgcaaggtggctgtcaatcacaaatgcaagttgtcaccaggcaaaatggccctgtcctgctgcgtgaccaatctgcaatctaagactggctcatcaaggttagcagataaatcaacacaaaaagagatgaacattgcaggcagtgctgatgtcaaacagagatttcatgcatctggcagaaaattgagcatattggtaaagcactaaagacttccttcatgaaagttctttgctccctggtcctgaaaggaaaattagattaatgctcacaaatccttcttgacatctgaaggatggccttctcttgacaaggctctagacaggaaaatgtgaggaacaccagcatggccttccctttgctaggtatctaatctaacctagctttctggaggcacttgttaagtactagattctcgctctctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtttttagccaggatggtctcgatctcctgacctcgtgatccgcccgcctcggcctcccaaagtgctgggattacaggcgtgagccaccgcgcccggcctagattctctctcttaacccttggcattattattatttttagcagttagcttcagcaagtgaagcactgctgattggagatgtgttttgtattctgactgtacttgcaagctctaccaagtacattagccttcaaaacatatttacgataaaggctgagtgcctgttccttaagagaaacctgcagaatggtctttatttttcacaccagctgcttcttcagatttgaacatgccagacaaatgtttgatgctcttgaatggtgtttgagtaaattaattgacacccaccgactgtcaaaatgtatgtattatgtatgtaaatataaaaacacctatatgcatgaatatgcagagatatgttttaagggtcattttgtggctaaaatatttgaaaataataatataagtaaagtatgatatgaaaattaatcttgtagaaaagtcagcagaacctaatggagattttagtgtagagaagaatgtgattaagccacagtagatccagaattttgctaatgatataaagtccttattgttaccagcctcaaggaaatccctgtctagtgcatattcatggagagtgaacgatgagcttgtgaaacatgtgagatgcaagtacagaaatgttggcccaactctattaaaaaccaatgtgtctcataattaagactctaaacacccccccttaaaactggccaaatgttggaatgagctggtgcccgccgcttcttaactcttcgctccagttttggggtctgtgcctcataaccatagtcacttttaaccaattctggttgcctccctgacagaacctgggattctgtgccatttctatgtgtgcccctattttaggaactaggtctaaagtaattaacagtttagaagtgataatctagtgaattagcttttgtgagggttgttttataatagcacaattcccttgttcactgcctactcctcctctgccccccttctccactgccttctcttccctgtcctgccctgtggatggctgcctgagttcttgctggctagcctctggttgggtttgtgtcataggggtgggaaggagtcaggttaccaggaggatgggacattgggagaaagtgattcgtgtatttcttacttgtctccaactccccatttcccaatccttcatttccccatgccactcccttttttccccacctggctatccttcccacccctgcgttgataccatctttttggaatgacgttgtccctccatgactgtggttagctgggaagcctgtacttcccagctcctgctctctcttgttgggctatggttacattattcccccacacttccacctctgagtgtctccatgtatcttgcctgtattttaaccatgcctgtgtcttcgtaagtggtccctttatcaaatttctgcatttaaaacatctatggaaatcctatttcctacctagaccctgatggttacactttactttctctaaccatagcattcttcaaacatgaaggaccacacgtatttaatatttaatcataccatgcttaagttgatacattggaatgccatagttctcatttcgctagcatgctattcaaaactttatttgtgagagaaacaaaaatagaagatgccatgtaagataacattatggtctgggtttatctgcacatgtcagtacatacctgcagagataggatctttgtctatggaagcaaaccaggaaggtatctgaatgccttggttcagtacccatcactctggaaatgactgaatgactgatgtgctttctaaacatgaggcagaggctggccaaatttcctttcaatctgggtgatgaaagctaagatgaggtaaatgttgtcacattgtgtttacattctactatatagtatatatggtatgtatatttctatgtatatgatatatatgtttacctacacatgtacacaatagagagagataatctcaaatatgaatggtactgcttaaacgcagtgttaactaaaagaactgcattacataaataaatattatggttataaaagaaaagaaaagccagagagcctactctcatgctttcgttgtatagctaaagtcatagaaaataaacattaaaaaaaaaaaactaatatttacaagacagcatacaaatgtctgtagtttaatttgggtataaacaagctacacaggtgctgaaggaattgcctgcagttaagagagaaggtgactatgcagaaataaattctaagacagggctggcttctgcccttatggaaaggtaaattagcccactgatacataatattagtggccaccaaaccattgtgacatcttgaatttcttctttttttttctttttctacggaagtctttacgggattgttagaacagcattggggggtttgtgaatcattatttattttggaggtatggagggaggtagcaaggaatgaattgtcatacccacacatgcctatccaggctcggatttcctcctttacttcaggccatacagatgattccactgtcctcttctctgttctcttgaaactgccactgcctgttccatcccaggctttctctcttaaacctggctgaagtaaaagccaagatttcgtttatttccttcttactcttaaagaacaaactcacagttactttaagttttcaaggttttttactaataagtatggtataataaagatttgacagataccacaccaaagaagatatacagatggcaagtaagcatgtgaaaaaatgcccgacatcatatgtcataaggtaaatacaaattaaaacaacagaaagatacccttacacacctattagaatggccaaaatccaaaacacggacaataccaattgtcgatgaggatgtgcagaaacagaaactctccttcattgctggtcttggcatagggattgtaaagcttaagaaaatacattgaagtccttgatctactgtctctaacccttcaaagggggtaaactcttttgtgcgaataccaaggtgtgagattgctgggtagtgtgataaaagtatattgagttttgtaagaaactgacaaactgtcttctaaagggctgtaacattttgtatccccaccggcaatgaatgagagtccctgttgttccacattcttaccagcattcggtattgtcagtgttttggatcttggccattctaatagatgtgtaatggtatctctttgttgttttaatttgcatttctcttatgacatatgatgttgagcatctttacatatgcctatttgccatctgtgtatcttctttggtggggtgtttgttgaagtcttttgccaatttttaattgggttgttcatttatttattagtgagttttaagagtttcttgtatatttaggataaaaatcctttatcaagtatgtcttttgcaaatattttcactctatctgtggcttgccttctcattctattgatgttgtctttcacagagcagatgttttttaattttaatgaaatttagcttatttttttcataaagcatgtatttggtgtcatatctaaaatgtcaccagtatatccaaagttgcctaggttttatcctgttatcccctaggagttttatagttccttgttttaaatttaggactattattaactttgaattattttttgtgaagtgtgtaaaatctgtgtcacgatccatttcttgcatgtgattgtccagttgttccagcccagtttgttgaaaagacttgcttcattgtagtgtctttgcttctttgttaaagattagttgactatatttacgagggtctatttatggactctgtattgttttccattgatctatttctccatccttttgccaataccacactgtcttgattactgaagctttatggtaagtcttgaagtcaggtaatatcagtcctctgactgttttccaatattgtgttggctattctggggcttttatctctccacataaactttagaatcagtttgtttatatccacaaaataacttgctggaatctgggttgggattgcattgaaaatatagattcttctttccaactgaaaagttgggaagaactgacatcttgacaatattgagtatttctatccatgcacatagactatctcttcatttatttagttctcctttgattttttttttatcagttttggagttgtcctcatatagatcttttacatattttgttagatttacacctaagtatttcattttcaggtagctaatatagacggtattttgtttttaatttcaaaatctactagtttattgttggtacataggagaatgtttgacttttgtatattaaccttctatcttgcaatcttgctataattgcttattttctccaggatttttgggtcaaacctggatttcctacatagacaatcatgtcatctatggataaagacaattttacttctttctttcccatcattatgccttttattttattttattttattttattttattttattttatttttcttgtcttgctgctttatctaggacctccattgtgatgctgttaagttcctggtctgataatttcaatattccttccatatctgattctgatgcttgatctgtctcttcaaacttttgcttttttcttttagtaagtcttgtaagtttttcttgacagccaaacataatgtactacgtagaagaaaaaaaagaacgacaataaataagcctttagtcatgtggtggttagatgtcaggggaggggaagtattatatagttatgtgattagatctcagtctcttggcaaccctgtacctctgaactgtgaacatctcaagtgtttcttaggtcctccacctcttttaggtggggcaagagggctagagtaaactggaattaggcatttcctttcttctatctggaaggctagagtgggctagagttgagtatttccctttccccaggttggttaggatctgatagaaccccaatagtttaggctcaggtgaaatattttctcttgaaggcaggccttattatgacacacagaatgctgtggcatgtttcaagatgtttcttcttttttcccttcccacttctggaagcatgaggggatttttctctaatattcattgtgagaacctggtccagctcctggaggtaaaaactcacaaaagcatgatagccctggatgaatggatccccttggagtttccatcattcagactggtccacatggagcctctagtaatccgtcagttagagtttaggcttttctactccagtactcgttcctgcggaggcttctgctaagggatttctgctcagataagttgtgattctctgtacccacctgtctgtctctccagttttggggacagcagtttgctctgtgacctcacttcttcgaaggatctaaagaaagttgttgctttcttttagttggtttagctgttcacgtgttggcacatgtgttaggacagagtgacatcttccaaactccttgcatgttgaaccgcctatatattgttattctcactatctaggatgtctaggaaagtaagaaaaagatcatgtgctggctctcattttgtcatcctcctgactcttcattttctttgagcctagggacaaaaatgaaggcctgttactttgtaagaagaaaaatgtcacatgttcataagtgaaatactgagcaaacatcgactcgatttttccctgaggaattgcttcaatctacacaaaagctccaccttcccaaagaggtccatcaaagtaaatctctaacatttgtgtttaaatggatagttatttctactatgagcacatcctgaacttcttttcctgccccagcaggttttcctggcacattacaactccaggctatcttgtatctgcttactacagctcaagcaggagaacagattgatttttgatgagaaatatgccttttctggggtttccttattctaccacaaacttggtccagagctcattgtttgtgaaatactgtcattcattattaagacgaacaatgatgcctgctgtgggaaatgtgcattttaaaatgcagttttcctcctttaaaattctgtggcttatttggtctcttcattctcctgtcattcgtcaaacacttgctataccccaagtgccttgctgtggttaagaggaatgagccaggttctgtctgtttgagggaaatggtacatgcatcacttccaattacatttctctaggcattttcaggagcagtaacttatgtatgggtaaaacttagaaatccaaaaccagccaaggggatgttttaggtagaatagtaaaagatcttgtatgcaattattgcatgaatcgcagtcgattactcaggtcattctaaattcattttagatgatttaaagaaacgtatccatattactaggatgtggtgaaatccactgtatagcaatttggggagtttaagaagtttcctttgggagttgatattatagacaatgacatgtattttataatttcttcagaggtttggctataaacaagacagttttgttgaaatctgttcatctactatcagttcctcttcctcaggaagagaatctgaaaaaaaaaggtaggtaatgtcaagttccaggggcagagaggggatagtgaatccatacttgatcttaaaaattgagcccacctatacttccagtcatcactctgtggcacattgaagagcatggagcccccacctggttttccaggcctactgtgcacaacagcattcctgtacctttaggctttcttatatctttcagctttctctccttactaagcaaataagatacatttagggaaggagggctaacaagaagacctgtaggggagcaaaatgcttgtgacttgtgcagtttagtcttcacaacaagagagagtagacttatcccctcttatatgttaccggtgaagacattgaggaatagagacctgttttgctcactcagattgtacttttcaggggaaggattcaatgcctggtaggtctgactctaaagccagggtttctcttgaaccagatctcagctctctttgaattcatcaaattggtatgaaggatttattatgcagagaatatttttaccttggacagatagtcagtaattgaagccagattccaaaggtggcaaagacctagataggaatgaaaaccatcttcaagtgttgtatatcctcagagggatttctgaaacattgtgtgttcaccagcagcattagttctcactcaatgtatcagtcatatttttccgcattacaaacaacctctaaaaccaagtagctgacagcaaatagcatgtattgtcttatttacaagactgcgggttggctgtggtttaactgatcaagactgggcttggcctaaccaagctggactcttggcttctgctgggcacaggtcttttccttctttttcatttcaggtacctgtctgaaagggcagtagttatctcggacattctctttccataccagcaaacactttaaaacttcacatctgctcacataccactgactaaagcaagtcagatggccaaagtcaacattgatggggcagggaaatatgttccacccagggtggcaggctctgcaaattcagatggcaaagataagcgaagaattgggaacacttatctaatccagcactctcagaaagtgatctaaaaaaggtgtcacaagagtctaatggtgttactgctcatgtcagacttgaagctatgtcctctgactcaacactggaattttaggaatgcctcacttgatatcttttggaatgtctttgaaaatgagttttaggatgatgtcctccagcagattttaattatatcatataatgtacttttaatcacaaaattgtatccaattatgtattatttttaatcataatcttagtccttcaaattcttttcatctctgtctcaatcagcaatagtgtggctgccattgtataccctatctaaaccatagaatagaagtcttgcccactggaccacccttttttaggcagattccacgtgctaccagcggatgaagtcagacagaactcagaatagagtgtcatggccaaggtctgtcttaagattcaaacatgaaaaggaaagattctccatgccaaatgttcacctcaggggagctgaacactgagaagttttacagaggaattcctagaattttgagggcagtttacaaactcaggccttcagggggcttgactatcactgaagagcaaaagccaatagtcaggggatttgagggctatctttctttcttctacactaagataataagggtgaatgctgctgagacggtgatgacgtgttcagcatgcctgcctctggagaatcatgcacctgtctgtgcctgtgagagcataaaagctccatgagacacaagtggtttacatcctgggagtcagtaacaaagctaagagaccctgtctggtgctgtgtccctgaaaggggtccttcagtctgtcctagtctagggatcctaggacacaggcctttgtcaaaaccccaagccaaggggacctagctgtcattctcctaggtcgtgtttttaagttgatcaaggtcacgtgcatggagtgtctaggccagcagaaactccagagagcagcacagaagtttgtatcctgccctccagtgagagggcttattctcataggcctcaggtggcacagaatcactgcaggatgctaggcagcctcctaggacacaggatcaggcaggtatttctcatgttcccaaatgtggcatgacaccatgttgagcacctattttgctttgagcccgaaggtggaaaggagaacaagacagacagagctctgtctcatggagcttaaattccagcagggtggacacacaataaccaagcaaacaaaacggacatcatttcaggtagtgataagagcagcaaaagacccctgcaatccaaggtgaggagtttagattttgcccatagtgcagaggaagccccactggggggctcctagcgtggatgtgacatggtgtgctttatgtttggaaagatcactagctaccaggactatgcaccatcgaatgccacccattcaataagcagaaactgcattttcatctctcagtagatcccaatatacgccttttctattcaaatgtgatgtcctcaatgaactcctttgattacccctgtagggaaaatgttcttttaaaaaagaatttctaaaaaccctattccaggtgattctatgagatctttcatctcctgtctcagaagacttatccaggggtagcaggaacagcttgcatagaatagaatttgtttcacgaaccatttctccagtcattattataattccttaggcaaaagatgatttcaaaaataccctccgaaatagacactggagctcataagtttgaggagctgatgaagcttgcatagattgtaaccttgtgtcctataaaaatgcagttcatttatacctgttttgcagagcagaggaaacacaacttgaaaggaaaacttcatgttttgcagttttttaaataaatgaaagaaaaagtgtctcaagaccaaagctgaatatagtagaatttatggagtatcatttgctttggcacacataatgtcaagtgaaatgaaagaatggtgtgaagagatgaggatgagaagaagtacagaatttcccttttccctttttatattatgactaattctagaggccctgctagggacatcagtgctaagttgaataaaataaaggaaggggtaagacaggaccatggggaaagaagcgatgtcacaaaagttctgtagtgagccagtgggccacaaatttacacgctccagtcatgtccagagtgatggtacctaaatgttcaagtgtaattgagccatcagaactgccagcttttctaccttctcaagagattccttgggccccacacacactctgcaatgaagacattaaatggtagaatgggtgctgtcacctgagaaagagggtagcacatctaattccatgggtcctctgggcatagcttatgcagaaggccatgtgtttggtgctctgaaacagctccctgcccacaggggcttccaatctgatttcctttctttggggtttcaaaccgtgtaacatccagactggagtgtctgacatagaggctttctggtatgttccatccattctgaggaccaacaacatgccaggttccaggctccaggctagggtatggagggggtgtgggctggtatactggtcctgtcccttgcttgagtcttccacgagccacttttcctctcctgtaaaatgggagatattatatacattttgaagggagttttcaaggtttgatttattttttgtggaagccagaggtggtttggcttctaagaatagcctaggctcccacccatgcccaccacagcatatcattactttctcttcaagcagatgcaagtccaaactgccttactgggttatattgagtctattaaaactgcatgacaaagtcacaccatactttgcacacctcttggcatttccttccttccttccttccttccttccttccttcctcctttccttccttccttcctttcttcctccctcccccttccttccttccttcctcccttccttcctcccttcccttcccttcccttcccttcccttctttctctctttctttctttccttctttctttctcctttctttcaacagggtttcactctgtcacccaggctggaatgcagcctccaattcctagtctcaagcaatcctcccatctcagcctcctgagtagctgggactgcaggcatgtgcctgggtgatttttattttttaattttgtagagataagatctctctatgttgccaagactggtctagaactccttggctcaagcaatcctcctgccaaaacatccccaaatgctaagattacaggcatgaaccaccgcacctggccttgggagttttcaatataaatccaaattaattctgttgaggtgatcagacccaacaccaggtcatgggggcgacgaagtccaccggagtcaaaggaatgagaaaaagtttgagagagaaagtgggaccagggagccatcacgagtggggaggctacgaaggtcccgagctctgggagccaaagaaacaggtagtgaggatgtgggggttgaaaggaagcagtgtatcaagtgaatgagaaacatatggctacttgagctaatgggagtgatagaagcaaggagccagcaagtctagcagatatgcaagccctacctcaacttctgtcccaacactcagcttttctcccaacaaattatctttgcctctttccctcaatacagtaaagtccaattacattgctgtccatttacagagcaactcatcttcctttttcttttctcttctactttccattgtattcttatgaaaattaaacgaggtaacacagataaatgctactaagtagagtgacttatacataataattgctcagtaaatgctaacagcagcggcactagcagcagtttattattatttcaagattgctgtcttgtctagtgagccaggtgtgcatgccaatgtgtgcctggactagatgacctttatactccccgaagtgaaatattatgttaccgtcgtgctgacagccagtgagctccccaactcctccccaattaattagctattttatagaacatttctctactgtgcatgtgctagaggttacaagtagaatacagtggagaaggggtgatcgcaagatcagacatgacacctcattgtctcagattcatcaatacattttgacagctgtcatggtttgactacccccaaaaagcagatttaaaggcaggggtttgtgtgtaagttgttaatttgggaggtgacttttggaaagagagacaaagaaaggaagcaaataaagaatgcattatcatgggatttgccactgtgggcaagtggagtgtgagctcactgagcaactctgggaaactataaagcacacacctcagcattatcccctgaggggtgagggagctgaggtgttagttaacccaacaactctcagtaatcattggttgaagaatgttttgggggtgccttgttccctggtcctttagacctgccctacatgtggcaaagtgagctctggccaccagaaggagcccttgggtaaaaggggctggcaccagaaggagccctcaggtaaaaggtttaagtcaaagcagcttgcaaggacacagcatatgccaagaagatacatgcagtgcatcgtcagcatctgctcttgttacccaacttatgaatatgccatgttatgtgtataatactcatataccaaagccagatcacaaaacagctgcaactccactctcttaacgacagactgtggccacctcacccttgcctactaggtgcccctttgtgctcctgggcgaagccagtgacacctttttagcattctgctgctgtgctcactgcagtaataggggcagtgtcactcttattacttcacctgttttatcttttgtgaaactcagcccttagccagaatggtctgagtggctggtctagcaagtgcttaacggtgaggctccttcagctcatttctctcaagtaatttgatttcattgcactatcagaattgcttttatgggttggaaggaggcctagggggaagaggttgacaaaagctgttttgagattaaaaaaaaaaaatgtattgcccagtacctgccatcacatcctccatctacaccctccaatctctcctcccgtgcatggtagggtgtgcgtgtgtgtgtgttcaggagaaattaaaataacaacacacaatgcatctcacatttgtatttcttttcacctgagcttgaaaagtatactgtttgatttcctgtgatccccacaacagaacttgtgtgctaagatggaaaaatattatggctatgttctctgaaattatcaagcaaagtgtaattttgcattgacagtcaatgttgacaatccctgttcaactgatgtcaacatattgatcaacccagtgatacatccttctcactcaggacaatcataggtttctatcagtgctgaaagtctcacgtttgataacttcataatatttttattttgagggtgtgcacgtgaataaaaataacacggtgccatgctttcctcattaaagagttggcaggaatagagagctcagaagtggatgtgaatttcatgtgcagagttcaagggagtttgatttttttaaactgctgctcctaacttctggatatttataacaatacagtaccaatttagagcttttagttacttggaaggctggttagtatagcaactactttctaaataatatgcagtctacacagggatttatgatttcataaaattgctggtgttttatcacagctttgggccccatgctcggctgggtggggtgaggatatggatgaaaaccctttgaggttaaaaccaccacaaaatacatttttcagctgaaaataaaatgattgagtgcataaagaatagtttttagatttgtgagtttcgcctggacattggtctctagagcgctgccttcttacaaactgcaagaaaggcagttaaagctgaggtgagacctggcaacagatctagaaggggatgttgacggaagccctgggcagactctgaatggtgcatggggttaaggttttaaagcctggcttaaatataccaaattattattataccaacattatgttcaattttattttaatttttttctagtgagaacctccttgaaatgattgatttaaagtatcaccatatgcctttctatgatatggtaatctatagccccaaatagactttcattttaaagtttaaaacaaaagctaatctgttgcttctgactccaaaaaggacagttttactggcagagtaagtcatgtctatctttattttagtggaatatgctagagttctagtaaacatatttgaattttatatcaggtgaacaaaattagtttctacatgacagcctttggacaaagttaaagataatagggaaatatcaataacagtaaaaaataaaaagtaaatagagaggaaaattgtccccagcaaagtgaaaaccagatttactgtagctgcattggaaccattctgggttttcaataattccaacaaacatacagtttagacatggggtagaatcttcaatgagtctttattgctatgtctttctgtagtgaaatttgatgaaaagaaacattggcttaataaccaagtgaaaggaaaatgtccacctaatgagttatttgatgtgctatggatgaaaacaactgtaaattcaacttgctgtttcacttctgtctcttttatttaaattgtcttgatggtctgctgacagaattggtcctttcttggcttaggaacatcactgctttgcagcgagaagacaggcaaatcataaaacttgtcttggcttctagttataaaaagtattgactagcctaaagctatctttaatagcttgaaatgtggtcaagagaatttaattagaaagtacatctcaacatgctaaataaatagatcagcagagattattaaaacacatcattttacactttcatatacttctggtgggagtgttattggcacagctgctttggaaaactggcagaatctcccagagtcaagcataacatggagtccagcagcccttcctcctggatatatactcaacagaaacacatgcttatgtccaccaagacatgtatgagaatgttcatggcagctttattcatattagtgtcaaactgggaatagtctagttgttcatcaacactcgactggataaacagattgtggaatatccatacaatggaatgcaacactacaatgaaataagctactgttatatgtaacaccatgggtaaatcaggcaggcataattttgaacaaaatatagacaaaaaagaacacacattatataattcatatatgtggagtataaaaacagacaaaactaacctttgatcatagaagtcagaatagtggttattttgagggctgggcattgactcaggacaaggcagctttctggggtattagaagtatcttataccttgagctgcataatggggtgtgtgtgtgtgtgtgtgtgtgtgtgcgcgtgtgtgtgtgcgcgcgtgtgtgcagtatataaaatatttgcaagcactttcaatacaaaagtaaataagaaaaaaatcatttatttatcgtataagtcaactttcacatttacaacaaaagttaattttatgaatctatgctaatgagtagaaaactaagctttggaatgccagtagaagcacagaatctgtgtgcacctggatacacacacatgcaactccctgcatgcctgaccctaaattattcatggcttgttcagcctcattgaccctcatacttggaagaaatttcccatgtcatctaattcagtgattcatctgaagcttgtctgtagcctcccctccgggtggccattctacttttgtgaacaaaagtcccctggtgaccagaatatgttgtgatgttctgaggaaggcctttttctcttggaagtccatccctaggctaaaatctgtctttgtctattcattggtcttatttataaccccggaggtcttgtagttaagtggagaaagaattgtcctgttgctgtttatcctgaacatcatgctttaccttgtatatccatgtccactgaaagcaggcatattatcagggatattcatcttgatatttttctccccttttaattaatcacaaaacatcttcctatgaggaactagattttcacataaatctctatatttttccccagggatgaaaagggatattctgaatataacaatctgttgagtaccttctcagcatcccttcctcctccccatactctaaggctaaacacccctgtgctcccaggagtgagccttttcctgttgtcaatatgtacaaagatccacaagtctgtaatccagtcagtcattcaacacctagttattgatcattctctatgtgccagcaatgttttaggtatccagtgataagcaaagacagatgtgttatctgcctcccagggttttcactctattaaggttattaatcacatatttacataaataaatgcagaactgcaactgtgatgggtctgtgaggtaaaggtacatggtattatgaaaacacaacatagggagtcatcagtgtcagagaagcctttcctgaagaagtgatcacctggcagaggacaaataaaatggatatacactaggaaaaaaggaggagaaatgtcatttcagaaagaggaaagagcatgagcaaggccttatgacaggaaggcaaaataaaaataccacattcaaagaccagaaagaaggccagtgtcgttgcagtggaggaaacaaagagcaatgcaacatgagatgagactagagagacaagaaagggccagcttattcaggggagaaatgttgccactaacttggggagtggcttgaagctagagtcggcttcaaatgattgtgatgcttgtgatgcttgtgaaagagtattccttggaaagtagctgagcaaacaaactaacgagaaaacaagttttgagagagctgtttaaatcagtaactttgaatcgggaatgttgcatcaaggtccagggcacgatccatggaggaagttgttgtggaagatgagcgggtcaatggactggctaagcgcggggtgggtcactcttgtggatgttgaaatcacgtggggttacagcaaaccttgaggttaagatgaaaaccataactcaatgccagatgctctgatgaatatgagagagtgaccaggaggtcacaaataattgagaactgaccatagttgccatggttctatgacaacttgtataatttctctgtggggaattatgtcttctaaaggtgaatgttaatactgatggtcattgcaactgagtgtgattgcagtatttattcgttttttatagccctataattttatgatgtaagtacttattcaacatacctaacatttggagaagaattttatgagatgagaataaataagagaagactgagaaataaatctagaaaggccccctggggtcattggaatgtgtaacacaaagctaaggtgcctgtgtttattctgtgttggagagtcaacaaaggctgcctctgttttgtgtaaggttgaggtgtaatgctaactatgcctatgcctaggaagaatcacttgaaagtggcttgcaggatagattggagaagggaaggaagaccaaaggagcacagctgtcaactacagttgtctgggtgagggccgatcagaccttgaatgaaatcaatgggaaagggaggaaaggaaggggcggtggaaaatagttcagagggacaatgcctttaggacttggttaccaacaggggagtccgtcaaacatggcggtaactaggagagaggtaaagccatagacagaaaccagaaagccagggatgacatttgttttaggtaggagcatgtattgcattgctggtgctgaagtgtattaaagggaagtatccaggcgattataaatctagatgttaaattcagggcagagatggactgaaaaggcctcctatggttaatcccctaacaggaaatgcccatcctggcctccttctccttctttttttttgagacagagtcttgctctgttgcccaggctggagtgcagtggcataatcttggctcactgcaacctctgcctcgcaggttcaagcaattccctgcctcagcctcccaagtagctggcattacaggtgcccgccaccacgtttggctaagttttgtatttttagtagagatggggtttcagcatcttggccaggctggtcttgagctcctgacctcgtgatcctcccacctcggcccttcaaagtgctggagttacaggcgtgagccaccgcacctggccgcctccttctccttctttgcagctcacccgtactctcattctgcttttctctcccgttcatttttcctaacctttcccattgattcctcgggactcacagcttatttctgagaataatgtctccttggttccccattttacagccctcttcctcaaatattctattatttcctgcaagcctcacacttctttctaacttagtcctctttatctgtgtccacatacccctaatacacttgtcatgctgcattttgtttgcctctttacttgtctatttcctcccctagactttgggcttttagaggacagggactcattaaaagtatgacatagctactcgtgtggggttcagtaatactttttaaataaattaactgacaattaactttaaagaaaatttaagagttttacattttggtgcattcatttaaagaaaacgaataggattaaacaattcataacaaatgcacaatcccaaatgtggtagacattgcaaaggttcaagaacttacgcacattttctgtataacagtcattgtctctaagaaaaattaagcttggctctgatttgttttgtcccctttcttaatgaactctctagcaaagcctgtagaaacctaatcaggaaagcaacacatattcttggaaatggggacaatatctgtctttttcttgtcctctcactcattttttttctgaagacgtactgagatctgaaccatcagtttgaactactagaatacatatttgccctccaataaaactgggtcttttaagtcttggttctctccatttccgcaacgtctctctctttctgcgtctgtatggaaaatgttccaggagactctggaccagaagatatcctcatagacaagccgtataaggaaaaaaagagggctgagtttaggatgctgggaatggcacacatttaatgaatgccgctagaaagaagccaggaaagaattggtcaaacaggaagaataagacgtggaagaaggcagggttgaaaaattcaggagaagaagtcacacattcatcaagacagaagtagattaatggttaccaggggctttgggtgacagattggggagtgaccgttaatgggtacagatttttgttttgggatgataaaaatattctggaattagtgatgatggcaagactttaaaaacatggtacaaaccactgaattgtaaactttaaaacaataagtaataaagtttaaaaaataaaaattctgtgagaggagaataaaacataaaaaaactagtcaaacacatctaacactagagagcttgaagataaattgaaaggtgatgggatttggtgattaggaaggcagtggtgagctcaaagagcgtagtttcagtagcatagttactcctatctcttctgcttcctgctctgtaaatatatacattgataaggttattccttcacataccatcactattggcagaatgtttgatgactctgcaggtccaggaatgtgtttggtttagatcagctatggtgacattctgaatgtgttttggagactctgagcatgtacgcttctgctctttgggacaaagcataagtctgtcattcttgctgcccttctaaaaccaaacctatgcaacaagacctgattatctcatgctgtctcaattccaagcatcacctctgatggccccaagtgaaacaggaaataccctctttgaattctgacaataagtttctgtggtatgtttcattggtggagttctgctggccttgtgactggcagaactgaccctggactaactgcatgttttctctgagacacatgtactttttttttaagctgaggataataaactttaatctgagcacttcttacaagaaaataatatgaaagtatattgtaatctattatgcatatgtaaatatgtttttaattgatattgttataagattagagacacaattaaattatttattgtctttttgttttttaaactctgtactggtgtaggaccagccttcttaatgcctgtgtgtaggatcacaggcttcatatccatgtacatcttactgaggcctgtacttattggttgaactgaatgttgtttaaatgagaaaactccagtatcatagcgtgattagcctcccttttgccttcatctttcgttgttcatttgttttttcctgctcttcatctaggctttcccaacgagcctgctgcagtcattgccctcaacaccattaaggaatggcttgccaagaatcaccatgaggtaggaggaacgacataatcagtgaacatccaagatgatgtaatttgatgctcagttccccccaaaaaagcacataaattttataaatatcaactacacctagtcattgagccaaacctagctgaccattcttcacttgggttacatgagtaattaaatgttttttggtaattgatagaatgcagcaactctattgatctatctggtgaagtgaccagattcatttagccataatctaatttttttacattggtggatagtatgggttatatgtgtgaaaaagagaaggggatggatttcattaagaataaggagttttcctatgctattttccttaaagctaagttatctttgttgacttgaggttcctggtgtacagtaattgtctggtatctgtgttctttggatttataactaatcacttccctaaagtcacttctgagtgtgagattgaagtgggcttgtataattgatcacaaaatcgttatgagcgggatttcttatgaaactaaataccttcatcagagtattcatcatcctcctattctgcttacttaataagatctttgtgatacgtttagtgatgaataggggaattactcaagtaaacaaagcagcaaaataactagagaccgtggagcgttaaatttcagagatttgtcagtttacatattgtaacagctaggaggtttcaggcaatgcacagtcttatgcatttttcttctgattttgtttttctcctcagttattcacataagggctataaaaattgtgtttcattttctgatggaccatgaatttagctattttccttgggtaggagatgaattatttggaaataattagatatggaaacaggtgacggggttttcaaatgagaaagcacttggtacttttgtgtgtttgaagaaacagcagtgtcattttctaattattgtaatttcggcatttgttgaccacgtggccaaacctatccatttgggtgcttaccctttattttcttcttactttgaaatgtataaatatggcaacttcaatttaaaggatatcttaaatcacctaaaagaagcaggagaaaaacaaatagctaaaatagccagcttacaaaacatgtctttgacacattttattttcttttcacaacaaccttatgaaatctctagggtaggtatatgttatcttcatctgcatttgccttcaaaaggttaaatgacatactcaagattggaaagtcacagagccaagagactaatccagctctcataactcactggacgttcctcattggaatgccaccaaggccagaaagagaaactcagttcctttaaaagccagttatcttcaatatattgcttggtcatagtaaatgttccacacctggattaactgctttgcaaaagtgtagcatgttgcatgagtgaaagttgataactgagcaagcgtatcagtgcatatccatcatttccactagaatagtaatccaaggatatgccccactggaggaagttttcatgcatcatcttgggatgtgatggacatatgcataaagtcatatcatcgaggatgtagtgatgaagaataaacatgttggtcacaggtacatctcatcaacaaattctactcattgattctctctagctaaattattcagaaagttattttccatagaaattttctaatctagtgttttctacttaattcacttgcctaccctatctttgagtccattcttttgctttcatatccttttatttttctgctaatttcttgggtccattgtagaaaatatagataatttggattgagaaactcagttattgctattgcaactgtaaacatatcctgtactgattcccttttaaaaaagacccctagtttcaatattctaatttaagcaagtcaatttgaacatatcaggtttttctaaataaatgaattataattggtaggtcttagataaaagctaaataaattgattagcagtattttgatttattttttcctctgttaaaacaaacaacagactaggttaaggacttataaaagagtattgcttctaattgttttctcttcattgcagtattattttgatgttctgattggttaagctacttattcattaattcactcatttgataaatatttattgactccccctaagcaacagatacttttttatattccagggacagagcactgaaaaacaaaatccttgctttgtcatattggtagtctagaaaaaaaaattatgtttgcttaacataaattaagcaaataaaaaataaagaaatagggaagttcaaagagtgctttacaaaataaaacagggcaattggagaatgtgtttttaggtagacgtgctgaggacgtaatcttggaatacagatttgtacaatgggaaggaggaagccaagccatacagaggtcttgagttaaaacattccacacagagagaaccataggagaaaagcctggaagagagaatgagctcactgcttgctagcaatgatgagacccaatgtggttgaagcagagagacgaaagaatggcaggagacaagtttggagaaatagacagagtcagattatagggtcttgtggttcatagagagactgtgaattttattctagtgggtagttgttgaagtgttttgggtaggagaataacacatataattcaccttttaaaaacaagcctggctgctcttccgaaaaggatatcttatatttataagatatcagagtaggaaatggcagaccaattaagaggatgctgcagtaaatccaggcaggagatgagggtgctctggaatacagtgatggtagaaaaggaggtaacaagcgtcaagtttggggtacactttgatgatgcagccaataggactagaggattgttttctgttaggatagggttatgctgcagttacaaactacccccaaatcttggtatcacaaacagcaaaggtatgtttcttgctcacactgtttgtacgtcttgagtcagcagagggaactgacttacaaatccgggctgacagatactttaccatgtgaaatatcatctatcacatgacaagaaaagatagataatcaattcccttgtagaaatgtttctacaaaggaatgatgtatataactttcactcacatttcattgtccagaaaaaggcacccagggactaagttccaggagacaagaaaatgcagcctttttgtatgttcagaatagagcaaactgaatattgacaaaaattagtaatgtctgttataaatgtaaatcagatgtgatatatgacaaaaagagaagaatcaaggatgacaactaaatttttggcctgagctgctgggtaaattttggtgcatttactgagatgaagaatattggtataagagcatgtttatatgaaaaatataaagaagacaagaattgtgttgccatgctacagatagttaagtctgaaatgattttagatatctaatgaagatttcaaatagacaattggctcttggagcctaaagctcaagatagaagtaggaaagaaagaccgggtgatattgatcagattaccataactttaacttgggttcggcctcagtttgagattgcttgcaagaaaaaggaatatagtcaaactagcttacataaaggagaatgtgttgtataagtgaactacattcttaaaaaaagtcttgaaatccaagggccggaactagagaggggtctcatgaattatagaatcccaaactataaatccaataagaaccaaggtagctcattttcattctctcccactccatctctatctctcccatgtctctgtttcattattattatcatgttgcatgttatcttttattctcattcacctgcttacgcgtggccccatcatgactgtgtctgtccattcatgggtcaatcagccctgcttgaggcaaggcctgggttcagtggataaggttgcattttctgaagctcttagctggtgaggttcccccaaaattttcctttaaaaaacaaaaaagaggaatctatgtaatgtgagtctcccatcagtgctcatgcttttcttattcagctgagtttattattcaacattcacaaatttcatagtttgtggctatcattccccataaataattgaggctgtcatataattgatgagcttttacatttcaccattaacttactctctgatttctaaaccatcaggaatgtgcactttttctttcccaacacagtagttgatttgcttatgtttaatttcataaatcaccgccagctggtgtagctggatacttccacacccagagaggtctgactagagtcccagtggtcaggagggggaaaatcatattctgttgcccaccatccacttgtttaatttacccaaagtctgaactccaagggcacagcatatatttaagaggactcagaaacccgaggggaggaacgctgctgcacacacagcacagtggctcaaacagtggcagctctagcagaagagctaaagcagcactttaacaaaaagaaaagaaaaaaaggagcattctcaaaaggctgtaattgaggcacaaaaatgacttagaactgaaaaacatgatgactcttgagttgaaaatcttaaaaaaacaaaaaagaatattcactactgagaaccgaattattgctatgagaagatcagatagatgaattatctcacaacacagaagagaaatacaaagaaatgacaatcatgactgaagaggtaaggtggcagagaaacccagggatcaaacatgaggcaggcagggtctgaagattacccactggcattttcagctaaattaagtattaagaacttctgagttcagaaaaccaaaagaaaagaatatcagagttggcagtaaaaattgacagcaggtagcatgataacctttctctaagtgcaccatttttctcaagtagtaactttattacagaaataggtgagcaaaataagggactgttatggaaatgaacagtagaaatgtggcctagatttctaagttggggtggctgctctgtgttatcaaatgcaatttcatgcattccttatttttcatgcaatctagaaatataattctttgcggaataggtatttccccactctgcagctctgagaccccctgctcatatctgaaagttagcctaagaaatgtttttacagtgcctgttctattgttctaccccagggactcatatggcatttggctattggtctctgagacaatgcacatatttgccattttttccacagaaaagtagaacaggatgcatttcacccttcagagccacaaatgtcctgatattgtgagacatttccaagtcatggtggtcatattcaatatttcagataccccaagggagcaagcatcctacagcacatagcaccatgtgttcgttttcccaggaagtcctgctagtcagggaatacggcttctaagatgacgattctgagctggaggatcagtggatttcccaggaacttttaaatgtggaaccctaaagtactgatcaaggattagttgtaacatgaaggaaacctgaacccctctcctcctaccatcaattataaagaagcagatagatggacagaaacccagcgttctaggaggctctaggtaaagctgtggccacctgcagctatccaaaggggagcccctggttcccctgaggcccggccccagcatcatctctgtgggctgttgaggatggactccttcccgctgcactactccaagggaattccctaatatcctccctcctatctatactgctctcctccctagacagatcccattgctctgggctggggacaattcaatggagaagtgtttggttcatctttgaaggcctttggctaggtcacctgcctagacttggaaatcactggcaaggaaaaaccccagctctgcattttcaaaacccaaatgggttttcttttatataggaggaaggtggtacttttctctcctcgcgtacaaggtttgggtctttgcccgacataattttttttaactatgcctttagcacaaacagattgttgttcaaaatgttaaatatcatctacttgtcatttaaatagtttactctgtgccttcggagggaaacacaacacctgtggtattgctgtttgtcacttaaagtagcaagcctacagatgtggcaggggatcctgagatgctgtatatgtgtggcagcatcgctctgagacagatgtccagctcggcaagttgatgccagccaaggctcccagacctcacccagtgtggtctagacctcaccgtaagatgccgatagccagagacaaaattagctttgagttcatccttgatgtcctttggaagtagagacgttggtttctactgcgtggaagcagttagccttgtcaccctcccttgccttccagtattcaggcacatgattcacaaactgctgaagaagctgaacatatttctccaccccagaaaacagaattaggaatccactgtagaaatgcacgtccagcctcctgagtggttcagatgctgctctcatgctgatttgacaagatcgagaacacagccacttgtttcctcattactgatcacaaagaaactgttgcactttaacttctggtgccaagactatttttcccccttcttggcagaggtctttgagcatatgcagtgttaaaaattgtttgccacttttatttcagcatcacgttatggatcaccgaaaaaaaaccccagtgtggggcctgccttatgtctctgacatgaaacgccttaggatctttgtgattcttaaaaagggggtttaaatgaaacatgaaatgatgcttacatttatgatgggaaaattatatatttcgaaacaagctccaaattcctgtggactattatttacacttatgcaaaaggcataatgtgccatcctccaattctatgcaatgcaggggtgtggttaacattcagagacctggaaggagcaaaggaaatgctccgtgctctctctcaggaatgcctttttatgtccacaaacatcatctgagtacctattatggtcttagtttttggtggaatttagtgttaaaatttgtgcacttgaaaaaataaattgcagctttgaaatggtcacatcctatgcagtaatgtggttatggtaataatcatcatcatcctaatatgctgccgtaaaaacgtatcctttgagtagcccaaatgtgtcgttcaggtggagccatgacactcataggctgtgacaccactgaggacagttagtcccagattttgcagatacgctgtgtcgcttttgctcttcaagaacactgatgacttgctaacattttatattttctctctacctctttatttttctctccctctctccctaccgttctctttctctctcactctcctttcttccctcctttccttctgtctccctccctctttcttccttcctccctcccttcctgcttctcccaattccctcctccctttttccttcctttttctttctttctccttccttccctccctccttccttccttctttctttctctctctccttccttcctttcttccttcctttctttttcttttttattttcttcttttctttccttttcttttttctttcttttcttttctcttctcttttctttttctttctttcttttcttccccccaccagcccgccccagcccagacaatcccttatcactctgagtctgtcattgtcgggatttgtgacaagcagttattgttcccacggttagaataaaagctaatccccaaggcagcttctccccttctgatgggggtgttccagtgcttggtgtcaccatacactgccacacaagagtttgccaagtggacagatccaccgacacttccagcttcaccctgctttagcatctctcacaattggcataatgaggttttggagccagaaactaaagccccaagacaacatcaagggttgctttcaggctccatagccctgttgtggtcaataggaagcacagtgcatgggaaaatatgcattttgctgtttcagttagtgagcttattaccagttagccagtgatggggagggctctaattacacacttttaggcgttgagctgagcttgcccaaatgccctgtcacccattcttactctggtggggagctcatcaaagttcaacaaatgttttgttttatttcctcccagtaggggatatcaggcaatcaaggccttggggtgctctagggacaccaacctacagtcctatgtagattagggtggcttgctgtcttctgcacttgcatataatcaatatacatcctcctcagccagccctcctgaacctagtactatgtccattatgccccactgtatctagataaacagaatggagtgcatgggaatgcagagagaacctagaaaaatactctgctgggggtgagtggtttggggggttgggattttgtttaaataggcatggagggtaattcatatatactgctaataggtctagaccttctagaaagagttctaggaggtatagaataggtacatgaaggagttaaagagggaagaaagaggtaagggaaatcaatatttatctgactcctgatgtgtcccatggcagaggcatggcccaaagatgcattctgtcttcacaaaactctcttcaaggtagttattttaaaatctttaatttcctagatgtgacagttaaaggaaattttaaaagtcaactaataagatactttcatgttctactataaccttgcttctgtggcctgtctagcgttgggcaccttacccagatttagccatacatgagaataaaaccaaaatagattgattagggtctttccatgggatttctttgccacctggagtcaggaataaaaaatggtggtgaacctgagggatgtggagcacagctaccgtgttccctaccattttggaaggttcttctttaagaagataatttgaagatgtcccagatttgagggcagttggcaagagtcacagaacccattctgttggctcaagtgaagaaccaaaactgaagcaaaaagcagtatattttagcaaaatgcaatggccacccattttaagtttttacaactcaaaaaataatttttaactagagaaaagaaaaggttgagaatcatttggagggttatttttttcaaaagtgtatgctttaaatagtttattctactcctttcagagaacctgtgctatgttgaaccactgtttatgatgagaatattttacatccttcagatgtgttggctggaaaaattttgagagtcactgtcctaaatagtaaaattagagtgctttttataaaatcagtctttcaatattcccttcatactggaggaccatcaaaagatagtaattaactaatgaattaattttctgatggctgtatttttctccttctttcctgcaacctggaggtaggaaacacacattaacagaagccagtgctgaggagagactaagaaatagcatgagacaggtgaaatgcaaactctttaaaatcaaacttcagggtgcaggtattaaaaaaaggagagagaatgcagtttgctcagatgacttggccaggatgttcctagggttgggattggtatatctgaaaaagaacggatccctttgcaaagtttggcttagaagttccaagcctgcaggaatgtactcaggagctcactatgtaacagaagctcagctcctcttccgtgcagcaggaatgggaattgtggctcctagaagtagagtggtaagaggtagggtgcagttataaccaccactgtgtaccctcactccaaagaggaagtttggtgttctaatcagaattttccacactcttacatagccttaaacaattaactccatctctctggactcagtttcttcatctgtaaaatagggagggtgggcatgtctcttctagcttcaggattctgtgccattgatgtgtgtcttctggagcaggcccactgatgcatcctggccatgcctttgaccatgtcttcatagcacaatcagacctgtaagaaggcttacactctgtgattctccaggctcctccagtggcataccaaagatcaagcaacatttgcatgtgctgtctgtatgcctttaagatgattaccaacccccatatgggtgtatctttagagttgatattaacaaccttgacccatttagtgtagaaggagaggccgccatgttgattttctgtaaatgatccggattatatggtggtttcaaaatagccaacttttaaagctccttatgaaattaaatgtgctgattatccaaatgatgtgacatttttataaatagaaagtaaacctctgagcatgtggttggaactacatcagacacagggataaaaacaacactgggaggtcctactgaaggacattctaacaaccattttctggagatagaagcatgcaccttcatcccttctaggtaggaaggaaaaagaaaccttttccttgtcctctaccttgatggactaggactcgtatgctgccctgattgaagggaaaattaacagttttgatacggtcatctagctcaactcagggaaaaacaaaaaaggcatttcccctttctagtggaagtaaatgatttgcttgttgatgggtgatgttttcagccaggctgctgtttccgatagaagctgtgaccagagctgaaccatctcattgtttctctaatcacgtctaggcaaagaggtggctcctctggaaagactagactcctttgatgatgccactgctactcactagggtaagaaaaccaaataggtctggcaaaacacttgcttctccaatttcatggctcaatggaaaacatactggaaaaaacatccgaagactgtgggtctctggccatgcaccgctggaggctgtaacggtgagcccagtgacagaagggctggctaacgtgctgtcctgcaatcagttatgtcgtctacatttctatttatgaaccccttcgaagtccatgacagaaagccccaaccttttagtgaggagactattcatttgcaagaagcagagaatagaagaatattgggggatctactattaactaaacttgtgttgaatagaagttactaaaacctggtcagattcacatctgtgattccaggttaagggcctcaggcaaggaagcgaagccccacgtggatcctgaaatactggccttagactcgattccacagcaaaggttgcagccacccagcatctgagctgctgggcaccagggcaagtgatggccagtgacaggaaggagctatgcacgcatatatcctctgttgtgtgcactctttaaaagaagagataaggagaaaaaaatatttaaatgatatcatttaagtttcacaataaaccattgactgaaataagacatatgaattctcttttcttccaatcggtccaaattttcacatgttccttagcttctttctgcattgatgtgatgctaagatgtaaagacttttagttgttgttgcttctctgacactgctcctcgatataagcgcaaaacttcaccttttgatcatggggtctttaaaaaaaggcccagcaatctcccctaaagctggagacaaaactgggtttcctggacttactgagatgtgatgtgtcagtttacaacataaggcctttctaatgaattttaaagaaaaattttgctcatgtgaaattttcactttatgtgctgaccttagagcttgaacattgcataagaataactcagctgtatatattttgcaacataaatgttgcctgtttgtaaccagcagatttcccttaggctgggcggcttcttctgccctgttacctactgaagtactcccctaatgaccaagaggttgctcagcttgtcagtgagacaagaaaattcttggagatgtgacaatcattctggacctattcctcacctgtaagataaggtgaaagtcatctaggaaaaatccttaaatcagatactggggcataccctaaatctactgtatcagaatatctgagaagatagtggcctatattttgaaaatttcttcaggtagtggttgagaaagattaggccagttgctctcaacaatcttttatggctaagacatactgcaataaaaactcccatttgttctcttcaataaggaaaaggctatgttaagtgagaactgtgagagtaaatctctcctctcaaccagtttacgactggccttctaacaaggggttaggagtctagggttggggctgtattgtctagctagtcctggggtggccacagcttactttctactcacaagcacttgacatgggttgaccaataagtgagtttgatgaagtttacacataatgtaactcaactcacattaaatatctttgggagttgctagacagcttttgtggcaccctgtaaacagtagaggccttttgccatcttttagaaaggattttagtatattcccaatatcctgttgatagtaatcattgtctctggatattgcctttgatgcctctatgcaagagatgcatttaataaattactaaaaatcattagcatacacaacttaattcttctttgagtacttattgtaggcagatttgaaaataaagccaacagggctatctcatggatcttatgtaattatattggttcctgaaacaacttttgagagtcaagtactcagtcatctgaagcaaattaattctccctggacatgaaggtgccattaagcatagcggcaagagatgattttccggttggtaccctgttgtcctttactgaagccggtttacaccaccctcatgtgaatcagaccctggatgtggagatacgtgccacccacggtgcttctaggtccccccaccgctggcacaattagatttctttaaggaattaggaaatgaaactctatattaaaattcattgctgagaacactacctaccttaatattttctgctgttcaaaattttcctctgaaaacaattagaggctgatggggtgtgcatttgacagtgcaaatggagctacaaatgacctgggtgggcttcagctaagcacagggcagcttaggaatgtattaagtggagtaattatctcatatggttttcccttgggttcagtgacatctacaaagttcgtttttctaagttcctccttctacaaatttaaactcaagggaaataggatccatatgtccctgattaatttgcactaactcatcaaacgttcttttctttgtaacttattagatgtctacagaggatttcaactgttttttataagttctttcaagcctttttgtctagaggcaggaaatggccatttgccagcagcaagcgaacccctaaatagtcacgttctgttcgggagtcaaaggaaaaagaaaatcccctgttttctaagtacagctgggtaatggttttctttagaggtgatgataaatgtattctctgaaatgtattattagacttgttaaatgtgtaattaaagggattccatgaagttgttgcagcaggaatgggatttaaattgcccccaaacccccttccacacacacattattactttacctgtgaaaatcttaaaagctgttggtttacccagcagcttagagccttgaactaagtgaaacatgaaatatcttcaatatatgtaccagaggctctgcgtgtgtgtgtgtgcgtgcacgtgtgtgagacattgacaagagaaagattgatatactcaaaccctacatcatactgtttttcataaatttccatattgaatccaagagacctcattttgaggatttaaaataatgtggcatcttgcttcattaccaataaaagtaagctttttggcctacccataataccccagggtaactggatttcaaaagcaaatcaacttgagcttggtctttcactaactaaaaatacagtcatgtgccacataatgacattttttgtcaacaacagaacacatgtaaaatggtgatctcataagattctaatgaagtagaaacattcttttcacctagtgatgttctgatgattctgaactgatgtgggcctaggctaatgagtgtttttgtcttcatttttgtaacaaaaaagttttaaaagtcaatgaacagatttaaaatgttaaaaacagaaaaaacttacagaataaggagataaagaaagaaaatatttttgtgcagctataaaatgtgtttctattttaaactgtgttattacaagagtcaaaagtttaaaaaataaaaaatacaataagttaaagttaatttatattaaagaaacaacattttcaaataaatttagggttgcctacatgtacagtgtgtataaagtccacaacagtgtacagtaatgaaccaggccttcacatgtactcaccactctcacccactggctttcccagagtaactcctagtcctgcaagctccattcatggtggatgccgtatgtaggtgtgccattttttaatcttttctactatacttttactgtaccttttccatgttcagatatgtttagatacacaagtacttatcattgtgttacaattacctacaatatggagaaaagcaacatgctgtacaggcttgtagcttaggagcaatagtctgtaccatataacctaggtgtgtggtagtctgtagcaccaggtttgtataagtatactctatgatgttcaaacaatagtgaaattgcctaatgacacatttctcggaatgtattccatcattaggtgatacataaccatatataaatgaaaaataatcacaggcattgaagtattgagtgcttcctttgtctaagtaccttacttgaattaaataatttaattatcacaaagatgctatgttatagtcataattattccccttttttgatgagatgagaaaacttagactttaaagatcatacagcaaataaatggcagttgagtttttaattcagaattccaagttcataactacaatcatcaaaagcattgtattttcccttaatgataaaagtaaactaccgtatcagagatctcctttcaatgcttatgaatctcactacagtctaattcagatctcttctagcattatcccatgtcaccctccatgctgcagctcatacaacttagaaagagttgcttggtaatttatttgtgaaaccaagatggcaggtccatggtttggtcaacttttattgtcttgcctttagcacaatgccaggaccatactcattgcaagttgaatgaaataatttacaaatgggaccttttattatccagcctgctgctcttataagctcctaaggcttcatgtgattagaactagagctgaatagtcatttgtggtatcaacatttctaagccatggatatttccattagttcattagtcaaacatgatcaaatgattaacaagcccaggaaatttcaaaatctccctgagagcaggaccctaatagtgactaatttctcagcgatcagtgctgcctttgttgcaaacacatggctcttgagattacagagtaaaatctgtacttactcctgttatctctgctcaaatactgcatctttggtgaatttttccttggccttaggaaaacttttcccttccaaatatcactgtcttttactgtggttgtggatgtacctgtcagctttcccactgactcaaggactgcaattgtgtaaattcatccatgcattgtttttgttttgtgttttaatccaaggagcctggcacataaaaagctttgacaaaaatgcattgaatgaacgaatgttttgaattgtttcttaaatgatggagctgagcatgtataaagccagtgtatctgtctcatacagattaagattcaagccttgaactctgttcctatcctcaaatgaggaaagggactgaaaaccagccctagtgtgcagagattcagccagactctggatgtagcccaggcttggagaaaattctaccctgctctttcctttatcttggacagatggcagtgtgctggagttaggcagctttagactgttgtctaaaatgggaagcttatcctcaggacaaattggagacagtcaagacttcagaaagctcacccccaagcctgagcttatgatctgttgatctatagctgatgggcacacggcttaccccgtttgcctgctttgctttctcttttcctgcaaaggcttgtgtgattttaaacaccagacaaccttggtctttaggtaactgcattatccttttttcagttaatctacttttaatttttctctctttttttagtccactcaacattgtcaacactgtcaaagatgtcaatgttttcatttccagttctgatgatactattttttaattgtcatgtatttccatatgtaacctgtttctgaaaggaaaatatgcccttcaaaaaaaatgttggcagcttagatttcatgtgtaattctttcaaaagcctctcagtctttatttatttatttagcaaatattcactgagtagctggcacaccctaggcattgcacactatttatacaaaagcagttgatatacaattcctgtcctaagaaagcttacggtctgttggagaaaacacaaagaggcaatgatcacaggataatgtggaaagtgctaggataaagggtgcccagggcagtgcgggtgctgggcagaggacagagtcaaggaagactctgggtgcgttctggtttgaacagaaggtagagggcagcctgaatgtttttcctggggctttttcttttccttgggagtgaaatccaaatgcctgtcttaccacaagaccaagaacacctgatcctcggtccacagactcaagaggtctcagagagtttgtaaatttggggcaaagtttacagttattttcactaacctctagttaaaatttagtactttctcccatcatgactgtagccgcaaatcacagtggtatcagcagtctttgtgactttgttatcagtagaaatcacagatatttcctatcacataacagttgttgcagagatctcaaaacactacttatgctcatcttgactttgaattatggtagacccaccataagatcttgtttcaatgtgttcataagtagtatgcaacgtaaccacataacacattgtttccttgtaaatggtatctcaaaaaaaactgtttcttttgtaatcttttgtatttttatttatttaaaaaccatattctgggaaggatccataggttctgctcaactactgaagaggtccatgttactaaaaagtcccggtggccaccacataccatttctcccttgctcctaccctccagcctccttggcctctgactccacccgtcaccctcatgctccaggccaccaccacatttgcaggtccccccacttataaggctcttcctaaagctctctgctcacactgacttcttttattcaggtcttatctcacacagcacctcttcacaaagaccttttcctgaacccccacacaaagtagacctgccctcctttcactctccctcacttcaccatttgatttttgtgtacaattcatcgctactggaaaagcgtatatgtattggtttatcggctgtcatcttactagagtggcacctatatcagagcaaggacttcaaatggcttgttctcttttatattcccagaacattgaacaatgcctggaaggtagtaggggcttaataaatgttcactgaacaaaaagtaataaatgagcgaatgggagggggagtagagaaaggggtatgccagacagcaatcagcgacaaagatgcagaggtgacaagaagcctgaatccaggagcgtttactgcaaagactgacagcaatgggccccttgtgcgcagggtcccttggccctctcactctttcctggcccctcagcagaaataaaacaggctcataggactctttttgataagagtagagaatacagtttgaagaactcatagtcttaacagataaatctggaaaatgctaatggagcaggttgccgagccatttcttattgcccaaccctgctgcctctttcacctagtaaagatgaacagacatgatttgcataacgtgcaggcacagaccatcaaaagtctggaaatgaatagagctggcaacagacattcttttcaaaggcatctgccataaagctagactcctgagagaacttgcagcatacaattttgggtgcccaaagagcatgctttatgagggagaaaaaaggtgatgggttcattgttgccagaatgtagtgtcttgacacacagtttgagatgtctgaatctgacatttaatagctgagatgatagtggtcaaatacttctcgaggtcagattcatgcagagttcctgaaaaggtgagaaatcactgagatctgtaatgacaaagctgatgagaagattgatgaaatggtggtggcaacaggacaagtcttcaaaatagcttgtgaatgatttattttgtagcagcagagccaattgacaatagcggattgctaattaaataccaaccactgggaaaataccataaatttcttttggctcagtattggcaattgtgtactttgaagcagaggccaaattattttccagtgagtgcttcattttagacctaaattttgtgggcctccatctctttttgctttcccttcaacctccagcatatttgatttaaaagcaaaaaggagaagagggaagaagaaagaaggggaagaagagattgaagaagagaaagaacaggtgggaagaagggaagaaagagggaggaagaaagacactcccaagtgtcctaataacatcctatcagaaaggcttatggccacgtgcggtggctcacacctgtaatcccaacactttgtgaggctgaggcaggaggattgcttgaggccaacagttcaagaatagcctgggtaacattgtgagaccctgtttctacaaacaataaaaaaaagtcttgctttcattcttttccagtctgtggctaattaggaaactataataactacagtttattgagaacctatcataagattggtgttttgctaagtgtttatgttcagtaagagttaacatttactattttctatgtgccggacattgtgctaagtgtgaattctcaccaggacactatgaagtaggaactgttaactcgctctttccttccttccttccttccttccttccttccttccttccttccttccttccttccttccttcctttctttctttctttttctcttgctctgtcgcccaggctggagtgcagtggcacgacctcggctcactgcaagctccgcctcctgggttcacaccattctcctgtctcagcctcccaagtagctgggaccacaggtgcccgccaccacacccggctaattttttttgtttgttttttgaattttttagtagagacagggtttcaccgtgttagccaggatggcctcgatctccttaccttgtgatcctcccaccttggcctcccaaagtactgagattacaggcgtgagtcaccgtgcccagccgtttctctgtttttcttataaatgaggaaactgaggcagatagtcttgtttgaaatacactgccattttttaatgagtgtgagaatttctgtaaaacaatttttaaagaaactttttatatgaaactagttgataagaattatagtttgctaagaaatacaattgaggcaatttaaggagaatctgtaagataaataagccgtatatttaaattaactgctggctacagttaggaaataaaagagatggagtcttactcctcaaatgagtaaagtgcgaagtgacctcagtttagaaagcagttaagatgggctggaagaatgaggtaagaatctggtacctagagaagccttatctccctctgtccactctctggtttgcactaggttggagaaagccattcttggagtcagggattaatgaatgtgggaatgcagagcaaaatgaggttgctctccccaacagttccataatctgaacctctatagctgattgtcaagggccgacctgcaaaggcttttgtggcaaagtcgaggagaagcctagaactccatgcgatgcagaggagtctcttctgttggagttaggggaagcggcgagaataaaagaagcactgcaatcaattccaacaaataaaatgagaactgggaaaacttatcatagaaaaatgaaaacttataatagaaaaatgattaatgatgaaaataggtaaatgtttctttaaatggctttttggatagaactgatctatttttttcagttaatgtagattaccatttggtggtatcacgaagcttttatgtttaaaatccacactgggaaaggactaaataaagttccacatggatgtcaggagaagaacctgtcttataattttgtgaagtgtctagattggggcaaatacccacagggagtggttatggcatggagaccttccccaacatggtggaaccacactttctggagcgagtcaaagtgccaatgaaccaaagtgaatgcagtgataactgcaagagcaggccatccatccctttcaccctggggtgatgactatagcgatgccagcgtgacattgaaaaccaggacacattaacacatttgtcacccctatgtttttaaagcttaagaggagcctagagcttcaagattccctctagtaacaaagacccccaactgccatgacaattaatcctgtggaaagctgagggtagagtgaacagaggaacggcaagatcccattggctgtatggtatgccgggtccctctgtggcactactgagagtcagacgggcccctgatatgctgcatactgaagagactacacacatgtatgaaacagcaggtggggtttagatattctctgatcaagttccttcacttgtttctctgacagaatccctggcctgtgccttaacaacatccacacattcatcttcccactacttcttgataatgagtttgaaaacttgccatggactgcacatagatctcactagagttcatggcggagctgcagccctcaacttcagccagcctttcattctgtttctcatcagatacatttaatggcaagtgggtgtttaaaccacagggaagggacagcaagaacaaatatataattagacatgtttcctggctgtgtgctttgtggataggcctgtaggttttctcctgggtgacttgccctaattgtatcatcagcttcccccagcagacaactgggctgagtttgatccatgaacttgaagcacgaggtgaagaatcgtgcatctacaagagcaattataattataattaagagtgggttggttttcttttcggtttgccttctcgtttttcagtgagcatggcagggatttccattaataataaagacattctagagatgtagaattaggaactggtcgactctggttaattggcatactattgtattcccataaattctgtctgggactgctgtgaatagatttaaagctactaggaagaaataaaatatacagccctttacaatgaagttgttttaagcttgaagcttttgtgtttttagtgactttgaagccggataagtattaacttgagtattttattgtggagaatgctaaagtaacggacatgataagagtttctggtggatattcataaactgcctttggatctgggagacagagagttttatgaaactgtgtaaaaatgtaaataacagtatggcacacatttactttctgccacctcttgggtagtccattctcctcatttcctctcagaaaaagcaagattatggacggtaaaaacccaactatatttataattgggatatgctaattgcagtattttaaagaagctaacacagctcaaaataaacagcattttcaatttacaaatagtgataacaaagattaaatggggattttctttggagcacaatttacagtggattttagtgaaagttgaaggagccaagtcagttcgtatgcagcttaaaagcatgttttaactggcgttgtcttcaggccacaggcccttcagtggtagaaagaacaccagaatggggtcagcaggtttattaactggaagtctttggacttaagttgctgaagatctctattagtttgcccatctttgaaatggagaagataatgtataattcacaaggctggtgataatattcatatgcagggtcaggactagggtgaggtaatcaaggtgcttgggatgcacagtttaaggaggcaggtctcagccgccaactctgtgcttgcatagccctcatattctgcaccccaggagcctccttcacctctctctagtcctagtgctgtaaaagaggtagccctattaccatgcctggatcatatggaggctcaaaataaaatgtttttctactgtttgtcctgtctgcctcatagatatcttttgaaaagtacatagggaaaaatagagaaatgtactcaatgcagtgctctacaaatgttagctgatactaaatcacaccaaatcactagtaaacccctgctacagttattagttgcaatggtgttctcatttgcaaagatacatgtgtgtgtatatacaaacaatagatattatggtcgtttgaagaatttcaatgaaaaatgtgtattactgtgttgagagtagccctttaaagtaggattgtattttttcctgaggacaaattataagctttgtgaaattagggatggtcttctcttgccttatttaatttgactgccagcccagcaccgtaagtatataggcaaattgtatcagaaaattagtagggttggaaaaataaatcagaactgaacattgttctagacttggatggcctttagctggcaactggtgctaactgctgggtgactggagacagcaatgggtatggcaagggtttctggtagatatacgtaagcctgccttttggatctaggagacggagagttttatgaaactttttaaaagtgaaaatgacagtatgacacaaattcactttctgccacctcttgggtagtccatctatctcattacaactccagcaaaagcaaaattattgatgataaaaatccaaccatttggacaattacaagttaaactggggaagatgcataagtaggcagctagagggactggtgttcttaccacccagaaactggatcatttgggagagaagcgcaacaaaaccagccatctatggcagtctctgacgaagccttaagcaccctttaaagagattctacaagaattgcctgactccatatgatttaaaagctaaatttattcagagaaaagaaagattttttgctgagggaaggacgttgctgtatgtttcatcacttgagtcgtggcagataatttgggttgagttcaaacacaatgtacttttcaaaatgtaaatctgtgaagaaaagctgaatttttagagccatcacagttttagaaattttatgctgtaatctgattttgtagtcaaggtcagtggctaaagaatgctgttggaagggcctagtctgggtcagacaaaggaccgatttggggaagatttggctgatgtcttcttttgtgcagggagagttattctctcactgggttttctgtgcaccagtagggaaagaagctgcacacacatggtatgtgtgtctgtgttactccaaaacccatcccaggctgtgctgcagtccttagtgaaacggagagattttgatgagtcaccaataactggtttcctgggactgatcatttaacatatacaagcgcactcagatttctgctgtggtttagaatagactggggggtgaaaacctgcccaggtctctgtttcatattgtgggaaatgtttgtcttcattctttctccatagagaggtggtttccatgatcgatggacagtctgaagtctagaataatggtaactatcatgttctgagcttgtgtagctatcatgttctctatcttgtgatgtgccaggccttattccaggtccttcatgtcgcaccagcctcgtgatctaggtgttctcttgtctttattttccagatctaggaactgcagcacagctaagttccatgatcaaggtagtaaatgtccctgctgtatgtacctcgcccgggctcacactcatcctgatgcagtaacttggaagtcctttgtctgtgtgcacattcatgtttgcttttgaagaacactgaagagattctactttgaacagaaaatatttacaccgaggtccttgttctctctgttgagtgctaaaagtgagggccaccaaggcaaagtgacaagtggtgccaggctctcagatttgatgcttctgcttggggtagatttgtgaggggatctccaactccagccctttcaggggccaaggcaggccacgtgaatgagtgaagcaggctgggcagagactccactaacttgctagtgtcccttggacacagctgcagacacttgttgccaggaaggattagccagggttgcctcatagtttaatttttctggagaagtcaagcattgagattaaaaaatttttgtaacaaatgttgagaattaattttaaaacttttttaaacagtacaaactaacccaaacatatctatgggccagatatagctaatgggctgtcatttctatataatttctgttctaggtgaatgatgcgtcacctacaaaaggctttggtttcttgatcttcctgttaggaggaaaaggagctatcacctataggaaatcccaggactggggaattgtataatagagggacttattttctgtgtagtgcctaggtatagccctgtacactttatctctctgcactataccgttccttgagcactagctacatgtagctattttaattaaaattaaagttaaataaaattaaaagttcaattacctacttttaccaaccacatttcaaggactcaatagtcacatgtggctggtggctaccatattggacagagcaaagtagaacatttctattgtcactgaggttctactgaatagtccaagtccaactctagattcttaggctctggcagcccaggctatcttacaactaaatgttctttctggtattggctcttcctggtattggccaacagttactgcgattgccccactggcttaagcttgtttgctttgcttaggtctttccattagtccaaaaatatctcagcattcggccatttccaggtgccttactgttggctcataaagatgtgtttggtgatgatgtttggtcaccaaagaagaaaggaactcttgttacctcttgcacttctccctcagactatttactgccattataatgttatatttgttgggaagtgaatgcttactctccactagaatcccactaagagccccaaggaaagggatcatgtgcttgccattttttcttcggttccctacagagttcctggcagagtggtcagccacaactgttggataaagttaagccctgggtaggataattttcctttacaacagtatgtccagtgtaggcaaaacatcattcccaacaagaaaaatggcacatctcaaaaaaagtaatttccatcatgtgttggcttataacgtgccatggtgagattcagaaccacaaggtccctgttcctttcacagtaatgaacccaaagcaattgaatgcagagctatcaacatgaataagggcaagtcaactaggactttcttatgcatccagcattaaagagtttttgttaacatccacagtaactagtgaaactttgtgtgaaaacattcacagtaactagtgaaactttgtgtgtttctgaggtcacattaaaaggcggtttgggtaggctaattatccttttatcatcctttttggtgttatgactattcaacctctttttatataaacttaaatatcctttgctcacacaatgatccagacagctggatactccttatagggtagtcaagagtattcagaggtccctcttcaacatctactggctgccatggctgagcatcacatccaatgtaaaaagctgaatattcttgggacaaattaatattgatggttagaaataataaaataaaaagatgttttatttttaacatctaataaaataaaaagatgtttttctttaagttttcaaaaagagaaaatagatttttctttatttcagaaaaggaaggatgtacggcattactgtaagctccacaaaggcaaggactatggttttggggattgtccttagaatgtctttccttcaggtccatctagtgagagtcttttaaaaaatatatcagatgctgtggcggacaccaaaccaattgtatccctcattcccttgctgtaagttagacaaaataagctagctggaccccaaatatctgatcttttgaaacaattagatgacaatgatggaatgatatataattaggaatcaccaaaaatagttcaggtataacataaatcctctagagagttgaagaaagatgagaatatttggggctaaactgatgaggcaaggctttatggaaaaagtgagaaaaattgacccaaagatgtgaataggtgagagagtggaagggaagtcattaacattggaggagagagaaaaaggagactgaatcctggtatgagccaagtagcaagaatgagtagacaggatatgtttatagaacagtaatgattctgatttgactttttactgagaaaaggtgggttgactgttttcagccaattatatatgagatgcagaagttggatctactaacttgatttagccagcaacacatagttagaaatgagtaaaaccatattgggcgtgtgggggctctgcctgtggtagttgacacttctttttttggccaggatggcttggttgatctgggcattaaaagaggatgcccttctttcctaaaagtgaccttcctagatagcaaatagaagataatgactactgtttagtcaatgaaagatgtgcagtccccaaataatcaatatttcctaggcacaattcatttatgttttgtttgtttcaaaattttgctagcaagtatctcaccacgtattggaaatgagaaagatatgaccatcttattttggtaacagttgtcgtgggtgaatgccaaaatattatgtaaaataaaacctttaagtatggggaagtaagctcactatctcagctttccctccccttgtctgagctcagagcatcaagctgttaaggactgtaccagtgactgcatgtgttccccagagaaaatgaaatgagcccaccagatatcagtaaatatttcttactgttttggtttccatgtgtcttaagtgtgaattttgagtaaaggttttattcaagcaaaaggctccttactcattttttctacaataatattactaaagtttagttaatggtattcaactatctgttctactcagcaacataatgtaatcttatgaaataagaaattatctgaaagggcatttcttttcacatggctttataaagcatccgtgttgaatgtttgatggagaaaatgagttaataacatgagaggtttatgcattaactatttaataaccagtggattcaggtaattctgtttctcctgctaccacccgaagtcacaccgctccccagattcctgatgtgttgcagccatttttctccctatatcataactacccagcactaccctgcaaatcctcagagactgcccataggccatctgatcatcagtgtaaggcttcagaatgatctgaggtccactactggcctctgcatttcttccttggagtccattcacacaatttagtaaatatctctccagtgtttctccaaaaggcaaaatccaaacactgatgtttggtgcacatgaggccaggaaagggatttgcgagctgctctagattctcatattttccaaatccctttttcttctccccttcagtgccttctgtctttttctccattttctccatagcacttatcaacacttgacaaactatatcctttgttcatttagcttgtttgttgcctaacaagttcccagtagaaagcaagtattataaagacaaggatttttgattattttatctgctgttatatctccagtacctagaataatgcctggcacacagttagtgttcaataaatatttgtagaaagactaatatagagcaatgtttctcaacctggggcaacttagccctccaggggtatttggcaacgtctggacacatttttttttatttgagacagagtcttgctctttgcccaggctggagtgcagtggcatgatcttggctcactgtaacctccacctcccgggctcaaacaattctcctgcctcagcctcctgagtagctgggactacaggcatgtgccaccacacccagctaatttttgtatttttagtagacatggggtttcaccatattggtcaggctcctcttgaactcctgacctgccttggcctcccaaagtgctggggttacaggcatgagccactgcgcctggcctggatgcttttttatcatgaggattgaagggataagcagtgctattggcttcctacaatgcacagaacagtctcttaccacaaaggattatctggctccaaatgctgaagttaggaagccctgatgtggagcacagaatccttgggagccctgccaagaaggctggctaccatctctcctgtggctctctggcttatctcctggactgtggctctttctgtctcatctcctgaccacacacttctgtttgcgttttttcatccagaaattaaaatatctcatttgttcctttgcagttatgtggtttttttttttttcagttcctttaccaccactactttaatgtagctttttgaagaagaagaagcaaatgcctgagcttagctgccatcttgaactcgaaactcttatcacttttatcttgtttgagtcaccatttctctgaagtctgtaatatgactgctaccaatacagcattctctcttctctgaattcttagaatacttaccatcagttttgaccatttgggtaatgtattagatagaattactgctctaacaaagacactcctaatgtaactattaatatatcttaaagaagatggaagtttatttctccccaatgtaacattctcaaattgggaggcctgagtcagtagtagacaccactgctccacgtgattgatcagattcaggctcctccaccttgctactctcccattcttgatcattgttctcagccaaaaggagaagagctggaagtagacagttcttgttctcagtttgagagaaaacgagaaagaaacagtcctgtttagcatttttcttctaaatatgtgctctgtgggatgcgtgtgtgtgtgtgtgcatgcctgtgtgtgtgtgtgtgtgtaagtgttaatatatttatttctggaagataggatcacaagatttgtaactttaattattttgctcctttatatttttccaattgtttttacattgaacctatactatatatatatttgtggctgacattagatattctttaactatttgttaaagaattactattaaattaaacgtctatgtaaagatcttcctttagaagggtaggaaataaccaagtggaggatagaggcttcttttagacaacaaagaactcaagcaactgtaaatacaagcaaaaaaatgtaaagccatgtttgtgattttaagtgaattgaaaaaaaaatctcttaaagtatatctttaaactgtaatagttacgtatatgttgtataacctttcaaaaaacaaatcaaatgaatcagatgtttgacacagtagaattaaaactcctaacttgactgatatccgccccccccacctttgaccgattatgttgacatttaacaaattaaagttaaatttaggagttgggagaaagaaagggaatatacaatgggaggtggacaaaacagtgtgggagagtggacacagaataagggccacggtgtgtattcagagaggtgacagacatcaacatatgttcatcagcaagtgacggaggtcaacaggtagaagaaatttgagtgaggacatgggacatttatcagcaaagacatgaaaataagacagtaaataaagcttgtatttgaaacagaaaaaattaagtggaagtaactgataataaacctgatttaattaggcctaaaaagttttatttgttacctgttagtcaccatattttaacccttctttggccatatgtagaattagctgctgtccctctaccaaccttaagagatatgaaagtggggaaatggaaactcatcccaagaggacagttgaggttcatttgatgaaggagacagaaagctttgggttaaagattaagtgatccctttgcaaattaattcttatactaaggtactgtgaacatgggtcagttttcaagggtttctttaggtttaataccataatactaagatttcagtagcatgattattgagcaacataaatagtgtatacatttttccaagctgtttttttaattaagatattatgggccaggcatggtggctcacgcctgtaatcccagcactttggtaggctgaggcgggcggatcacgaggttaggaaatcgagaccatcctggctaacacggtgaaaacccgtctctactaaaaatacaaaaaattagccgggcgtagtggcaggcgcctgtagtcccagctactcaggaggctgaggcaggagaatggcatgaacccgggagccgagattgcgccactgcactctatcctgggtgacagagtgagactccatctcacaaaaaaaaaaaaaaaaaaagatactatgaacatttttactttccatgtacgcgtataatgttttttctgattatgtaacagtctatggagtggaagttccaattaatatactcctgacaagattagcaaggttggctatcagatgtatatttattgaagaaaatatttatttgacaccacttattggtttattctttatccttagatactttttaatgaaacaaaatctttctacattttgattgtcataggtgacttatttaagttgaaaaaaataacttcgctttttttttttttttacaaattgctggagttgtacatcgatgagttaaagcttataattttaaatattaataattaagaatagagcaagtgctgctgccatttattcaaaaagaggcaagagatgttaaaatgaaatcgataaatgtatttgttgaaaattaccagaataaataggaaaaaaattttaatattttgaatgaaaaggctagaatatgacatattctaaatcccattgtattttacttctctgaaaattattttaagattatacatttctatataattatttttacaaaatatgatttaataacataaacaaaaataaaatataaacatgtattatttatgttaattttctctttattaatattttttcttctcctccagcttattattataaaaatcttcaaatatagaaaaattcaaaacatagaacagtaaacacctgtgtcacctctaagatttaacggctgttatattgtaggaaaataaaaacttatttgctgtatgaatatatgaagtactgaaatagaataaaaacatacaaagtagtataaacacacttttatttctgtaccacattattgatattgtattgatacattgttatatttttgaagaatcacaataaactctagattggagaaatactcactcatagactcaggccctggaaactaggagagtccagtgcaatcgtttttgttatgactcgttctcttttatttttctcctttctttttaaatcttctttgtctttctatctgacagaagaataaaatttagcaaaataattattcactaaagaaatatctaaatgaatattggttacataccaaagatcgaataattgcattctataatagggaagtctgttgtctttgtggttggttggtcttgtgttatacagttcatgaatacataaataaaattcgtgtgtcttttgcaaattactcttttattgtgttccttggaaataaatcactataactaacatgtattgagtactgaatgccttttttctttttgtaatagactggagtgaatttagttctgcatggtaagaacttagtatatgtagtaagtcaattttaacttactggtaagtgacattttaatgaaacatttttaaatgggcagatctagtgttgccagataagctgaagcatgctcagttagatttgaattcagatgtacaatgaataattaccttaatataaatgtgtcctaaatattgcataggacatacttatactaaaataattactcattgttcatctgaaattcagatataagtggatgttctgtattttgctttgctaaatctctcaaccctagcagaatgtgatatgttagatgtttggtcatctagggttttgtttcatatactttttttgtctttttattttatgccagaatcatgatttagacaaaatattttgcaagttttagctacctatctgaaatgttggaagcaaaccaatcaacaaacttggcaccgtcactgaggaagagagaaaagtgaggtatattaagttactcaaccatattttttattttatttttactcattgattataattttttctctaagtataccaattatataaactcaattataagaacaaacaagtgaaacaaaacaaaataaaccaaaaaataagcacacctaaaaaacacagaatgctacaaacacactacctcatattaaatgtattgccctccagaatcagcctctgttctctgaaaaacactgacctgggtcttaggaaatcttaccccccatcctggtgttgtccttatgagctctctggcatgagcaagtatcttagtctcctaggattctggttctcatctgtcaattaaagggtttgaaagattgatatctgaggtcatttccagacctgaggttagagtagcccatgatttcagcttcaagttcctggacaataattatgtatccatagcactcatgagccctgtacttgtttaattaatctgtgtttgcttgttttttaaactgcaccatttctatgtcttcattcttctttattgaaatggatttagttttcatcttaataggtgtaatgatgttattcatgcaaagcaataattcaaaattaaatccaaaggaaatcttttagcagtattcacattaagatgctggatgtgccctttaaataaagtcagcatttctccctaatgattttgaggctcattctaaaagtttaatgccagaataaaatggtattttccttgggaagaacaattttggtggtcccattgtagagcaatctttttaagagaattgcagaaggtaaaaagaaatgtacatagatcgtgataattttaggcattaggacagtgctacataagacagatgctttctaccgtaatttataaacatacgctttaggacatgtaatttttcccatttgtattacggggtactttaagtgtagttgtaatactttagagttatttcagacaacaaaaaaacccttagagatcatctatccaactttctgtctctgtctctgtcgctctctctctctctctctctctctctctctctctctctttttaagaagaaactcagtcccagtgcactaggtgactggtacaggggaaagtaacttagggaagaaaaggaagcatcctgtaggtactttgcaggcatagctgatgttgtatcataggcactctatgggctggcccagccccagaattcctgctataaaaggattgaaagtgatagtgtggtcctgggatggaggagggagggaacttgtctgagatgtgcctgggaggtagggtggagtgggagacttgtctggaagctaaatttgcatttcaagttcattatttttgctcaggttgtctaaatgtggtaccttgatgggagagccagggaagtggggaggagctgatggaaatcacagaggggctaaatgcttcccatgccacttcttggctatgacaccttagccaagatatttttttcccaactgtacagatgataaccctgaggctaaaaagcatttctttgatttgctgaaagttacagaataatgggtaggattcaaactcaggtctgtcaagccagaaaatctatatgtgtgatgcattataccatgctgatggaataaacatgacctcaacaactttgaaaccttccttgaaaagagacacaaaccttcaggaccatacgtgattgtgtttgctacatgtagacacacatccttctgaacatagtaattcaaattaaatttcttaaaagtcattgaaaaatgtatagctagagttatgtctctatgtgcaaattaattgctagaagaaagtaaaacataattaaaattgaatataaagcctattacattaaagtaatgaattatttattttaaaatatccacattgacccagttccattggttggttttaaaatagcaacatgtttttctcctgagaaaagcgtttctgtataaatacattcattctccctcccttacaggctctttcttgactgaacaaaagtaatttatgctttttttttcttacttagaagttttcataatcaaagggagtctctaaagcatgtaataggacggtagatatgaaggttgatagatatgtttcatcagtttcaagcacataaacagttcaacccccaatatacaaatgttataaccaacagtataatttttagcaattcatgtagatttgatgccagacctggctgcaaggtagtgtggagtaaacaaagcaaaggccctggagttctgagtttgtcagatcctcagtgtcattgctaactgcttaggctttaagcatcttgccaactctaaattctactctacattcttgccaactctaactgaattcagcttctgaattcaactcaaaattaaatttctaattaggattagaaaattctaaattctttgaccggatttataaaatcaaatataaaaaacatatatatatgtttttttgagacgggctctcactctgtcacgcaggctgaaatacagtggtgtggtcatggttcactgcagcctccaactcctggattcaagtgatccttctgtctcagcctaccaagtaactgggacaacaggcaggtgccactgtgctcagctaattttttaaaatttttgtagagatggggtcatgctatgttgcccagattagtcttgaacttgctttttaagcagtcctcccacctctgtctcccaaattgctgggattacaggcatgagccaccacatctggccaaatattgtatataatacatgtttctggtagttcccagggacaatgaaagccttttattcccacagcagtggttctcacaatgtggtccctagaccaatagcatcaatatcacctgggaacttgttagaaatgcagattctcagcctccatcctaaacttgctatatcagaaatcctgaggacaaggtcagcaacttcggttttaggaaattctccaggtgattgggaactaccgttttacactatgatattaaagggcgatttcaaagaatagggtaattcccagattattatactgagagcttcacaactcaatctctgccttgactgtatcacgaagaatccttaaacagaagagagtgagccacaatggatggttgtggaagtgaacaaccaaggcaggtggtactgccatttcctgatagaacactttccaatcccgcgtctcccacctctgggtttccatcttcctgtatctattttcataatgagtgttcatctaagcattccaaataagttcatactggataattatggatgagaaataaattggcaaccagaaaaataggaaatcatccctaaacaatgcctattgataaatatctggaaatttttctgggaagcataggtatgctgtttcacaatataagacatgaaagaatgttcccagaagggtaggagtggctggactgaaattgaagtagtaatttgaggtgtcacagtggacacctcaaggtcatggcattttatttattgttgcaattataagaacaataaaactgcaacaggcagcagggtccatgcagtttcaccagccttccacacgataccgttccccctcatcagcacttctgatttccagaggctcgaatccactaagcagcctcagcaagcacacacattaatatatttgcccaagacagaacagtttttgagctggcagttgttgataaagacatgtcacccctggttttgttctttactgaaaggcctccgaataggaatggtgaaattctttttatcacctccacatgggttgtcttcttggcacaaatgaagagaccggagcctgcaatcattcctcaactcctaaaacaaaggaaggtggattccattattctaagggccctggggattggacatcttcagaagcattcaagaaataaggaagctgcatgttaaaaggcctcagtgctgattaaaagtaggaacaaagctaggtgctcttgcatttatcacatgtattaattgtactgctatctttggcttgcagaataggatgttataaagaatgcagtgaccattttggcatgttgaaaatcccattattcatatgattaagaaacaaaagtgaagtcgccaagcactgggttatgcccatctaaagatttgttgatggaatgaaatttatcttttattcatactccaacaacttctgaataataatttctagtgctgctcttcggtgcgtttctggtggttctgagctttattatgatcgtttccatcctaagatatacttctctttttagtatttttataaaatttgataaaaagaaaccagtggaagtgatcatgtcacctcttgtttataatgcttaagtggagttttctttgtatagtcagcaaaggatggataatctcactactgcttgttcctgcaacctcagtgcatgctgttcaccccttgccctctgagttctgaactgactaccctcctctgagatgctcaaaggccactgatatggtttggccatgtccccacccaaatctcatcttgaattttagctcccataattctcacatattgtaggagggacccagtcggacataattgaatcctgggggtggtttccatcatactattcttgtggtagtgaataagtctcacgagatctgatggttttataagattaaacccctttttgcgtagctctcattttctcttatctgccaccaagtaatatgtgccttttgccttctgtcatggttgtgaagcctccccagccatgtggaattgtgagtccattaaatctctttttctttataaattacccagtcttgggtatgtctctatcagcagcatgaaaatgggctaatacagccccaagctcctttccactcatcattttgcacatgttgattagtcaccagggatagtctttcactttgcctgggaaatcccactcatcttttttttttttttttttttttttgagagggagtgtcactctgttgcccaggctggggtgcaatgacaccatctcagctcactgcaacctccacctcccaggttcaagcaattcttgtgcctcagtctcccaaatagcagggactacaggtgcacactaccatgcctggctaatttttgtatttttaatagagacagggtttcaccatgttggccaggctagtctcaaactcctgacctcaagtgatatgcccaccttggcctcccaaagtgctgggattacaggcatgagccaccatgccaggccccacttacccttcttctcacaactcttacaaatctcattctggagagcctgcctctggctcccatgctagatcacgaccccagtcatatgctttcaaggcatcttagagttttgccttagagtaattatttgattaatgcctgtctcccaacatagaggccataattttttcatcattttatccctagcacttagtagagtgccagcctggcatattgtgggcaataatagccatcaaatgttttgagcagggaataatatggttggatatgtcttagaaaaataacccttgtaagtttggaggtcaaattggggagtggaacgattaataatagagacttcttatagggaactattgcagttttccacgaaggaaaaagaaaaacaacttaaaaaaactacctaaactatcaattttatcatccattcacccatttgctgaacatttactgagtgcctacaatgtacatgtcagatactgggctgggtgctgagacaataaaggactctatttggaaaatgaaaggaaggggatagattttaaaggggtctaggggtagaatcaataggacccactaaacaatttgagatgtaaaagacgggcttcaaaaggaatctaagatttcttgctcaatgaccaaatagagggtgattctattaacccctttttagaacttcaggaagagtagcaagtcagaacaaaaggtggagagctcaagttgaacatgtggagtttgagatgctcatcagatttccagatgaatcaactggttcaatcacagtttttgaaatgaagcatcattgttcagtgcaaatcttccaggggaattcaaatgttagatacagagaagtagagactgagaagagagcaaggcccatttaaaaatataaaagtttagttttaaaaatgctgtctttttgacctttacaatgtgcatattttgaatgagagtaagcaaaaacaattgatttttttgtaaagaaatgctgaagaaatacattcatcaatactgtagtttgaatataaagaaaatcagaatatttataaataggaatataaataatatagcactcttattggatagcaatggattaaatgggtatttgctactctactgcttttttttgagctgattataattatatgaaatatattttagggcatgcaattataactgtatgggcatacctaataaataatatgtctatatcgcataaagtataaattataaatatatatgaactatataaaaatatactttagtcacttaaaacacataatagaacattttattctgttttttcatctttttttctgagtacgtaactcttgcacttgtccctttcaggcaatgcttaagaatgtatgtaaccaacaaatacaatgataaatgtcttttgcagcaagcttcaaaatctcaagagatgtaggggcagcataaaactctaaccagataaatccatggtatattgtctgagccaaatgctttctctaaaatgagagagattcaaatcagtgacaagaaggagcatgtggggcttaagctgactgtaggaggacacaggtgtgcttcagcaccacaaatgaacgcagaattatctaagaacaccttgccttgccagctatttaatatcacatgaaacgggccaagaatgcagtgatattgaaacaccaatgccagtattgtttttcctgtgtctattccagcaattgcttctttgttattgttgttcaatgaggtgttatttcaatactgaagtagaattcattaaagtaaggtttgagtggagatattttcactggttgattggttaaactgaggtttctttttgcctctctagttatccagtgtattgacagccatattttaacaagaaaaaaattttgacttcacacattcactcagtaaataactacttagaaggttcttgagccgggcacggtggctcatgcctgttatcccagcactttgggaggccaaggcaggtggatcatgaggtcaggagatcgagaccatcctggctaacacggtgaaactctgtctctactaaaaaatacaaaaaattagccaggcatggtggcaggcgcctgtagtcccagctacttgggagactgaggcaggagaatggcgtgaacccgggaggcggagcttgaagtgagccaagatcgtgccactgcactccagcctgggcgacagagcgagactccatctcaaaaaacaaagaaggtacttgatggacaacactctctagacttaggtagagcgataaagtgatgaccaacttacagctgaaggggaattccacatgttgggcatagagaagagtaggtaaaggtatagggatgacagagaccatggttgctcagataatgacaaacagctgagcatggctgggtgcatgaactaaaatattgcttgaatgtggggaagtaggatggtgggttgcataactggtaaggagcaaaccgtgactagccttaaatgtcaatctacagagttaagatttccaaattcattaggacatgtatcctacagtgtgcaaggatttttactaaaggaatgacatggccagatttgccatttggaaagctgaccccggccatcgtgtggaggatagtttggatggtgaggcaaggaatcagaagagaaggaagtgtggccaaggaagagactcttgtagcaattcaaatgagaatactgaacactgaaccaaggacaagactttgaatgtggaagcaggggaaccacataagacaaatctcaaacttggatgctggggatgaaggataagggaaaatcccaggtcaattgggttgatggagtgtatattggtttgctaaggcttctgtaacaaagtgcacaaattgagcagcttaaacaatagaaacaatagaaatgtactgcctcacagtactggaggctggcagtctaaactcaaggtatcggcagggttccttctttttgagggctgtgagaatagagtcggttccatcactttctcctgacttctggcagtttgttgacagtctttcatatcccttcgttctagaagcatcagcccaatctcctgccttcatcttcactgtgagttctccctgtgtgcacatctgtatccaaatttctccttttctagagatgccgttcatattggactagaggcccaccttactgtatcatgacttcatcataagtaattacatcagtggtgagaccctatttgcaaatcaggtcacattctgaggtactgtggtttaggtcttcaaggcagggatttttagagatacaattcaatccacaacagggtactactcgtggaaacagagaatacacaaagataaaccagtgtttgtgggaggaaattattaatgcatcattggttatgctgagtttgaggtactaagggttcatgcaaatagcaaatatttctgggactggacttaaacaattctagaacatagaaaccagcatctctcaaaaaagagaggccttgggtacactgcctactataatctcttttatttgtcttttttgaatttaaaaagtatttaaattatattagcagaggaacagaaatttagatattgcctggaaattttaaaaatcagaaggaaagggccaagtagaaaaaataggagactcttcccagatgaatttcaacagcttggtattcgtgtgatgagttgtgattaacaggcaagcaggccaaacgtggttaatagagctgggtctttgagttttctttagaaaatgttgattctataatataagtgacacatctccatacgccccaaagcagcatctggtttgatattgaggtttcacctaacagttttcttcagaaaactggaacatttggccaatttcttaatatattaattttaatagattttctgtttctaatgaaaacattcttgtgaaaacatttgtttttcatatgcataactccttattgcccaatatacataggaccttatatatggtagatgctaaatacatccagttgctggatgactgttgtgtaaatgtttgggacacaacctttgaaaagaatctcaatagcccataactccatgtagcatacaggcgctcatataatgctctcccttccccactacaccacatgggaatgttatggttgctaagaagcacaaatgatgccaccaaataagtctaacttgggtgccaagtctgttcttccagtggtatgggcactatctttaggcagaggcatccagtaacagttggaaagaaacccgtgtgactgcgacctgtacaatgcatgcaggtgacagtcttctctgtgcctctaaatgtgacaggcatcttggggttatacaaaaaaaagtatatcagatagtgccttctatggagacagtcaaaagctaagattgttggagtcagatcgacatcttcatatcccagctcagccagctctcgggctgtgtgaccctgagtgagtcaggagctttctcaggttcaacttctttataatgtggaaattgtaataacattaccttttagggttattgtgagcacaatgattgtatagagattaaggcacataaagaagttcacaatagtagatatggttgtcaaaattatcatcataattataccagagacctgaggttcctgtgtacttcatgaatctattaagaaaccattccagaaagtaggaccagtgggagatgaccataatagccatcgatattgcaaatggagaggggcaaatatgggtgcttctgtgatctgggaggggccttggaaggaggtaaggcttcagtggccttcaaagatagagtcttaaaagaagattgaaaggacagaataaaaatgtactgtctgaactccactatttcaaacacttgactgatctttgacttctctgaaacctgttccttaacacaatttctgaagaaggattggttctcacaatatttactattgtaagcttcatcaaacagccaagtgatttctttaaaaataggggttttgacctttgcctttccctggctgggaacttaatcatcattctttggccataataggccaactctatttgtgggcctaggacttgatattggagatcacgtgacatccttgtccacgtcctacgcagcacaacttgtcaaaccagagcagatggctcttccgagtctaccccactggcagagggtgaggacgtgggaaatgaagaggtcctttacagcctgggcttctgggttgctatgcctgtcaagcagcaaattatgataaaaagggccatgcaaaatttaacatttttttaatctcttgagaactgactacaatgtttactcttttctggagcttcccggaatgttttatataaaacttttgctactaaaatcctttggagttttagaatgatgatgggaagtatagcagagtttaagttttggtttgagtccactaaaccaggttcaaatgtatcagttgtgtgtccctgagcatgttacttaacttttctaagtgtcagtttcctcatctgttcaagaggaatggataataaggccctactcgtaagattatagtgaatattaaggatacagttgtatactgcaaaaggcttttgatacatgatagaataggccctcaataaactctagttattgttattttaatggtgccacacacaggtgatcaaggtttcagtgccacaaccattgaaagcttggagtcccaatgccagtaatgtcatttttaaattttcaagtcatgacagcagaatggtgagatgttctgctacagagaatagaaacttttagaaatggtttccttccaagcaatgaggtaaacctcctcttaaaaaaaaaaaaaatcttagttttccattgttacaatttcaagcagtggcttaaaacagtaagcacttgcaaattatgtggctaaacacagtaggcactttttggcatgtgaatctatgggactatagttcaggccaaatggctctgctagcctcagctgtgtctggaagtcagctggtcattgactgactaaggctaggtctggccaggccaactatatttgtttcacctgtcttttatccgtttccctgggacaagccagcctgcctggacatgttcttctcatggtagaggtataagatagagcaagtccccaaagcaatcacccaaatgctttgctagactgcttacatcacatctgctagcatctcattggccaaagcaagtcacatggctgagcacagcatcaaggggcaggggaggtgactctcacactgtggggaagtacagtaaagtccctgagggaaaggatgtggatacagagtcggggaagaagagggagcatcatgtgatctacctcagctttagagtaaccgatagccaaggggccatcacctcacagcgtctagactctgggaaacagacttttgccctagtattgattctttgcctggagtcgtatcatttgctttagtacctggctatggcgttaataataatagcacagcagaaaggttcagtgattcttgtatagctacagactgagctttataaaataacctggatgcttattttaagaatatagactctgacagtagcaagaatttttctcaattgttttgaaaaggttctcacctattgaacagctaggatgaggagggttgattagaattttcagtgcatgctctgaattatgccatggagacatgtgcaagactaatttgtttgtagcaacagagaagccaatcatgattagatttcctggcatgttattcacctgcgaggagagtcagacttgtgtccaagaatctcaatgtgaatttggtcataactacatccatacagtgctggagggtttgataagctctaggtgtccaagcatgctcttctagaacttaactgacttctgcatgcacgccagccttcctagtgtaacttagggcagagctatgttttacttagttgctattgtctttgtattttatttaattattattaggtaaataacagctatctggaagtgaaaaagtcaaccatgatggctgatttttagagaaaatatatcttgcttttaccctctgacttctagcccttcagttccttggggaaatacttgaactcactgagcagcggtggggtcacagtctgggcttgtatgccctcatttccaggccgcattcctcagaggggccctgagtactttgggagctgatagagtttggctgtcatttgaaaatgttttcctgctaaatgttttcatttagaagctaatttatactctgctttcaagtaagcttaactccatttcacatccctgacatgtagcacacactgcagtgactgggatggaagtagacaattcaatcaaaggatgatttctccgtggaggaaatgaatattatttgttcatcttgcaattcagaattctgagaaaattatgatgtttggcaaaggcactggcaagacagaaagacaaataaattgcatggtgtgagaacagccttcttaatatgaaggtttccttaaaacagtgggtattggctgcaggcaaaatattaagctgcaaatcactggtttgcaacttcttgatcatcggttgtaatcccaagaacatatttaatttcatatttagtcctaatttctttttgttccgtaatgatatttctgtcactcaaaataagccatctgttggcagcagcccacaggaaacagatactgcacactcagtaatcttggagtgagtctgttgcattgtgagaatgaaaaacgggcctcttcagaatcatagggtcacctttaaaattcctaatttttctttttgtcttctctttggccatatgtagtagtggaaataaatcttgtttcattgtcttttctgagatgtttgtgaccagaggtcagtgctttggactcgaggattagagagtttccagctctgcttggagatgcatttcccatttttttaaccctctatttaatcaatacctagctttgccatattttcaagaaaaaatatacctggaagtattgaccagaaatcaagcctatggcaaaagaatgccttccatttgaaggttatgagatggagggcaggatgtaagacagggagcaccatgatgtgaggagtgggcagaatttgataaattgacattatctccatctagtctttgaccacgcgtatttgaacagaattccaaatggaaagaagagacagctgggcacgatggctcatgcctgtcatcccagcactttgggaggacaaggtggatcacctgaggtcaggagttcaagaccagcccgaccaacatggtgaaaccccgtctaaaaatacaaaattagccaagcgtggtgatgcatgcctgcaatctcagctacttgggaggctgaggcaggagaattgcttgaacctgggaagcggaggttgcagtgaaccgagattgcaccattgcactccagcctgggcaacaagagcaaaactccatctcaaaaaaaagagactctgaccatgacttcacatgatagctaacacttcttgaacgtctgcagagactgtgctaaatgactgtaaatggattttctcctttattcctctcaacaaccccagcaagtttctcataatattatttgcattgtaaggatgagaaaacagtctcagagctccatagctattaagtgatagaatcttgatgtgacagccagggcagcttgatttcaagatatctcaatactgaagttaaaacttggaatgggttaaaaatgaagttgttctatccatcatgcctgcagaaaacctcctaagaataaagaaaataattcagattcacataaaagaaaatgttagagatattgaaatggacactcaaagcacatcaatgcaaaggtgagggagacagaggagcttttgatcttcccttttgttccctcatgttttgaaacatgcttccttttgatgccagctctttagaggttgctgcactcaagctttagatgactcttctatctcccagagcaattaaaaggtaatgtcactattttaccacgtgacgcttgacatctgattcatatatcactcagcctgaaggcatatttttcatactcacttgggtgcatgtcaagcagtgaattgatctcttttaggattcaaaaggaatccccttttccaaaggagattctggtgagtgaacaaaatgaatgtccctattacttcccatctcctttaattagcaagccagagagctaacaattatctcacctgtcagctctcttgacagcttgctgttgaatcggaaccaaagagagatcacctgccccaatttcaaaccccagcaattgatatcaaagtctccaccacccaaggtctacttaaagcccattagtgtggccttcactatatttcagtttcagttacctcaaaccaatatctcagattattcctccttccatcatggatattctgactcataaatgtcagtacatggtggaggttgcctcatctcacaaatttccactgtcaaaatattctcagcagtactagacagatggaaccaatccagggagcaaaacaaatgctaccccagcttttggcgcactccaaatgtagcggtactagctgttcttatctcataatatgcctatcgccatcattttttcccctaacaatctgtccatgatgacaagttctattccatgttcttgatgagggatcatgtctctaagccatatgttgtaactggaagactagcccagttgttgcctttacgtttttaaataagtggaataataccgctcatattaccttccattatcttagtacttatctcagtctggttctgtatcctcatcatttccctgactgagaaaactaaagaataatgtgtaatgtgatcgcaaatttgtaagatggaataaagcatttagtcgttctcctctgccaaattttttgattcccattttcagaggatgatttgtctcctgccataagtggacatggtgccactgagcatgtagcaggaccgagcagctggccaagacagatggattcctgtgttgatctagtgaagtttcacctttgtaaatcttccttgctttctcatgcctattaagcgatcttcatctcagaacagcctctttgccctggttttaccctctctagtaattgtgtctcagtgaactgtggttttagtacaagtaccctatgaaagatgtttgcaactctggtcatagttgggaagtcaccacatactatgctttggattcatccaaataacccttctctcattgccatctatctatatccatttacttatccatccctatccccctcccttcctccatccattcatccatccaccatccatctgtccacctatctggtcatttaatatttcttttggaaacagttttggaacttagctttaccttgtgatctgattatatgaaattaatctagccttttctgatttatctaggaaagaccttctttttcagagttctaattaagggtttgaaatgccacagttaaaacatagtgattttaaaacatatcataaattctctaacactcctccctttgagaggaggagtctgtgttccctccccttgaatcggggccaaacttagagatgtgcttttttttgttttgttttgttttttgagatggaatctcactctgtcaccccaggctggagtgcagtggcgcactctcggctcactgcaacctccaccccaagggttcaagcgattcttctgcctcagcttcccgagtacctgggatttcaggcacctgccaccacgcctggctaatttttgtatttttagtagagatggggttttatcatcttggccaggctggtcctgaactcctgaccttgtgatccacccaccttggcctcccaaagtgctgggattacaggtgtgagccactgcacccggccagtgatgtgctttttactaatagaattaagcagaagtagggctatgaaattccaagctaggtcagtaaaggccatactatccttggttctcatgagttaccttccttgggggaagtcagccaccatgtaaaacgttatactactctgagaccaccatgcaggagaagagatacatagactctctgaccaactgtccagctgagctcccagccaatagccagcatcaactctcagtccgggatgtgagccatcttggacatccagatcagtcaagcctcaaaggatttcagctccagctgacttcttacttcatcctcatgagaaaccccaggcaaaaactgcccagtcaagcccttcagactacaactgggccctgaatccatcatcctcaaaattgtaagatagtaagatagttgttgtaactgctaagttttgggttaatttgttatgcagcaataatagcagaaataaaaacaatatatgactgagttacttagcacttcaagggaaagcctaccattttgttttatagaaatgggctaattcttcttctagttttcacctttctgttttaaactatagcttgtcttgcaagctttgctgctagagattgaggtagaaatggatctagaaactatggctgtatgtcaatttcatttcctcaaaggatcatatattttatgcagatatggagagaatatctaagctgcaagagtttggaggtgaatagaagaaaaatagaagattttgtaggttatccacatcaatctatatactcctagtttaggttctcatattgtgttatataccaaatgtatacatctcttgatgactggatactttgtgaggccttctgttagtctttggataatgtataattcaacacagacagaggttttattttgacccttaagtctcacctccagggagggaagagaagccttcacattgctgtcacaattctccagatggtcctaaaaggagctcacttttcttgtctgccccagtcccagtcgtcatatcctataatcgaagcagcttcctcttgcatcttcctaaattaccacttagcatattccctgactgtgggcatattcagtcagggaacatgttaactcaaaccaaatattgtctgtgcattttctatctatgtgcatatcaaccttttttttttcagcgctatctgaacattaagcattaagtttgcgacattgctgcttcattccaaatgcgacatatataccctaagaaaaaggacattttcttatataagcacaagagcagtatcatactcaagaaacttggcattaatacagtaatatatctaacattcagtttatattcagatttccccagttgacccaatgatgttttctggttttgtttttgttaatagagtatctttattaatacagtatctaatgcatcacatttacttgtcagatctctttatcatcctgtaatctagaaaagtttctccatctattttggagtggtgtttggtaaaattaacatttttagagaattcatacccactgttttattatttaaaataagaaatatttaaataaatatttaaaataagaaatatttaaataaatatttaaaataagaaatatttaaataaatatttaaaataagaaatatttattattcagataaaaatgtgtcttattatttcttcctgattaaattcagattatgaatttggggtaggaatatttatagatgatattattcctttccagtatatcccatcaggagatacttatcatcagttagtcccattatttgtaattaaaagtttgattccgttaccaggatggtgtcctccatattttttattgtatcacttttttattccatattttttcattttaatagtttatgagcaatcaagaagtgacactctgacactgtgcaaatattcagttccccaaccagttttcatactatggttttcacatccactgatgagtctcacctgagtcaaccattatattgatggctgcaaactgatgaccttctaatcctgttccctgccggggtagcacaacaggcactgggctaaatgattgtacatggattttctcctttattcctctcaacaaccccagcaatttctcataatattatttgcattgtaaggatgagaaaacagtctcagagctccatagctattaaatatcagaatcttgatgtgacagccagggcagcttgatttcaaggtatctcaatactgaagtgaaaatttggaatgggttaaaaatgaagctgttttatccagcgtgcctgcagaaaacctcttaagaataaagaaaataattcagattcacttaaaagaaagtgttagagatactgaaatgtcctatgtccccattccatgtgggtgtagggaaggagataggcaatgtgaagccagggagggctgtggaggttcagctgctccatttataggctttcaacagatcgccctgttttcagccctaagccttacccctttgcttagggctactgggtatctccacttcagaatcctctacagagttccctggcaacagtcaacacactctgactacttctcagcaggctctcctatttcagttcttcttccttactatctgttatctctcatttaatatttaaaaaaaaaaaaaaactacatctcttgtcttttgtcacctcgtttttcattctctttgtgggcttttatttatttatttatcatattattattttaccataactttagtggactttcagaagggaccgaagagaaaaaacatgtactaaaacatgtgctcacgttttgtgtatgttggtatttttattcttcagttttacagatgcgtgccttacatttctactcacatcatgttgtttcatgtagcagaatattttcaggctgggcgcggtggctcacgcctgtaatctcaacactttgggaggccaaggcgggtgcatcaggagttagagaccagcctgggcaacatggcggaaccccgtctctacaaaaaataaaaacttagccggatgtgatggtgtgggcctgtggtcccagctgctttggaggctgaggcaggaggattagttgagcctgaggaggtcaaggctgcagtgagcggaactagcatccctgcactccagcctggcagacagagtgagaccctgcctcaaaaaaaaaaaaaaaaaagaatattttatttctgtgtaaacagattattattccttttttatttatgataattatataagcacttattactttcatataaggagaaaatcttcttcaaatttttatatgcatacatttttttcttcaaggaaatctatgattaagcctcttttataaaaaggtatgctttatgaattaattagagctagggaagttaggtaagtatatggagtaggaacacatgttttcctcccctcctcataggtttctagaagttcttctcttttttggaagacagaggaattatcactgccttgccagaagtagcatctgggcctttggtgtattcttcagcttgtttattgacagcttgtaaacgtgcatagatgttcacagtctttctttagttttcttgaccattctgaaatctttaaatgatcttttcctgtccatggcccttttagtcatcaccaaactagatctggtcctcagagaatcctgatttcttgaaaatctctcattattccgcaatactccaatctgctattaagtgaatactagaaacaaagtggtaggcactcaggatgttaggttttggggtgtttttgtttttaatgctgtatgtgaaggtgtgcatggcagttgataaggatgcctactctgtttcccttggcccagctgagtttacctgcagccttcatggacagttcccagataacacagacagcttccatgtcaaaaacctccatctcccactcctttcctggggacttctacagtgccatggtagttttactcagttctggtgaatagcagcctagaagtgacaagaatttaatgcctccaagggcatcccttaatcaatatgggagaagattcactgaataaataatctggtatctcagtccctcattggcactgttttaagaatgtcctatatgagtcctcagaaaaaatctgagcctcagttgcctacatgggttaccctctcgttaaaactcctcttattggatttctcccttctcagttgcctttcctatcacctcccctgttcttcctgggatcatcccaaataaactaactgaatccaagtctttgtctcagggtctgcttttgagggaactcaaactaagacaattacaaagactaaaaatttccagagaaagtgtaattatatgttgttggaaatttactctgctgaggggaagtgcacaggaaattattctttttagatctattaacaggcaactggtaaatttatgttataaataacatggtaatttactcaaaaatttctggaacccctactaggtgccaggctttctgctagggactgagaacacacgagtcgacaaaataaacataacccatccctctccatcatagagcttagattctaatggtgatatggacaaatcatgtcaattataattcagattggggcatgctatgctagaggaagtcccattactgcaggaatacatagggtcagaaagactgtgttcacccctgtttctcaacatctagcacaaaacctggcatatgatgggtatttgtttgtttatttgttcgagatagagtctcactctgtcacccaggctggaatgcagtggtggtgatagctcactgcaacctctgcctctggggcttgagcgatctcctacctcagcctcccaagtagctgggactacaggcacacaccaccatgcccagctaatttttgtaatttttagtagagttggggttccaccatgttgcccaggccagtcctgaactcctaagatcaagcgatccacctgcctcagcctcccaaaattccaggattacaggcatgctgggcacattgtggacgtgcccggccaccttgggtattttggaagtatttattgagtaaaagaagcatattcaagaatgagtttatattcaaagaattgcaaaaaaagatcaatgtcctacagaataaagcagatagaggcacggacaagaatcaggacttgtaggccgttgaatactgtttaggcctggagacttcatctgaagagttacagcagacaagaagcagagaaattttaggcattaggacagattcagtttagcagtttcacatggccactctgcagacactaggaagaatggatcaaagccagcaaaacagggatcagaaaaataagggagagggctatgctgtaatccacatgagaaataatggcaagaatggcaatggagatgtggaggcatggctggactggaaagagatgtaggagttagaatagatgaggcttagtacttatttggtatgagaagtggcatagagagagacagtgctaatattgcccacagttctgatcagcacagctaaatctggggctataggaggaagagtaaatctaatggtgaaggtgaagagagaggaatttgctccggtatagtgcttaaagaaggaaggcagttttggcagagttgttttgtattacatttctctctgcccacaaaggactctttatttatcaaaaagataaatctaaaatatgtcacttgaatatagctagataatttatagccttgtaaatctgaatggacttcaccttagataaaaacttggtatgttaacttttccatcaaataagtttcatatttttggctttagaacctatacatcatggtagtcctatttggccaaaaaaaaaaaaaaagaaatatcaaattatataatattcattttcttaaacaaaacatggttatataacttgtatgcttaggactattgtttgttggaatgatttaatgaactagattatggccctttaggtgcagtttattatttttaaatttcttcttttggaaatgtgaggaagggtaggaaggttaaatggaactgaagtagcaagctgggccatttaaggagggcatgagtttaaattctgaacgctgaataaaaatgtcctaaaataccttcatttggaaggaaatgactttagctgtttagccttggagggaataaacagctacatgcatactaatcttctgaaccctgtgctatgttcatagccttatcttttattcatttcaaaccatacaaatctttaagggagagaaacccctgcttcttgcagcattgcaactaaaatgcagatgctacatttctatcagtggaatttgagttattcttgattttataccttaggatatagcaaatctctaaagacagagtgtaaaggggtatgagtgtgtctattaatgggggaagaaggagtgtgtgaaggggatcccagtgggtgggtgaggagggagtgagaggcggccaggggtggaagcttacacaagagccaactgcagccctgtggtagagaagccctcctattctctgatatctatttcccaatcagaataatgaccaattccagtccctcttttggaatagggatgtggagagtcataatgggatttgaaagctgtcctgcttgtagactatcatttgaacttgacattttcacttgagtgccttcttcttgcaactagtttacggttttatcaatacagtttaatacacttttaaagccatacttctggcatgatctagcattttccaggaaaataaaagaggcacatactgtaactgttgatcatggggagtgatggatgggttctgccctctgctagtgcaaaacatatcactgaaagtctagaggaacaggtaaggggttgatagttgggacaatgaattttgaaagatactctgagcttatctcatttatctaaaaaatgacattagaaataaccagcacaacacggtgaaaccccatctctactaaaatacaaaaaattagctaggcacctgtagtcccagctactcgggaggctgaggcaggagaattgcttgaacctggaaggcggaggttgcagtgagccaagattgcgccactgcactccagcctgggtgacagactgagactccatctcaaaaaaaaaaaaaaaaaaaaaaaaaaggaaaagaaaagaaaaggaaagaaccataaattaactgggattgaaagtgtgtgtgacatttatatcatggcataatctccaaatgaagaacatgtttatttgatttggggatagcttactcaggattcgttgcctgatctttatttctctcaggtcctaaatgggactctttggaactcatgcattcctgacttattcagacctgcttctgaaccatgcttggctcagtaaagcagagaggcttagagaaggaaaattaaaatgggtcatatgcatctgtgtcctctttgaggcatgtcacaaaaacagccattctgggaacactgtaaacagttttacccatctgtctagtttaatctatttggggattaaaccttctggcttctcagagtacagggttgtgtgagaggctcgttcatttatgatatgtgtttctggaatgctggttacaccaatataaatgatggatttagggcactgtgtttacttaaagaatcatggatctcttgatttatactaagacatctggttttttttttcccaaaatctttgcttaaactgaagctgtttatccactgataaaataacctctgtgtattcatggtgcccagttgttggtaactagcaattatatactactttctaaaatagttttggttaaatggcatgcatgatttgtagtaatgaagttcttcaatgataaaaatattggaagagacccatttgaattttagctcttatatgttacaatgtacttcacactggctgtgtgcttagtattcatgttttagaaaataagaaaagcatttgggagatattaccaaaaagaatcactgcctctgtttctgtttatcctgtgattacagttttcttattaagaacaaatgtgggtataaactcaatacattgtgggattcctctctggtcaatggaccctcactgtgttctgacttctctctctttcttgattgatggtaatttgctacagtgaacttgaatccagacttcagtgtaagattgatgtgtgttaggaaaaagggaagaactcttgcccttagaatcagtttccaactttatttactgtttggggctttttccatgaatttcaattttacctatctaggacccatattagcttgaccattgcaagtagggagggctccaatcagtcatacagccatggattgatgagtcatacaatcataattaaagaggaattggcagcaacataaaattcatatgcaaataattgtgctgattcatcattgcagtaaaattcacttctctgcatttcttcattcaaaaagccacattcaacggggcactccattttaagtaggcaaatttggagattccttaaaaaaaaaaaaaaaatgttttccttaggaacaattctgtttagtaaaatttagcccaggctataaaatacaggctaggacaagatacgggttaggacctctactttctcttcattctttgattaggtagttttacagttcctgattctattacttagatataacatgtagaagaatatctacacttcagatgcagagagagaaaaaaataaaaggggtaccccacaagaagaaacagcaaacacacacaccaaagacaagaaatgtaagcataatcttttgttttttcccctgacacacagatttagcaagcttaccattggccccttgggtcatccccaaaccagagctttaaaaatctgtggttacctgagaccctagagctaagtcagacattctaggacctaagccaaagggccaatagaaactttagcccaagtaatggtcacacatgtttactatagagagcaaactgaattggtctcagagtttatctttctgaactcatgatggaacacagagagtacagaagggggaattgggcttaatttggtgcagctgttagaatatcccctggtctctgagctatttgtttgtcttactgaactccagcagattaccattgtcgggcaatctggcacattttgctcctttgttcatccccagccatgttatgtaggagtcatcaacttccccctcataaagacgaccactcagaaagcactttcaactgggacaaactcacatagtaataatctaatgtgtggctactatatgttaggcactgtaatacgctttactcaaatctcaatcaatctctacccaattctatgtggtaagcataactaagatataaaaagatgacaagagtcagaaatcaggtaagacactcagggtttctctactatcgtgtcaatggaaattcattagatcctggcccaaagcaatcaagcccatcttgggctgcccgtgtactttggctctagccagactatgagcacttcaccaccactaaagacctcagtggccattccattctgattatcctgctgacttcttgcctactgtgctctcttcaggaccactctgccccagctgccaaactttcaatctgtggcctgagccaccccagcaccttccctcctgcactgaaatcctcaggcatttctattaggttgttgcaaaagtaatagcgggttttgctattactttcaatggcaaaaaacacaattacttttgcaccaacctaatgctttgtcccacactggcctgcagagaacagcctctaaaacacttgccaaaggtgctggggttcccccaacccacatcttggtgaaggggctcattttggctacattgaaacgtggtttcatatgtttcatatgaaaccagtgtgttattatttttccccctttcccttatcttttagtggcctcaccagaatttgaaaagttatattcctttgataacataactcttcctcccattggctgagctcaagaagtgttggttaggaaagaaaacttcaggcagcccactgaattctaactctgtgtctgaaattctttcctacattaaaaatgttactgaagccctgatagtatcatttctttgatatgtgtatatgtatttcttataaagaaaagattagtttaagtgactatcaaaattaaacattttgttgaattattgcaaaactctgactgaaccatttagttatgctactaggatcacattttcctttttgtataatgcattaaagattctcactttgggaggccgagacgggcggatcacgaggtcaggagatcgagaccatcctagctaacatggtgaaaccccgtctctactaaaaatacaaaaattagctgggcatggtggcgcacgcctgtagtcccagctacacgggaggctgaggcaggagaatggcgtgaacccgggaggtggagcttgcagtgagtcgagatcgcgccactgcactccagcctgggcgacagagcgaaactccgtctcaaaaaaaaaaaaaaaaaaaaaaaaaagattctcaggctgactatcacatgtgtggatgaaggtaagagcctagaacaattagataacaagagtgaataaaatattaaataaagaatagtcatgattaaatcaatctctggagtaggatcactaaatgcatcaaacaaatgttagttgagtaaaatagaatcattgttatttttgagtttaaatattgaaatcgcaatcttatttaagaccaaagtaggtttacatttgctccatctcctcacccatttcccatattcttgccaccccataaaatgagaacttctgtcaacccttggaagaattgaggacaaagagctgaattctctccattgttctctgacttctctcatgggaagagagatgacgggttgagtggcaagagcctgacaaccattggtccatgttcttctgctgagtaaaatcagtgcattaagcatcactgcgcatgtacagtcactcttcttgggctcacagtggtcaataaggggtgaggagatggaattttctatgaagttctctgcctgtctgtcctgaaaacccaattctcaacaatctataggtccaagttataaacatggagtcaatggatagaaagacttctgaccttgtgttcaagctacattttgcaatccagtcttccaaattagaaggctgatgttttcatctctgactcttgcacatatttttaattcatccatggtttggaagttagagagttatgatggtttattattctcaaactgcaatactttttatttagttcatcaaaattaaagacaccacagccataatccatgtcactttctgcctcaaatctcaagattttgaccaaaacatatggctatggtggtctcttctagtttaaaagggcaaccatgttttcctatcattttatgcctgttcgcctatttgtggctggctaaagaattgtgaaagtaagagacattgtgttggagtaaaattaggagacccaaatttgactcccatctctaccagttaactacctgaggaaatttaggtgagtttcttaatctctgtactactcaggtcactcatttgtaaaataagaagaataaaaattactttgtaaaattatagtatattatctgaatatgataagatgataaaacaattattaaaaagaaaagatgtaatgctagtgctagatgctggggggattttgccattgaaaaataacctggaaataagtcaagactgatcatgggctgagttcaatgactcatgcctataatcccagcatttgagaggctgaggtaggcaagataacttgaggtcaggagtttgagaccagcctggccaacatggttaaaacctcacctccactaaaaatacaaaattagccagtcatggtggtgtgtgcctgtaatcccagtgactcgggaggctgaggcaggagaatcacttgaatctggaaggcagaggttgcagcaggactagattgcaccactgcactccagcctgggccacagggcataacaaagtctcaaaaaaaaaaaaaaaaaaaaaaaaaaaaagactgatcatagtctttctgtataggtcaatttttttttccattcttggacacataattttgctttaggtggtctggtttatgtctaaaacagaaggggaatgggttgagtaaaggggaaagaataaactaaatgatcaaagtcaacttgtttccagatgtctagatctaaaaggccacaaaagagctcttacttaaattatttgcccaaacaaaggagaaattttaaagatcccaagaggatgtggcattaagacagacactgtgatactcttggtgtagtcagggaacatcagaagctcatacttcctgacatggaggcagtgagtattgtaagagaacgctactcaatgacatcattcatggtcttttcacagccttcacctcctttgcctcaatatccttattcttcaaagtgttggtaaattgggcttgctgtcattacgcattttattggaataagcatgaattatgcaattagctttctcgctttccagcagcatatgcaaagtgaaccagaaagataagagaaaatcttttcctcaggatctgtagattagttcagcttttggaattttgctggcaatttgtagtgatgttgtcattttgactactcaacagctaagtttcacattttgggctgaatctggctgggtagggtggttacttgctttgatgttcttggagattctctatgttgcttggtactactaggctaaaatgtaatactgttctgtctgtgctacctaaaaccagtatgtttggggcctcatctgccttcagtagggtattttcctttatccttcgtgaaaatcaatttttttttaaatgaatgaatgagagagatgaaatgagaaggagaaaaatggttagggtagattttttaagcagtgcctttggcttttgttattttatgctaagttatttatcagtaattatcattagacaagctatactggggtgaaaagctgctgctttttcttccgtagccatgtgaaccctggggcgtgccgagggaattaaaataagaacagagcacactgctgttttatctcagctactgcaacatctctgcttgacaccctgtgttgaacaagagactatttagtagatctcaacaattatgcatgtactttcctggcagagaactctttgctgctttgtttgtcaagattatgttgaatcagcataaaaatcaggcctgacttatttctggaaggaagcagcctctctcgtaccattggaaacaatatgatcataataaagttttgcatatagaacatttcttttgagtgtagacaacaacttattcttgtaaagaatttaacatttaagtctcatatttccatacttatttctattgggactgctgcctactgccccacccccatcccccaccagccagccttagtttttggtatatttctagctctgtccatcttggagcagctacgtgaggattttacagctgtctttgtttctgatggaatcctaacccttttgtgatgtggggccttcatataagtatgtgatgtggaaaatgaagcccatgtgtgaatacaaagttaattagtatgaaaagtcccattttccaccacatttcttgccagcagctatgattaggtgcacctaagctttccaggtctcctaatattttttaactaaatccaagcatagagattccaaaatatcccattctgtgataatatagatgcatgacagaaagggaatgaatattggaaggtaatgtttgtgtgtgtgtgttacaggcttgttggagttcatcactttactttctgtacataaaggtgatttgttctaaatgttttaagcagcagcagcagcaaactttctgaagtctttaatcattgggatgattacttagggcatgctttaatgaaggaccactttaaaaagtagctccagagtaaggctgaagtccaattgacattttctctatgtgttatctaatggaaatgatctccatggcagagatgaaaataagacctttgaattgtgttgagtaaaataagatgggtcagatggatttgggcaatttggggatgatccttagaaaggagatagttgcatctggatggagctagggagacccagtgacagagggagcctgggatcatcttatggtgcatgtcatgtttgtgtagaaacgtacagtttgagcagaatacaaagttatataggtctaagaaattacaaaagaaaaccaacagcttcccctttattcctgatgctatggctggcagacaaatggggtcttcgaaatatgtgtgtgcatgcagccatgcacaaatgcttattcgctgatgaggatgcagtgttgatgcccttaggaacagcatcacttgtggactgggtggtaacaaagaactagaaagatgtgcttctcatatcttgatatcaatgtctatcagagaagatggagaaagctgagagatactagtctagcttgctgtgcaacccccttcttctgtcccatcctccttcttatgaaagacttcctaaccctcctcctaaagcctctttttctctgtattttacacctggtccatgcccttaatatccagtccagtagagatgaatatgcctagttcctggtgtcctgcttttatggccttagaaagcctttctctaaacatctctactcttcatgcttgcattcaggcttcatgtgaaacttgcaaacattgagcataataagaaagaatacatagtaaaccatcttaaaagaaagactataaattattttggcactaaaactattaaaaagtatatttcactttagtagacagcagagaaaaatctcttttttaagtttaaaagaaaaatgcattttcttagcagaataaatgagttaacagagtgtggtatggattgatcaaagacataaaataatatattttattgcacacttctagctctttgctggaaatacttgactataaaaaccttttaaaaagtagtttgaaagacagggatatagcacattgtttgtcttactagcagaggaaacaaaatgatcaatgaaagcagggtaaggatgaaggaatccttaaactgttttccatgcatatgattccatttaatcagcgctggaacaaaggatagcatttttctttcctttttccgtgtgtgttatttcatattattaaatgagatttgagtgaactgaagtaaatcagccaaaacccagcttggattagatcccctaaacttccttatgcccagattttttccagatggtttctcatgtcgccagtttaatatcaacagtgtgtgacacgctagaagaatatttcttagaccagttcagtccttgaaagataattatactgtcagttgccatcactgttactgtgaaagtgaagataactggggtaagtatattaaaatccagccccaaaccagcctgactttcagacagtgcatctaggaaccttcgctcatttttgtcactatctgtctatgctacccgacgtaacactggtatctttttgacagcaaaatgtctgcaggtcactttttggttatatgctgaggaaaatatgaagaatttttgcatgatgaaaaagatggtgtgctcatgtctgcttaaaaactctgatttctctgctttccactttaatttacaagttgaaaatgtattttcatgctactacccactttggatcttttttattgtacctctgacattacttatagcacatttcgcagctgggtttaaaagcatgttagcaggcaattgtaggtaccgtgtcaacaaatgtgggaaatagaacaagactaacacataaggaatgcctgcaaaatcatgatatgaggtgaaaataaaatggtttcatgaaaatgctttttcttctttttattttaatataatcacaatcttacagaaaagttgcaagaatgctggagagaaggctggtaatatgtttaccagagttaccagttgtcaacattttgaacatttttcccatatgctttttgtcattatatatgtatttttcccttgaacaatgacaataagttatgaacatcttgccactttacttttaaataattgagtgtttcctatgtacaagaatattttcttacatgaccccagataaactaccatgctacaaaattatagtgagtaaaatactgttgtttaatccacaattcacctttaaattttgccagttttcctggcaaatgtactggatccattgcatttaattgccatctccagttagctctgggatatcatgaagctgctttcaaaaatacagtattttaaaagacaatatggagcagctaccccagcaagcctgccaccaagagctgttacgtgaccgctgtgtcactgctcaccaaactctgttgtgcttctgcttttctggtaactaacttgcatcttacagattaccaacaggaagcatttcaaatgcaaatgttcatctgaaaataaatccctagagatctctgagtatctaaagaggtaaacacgcaaggagtctaaagttgcttttaggttgaatatgcacatttatttataaacatggctgtaaccataaatgattttctgcaaacttcatgtttatatggtgattacttcacagaattttcttatctacatatttgtttggaatttctgagatgatgagtgagtaggtgcattcactgaaataattattttagcatattaaataaaataccaaatagtgtgagatcctttcaaactgtaagatacttgtgtatgtagtttcttgagatatagaaagtagacttgtcagctgagcaacaagtcatgggtacagttggtattctttttttgtttgtttgtttagagacaaggtctcactctgttacacaggctagagttcagcggcactatcgtagcttactgcagcctcaaattcctgggctcaagcaatcctcctgcctcagcctcccacgtggctaattttttaattttaatattttacagacgcggtctggctgtattgcccaggctggcctcaagtgaccctcctacaggcatgagccactgcactcagcctggtattcttttagtagtgctgtaaggggaaaacctggtctactttaccaagccacactgggtttgcagttaggactcagagtactaatccttttcctgccatttcttagccctgtgacctcatttgccttatctgtgaaataaaacgactcaggcacgtgatctctgagcttctttcagcactacagttctgtgaaaaagttggacatctgcttatggccacagtaaaagtagaggaaaaaaatcattaatttaaaaagctgttaccatacccaagcttgttcttaaaaataatatatgcagttgatatccatttactcattagtgaaaccccattagaaatacaatccccagaggctgggcacggtggctcatgcctgtaatccaagcactctgggaggctgaagccagtggattccttgaggccaagagttcaagaccagcctggccaacatggcgaaacccaccccccaccgtctctactaaaaaacaaaaataaaaattagccgggtgtggtgatgtgcgcctgtaatcccagctactcgggaggctgaggcatgagaatagcttgaacccgggaggaggaggttgcagtgaaccaagattgtgccactgcactccaacctgggcaacagagtgagactctgtctccaaaaaaaaaaaagggaacaattcccagtttgaaattgaaactgattttgcttactgtatgactgggacctctgtgttcaggactttttccagtctcatacgttcccttctaactccattctacctttgtatttcttgtcattaaaagaagaagaaaagctcttggcattcccagtagtttgccctgtcatcatttccatcttattgcttaggccaagaaaacatccttcagttaatcatttgtgtgaataagcatcactctgaaacttatctcaaaagcctcccctgtttatctgcaggtctcttctaatactccaagtagttcttttccaattatgcagtaatttaccatagttacactgtttcctttcgtagttcttactgtgtctgtctgcttacacttacctgatcagcaaaactaactataccctgtatctcaaatgattctcatactgaaataaacaaataaaaattcagaagtgagaaagtggaaaagccagatcttttttttaatgttttttgtattttactaagcagatttatgactgaaagaaaaacattttaagcattttatcctcctctgttttaaataactattgtggggttttttttttcagaaaattatttaaatacactggctctagttaaaataacttggttttgattcatatattaatagttaaagtaaatattttgaactttcccatgaataagtacaatttagttagtcaagactttattattttatgaattatataaaaatattgttctctttcattcatgaagggaaggagaatctggtcatctagttggccagtgcatataatccactcagctgatgtagatatctgagtgtttatgtcaggcaaatgtgctccaggaggctgggataaagccacggatgtggcctccatgtggctcagcacttgagatgccaggacgcgctgccaacacctgggaataatagagaatgcgaatacctcccagattatcatagtatataaaccactccctgggagtaaatcaggaaccttgttcatgtgctttcaccctttccagactcctgggtaccttttaatgatcacttctgtagtgtattgcaggatactctggcaacaacttgaaggccttaatgtgactgccacaactgcctcgtaagttttcagtattggaggattatatcttagagagtctgtttaaaagccagtcactcaaatacctacaaggtccaggtggtagcacatgagtgaaactcgcactgggtaccatagtgaaagggaaaacttggcctgcttaaagagggcagctgtttctctgctccagtgaatggtaccaggtcagaatgtgggctcagagttatcacttcttcttgcctttaagaagaagctggaaattcagattttttgttggtgaaatctcctgaatcttaaatactggcaaatttacttcaaattaagaaagactgtaccagctaaatacgtctgtgggtcatcagtttgtgaattctgaaggagaatccaaaaatatattaatgtgcttcaacaggtaaattttctgttgactttagttggttatgagccacagggcctggggttctggctctaaatttctacataggaaaagccctgtgtttcctgtggacttgctatctcctatcctaccatttctctatcatggcaaagatgtccatggacttcagaagttctattgagagtttcgaggaaatctcagacctctcatcctttgtgtttctttcctggtaaaatggagattgctggggtccaggccttcagggtagaggacacatctgtatacaacacattgttttcctttctagttgatgcattagtcagtgtaggctaggctgtgccatataacaaactcacgtggaatgttcagtgactagacacacagagactttatcccttgctcttaccctatgtctaacagtgtgtgtcaacaccgttggctgctcagtgacctacactaacaaatggcttatttctctgtgatgctgccaccctcaacatagggcctctagggacttcatggcttaggaagagagcagtagcagggcacatcagttttgttcagaagtgatgcatattactcatgcttatggccctttgatcagagctagtcatgtagttccaaatgaactgcaagagaggctgggaaacgcaaggtcacacataagataaatatctcacaggagatatgtgctcctacaatgatgttttcctgaccatcaaactcagacttggggctcctgttaataagcaactatagatggttttagccccagtctttcctagatgccaagatcagtctctatgggtatgatctgtaagttatcagaagaatcttctagcttaagtcttgtgaatacaggttggagcttgggaacaccaggattttagaatccaaaagattaaggggcctcctcatccacagctgctgttcctctttccctgccatgtcatgatcacagcctgagagaaaggagacaaaaaatcttactgaaggccttgaccagcacgtgacttcccccaataattctgaagttagagttcaaccaagaaattgtagagaaggatgagggagggtcttctggttaactcctgccctgaatggttctatccctcagtttcacattggttgatcagaagtgtaagtttccacggtgtatgggggctgtgtagaaaagtttgcattttgggggttttgtgaatctttgttttcctggaaaaatgttcacttttatttcttaattattttttaattgacagataaaattgtatatatttatcatgtgtaacaggatgttttgagttatatataaatgctgtggaaggactaaatctagctaattaacacaggtattatcgtttttgtggtaagaacacataactttaattctttagcattttttaagaatacaatctgttgttattaactatagtcaccatgttgtacgatagatgtttaacttattctttctatccaactgaaattttgtattctttgatcacccctctagtccctgttccccagccacccaagtccctggtaaccaccattctacgctctgctgcgatgagatcagattttttggatctgcatataagaagtgagatcatgcagcatttgttttttctgtgcctggcttattttgtttagcattacgtcctccagatttagctatattttgaagtggtagcttcacaaagatgtagaccatttgttagtctgggtcactgagtaagcaaccgtgccgacatacagtgttagacaggttcattctactgcaaatgacaggatttccttcttgtatggctgaatagtattccattgtatatatataccacattttatttattcgttcaactgttgatgggcacttaggttgattccatatcttgggtatagtgaatgatactgcaataaataggagactgcagatatctctttgacatattaattttatttcctttggatatctacttggtagtgggattgctggattatatggtagttttattttttgaggaacctcaaaaaatgtacatatgttttcaattcatattgaaatttgtataatatatgaaacaattcctattgttttccgtaatggctgtattaatgtacatttccacagatggtgtgcaagggtttccttttctctacagccttgccaacacttgttgtctttcatattttttataatagccattcaagcaaatgtgaggttttaatttggttttgtgtggttttaatttgcgttttcttgatgattagtgatgttgagcatttcttcatgtagctcttagaatgttggcactttgaaatagttttaaccagtctgagcaaagttctctaatatgtacactgtcacagatttataggcttggggatcagtcttgatgggggacggagaatagaatgactacaactcgtatgtacatcttttagttatgaacgactgagaacccaattcaaaccagctcaagcaagaaaagaaattgattggctctagcaactaaaagtccaggggaaggactggctccagttacacttggattcagcactcaaaacactgcattggcactcacactttttctttcactattgtgttgttctccatgctggctttatgttgagccactacatgttggccctagctttagaaattctcaggttcattcaagtttagcaaaagaagtattagaatcctttcttgcatcctcaaaaatcctcagattcactcgaattggaccaatttaggtcacatgcccggccctgaagcaatggctatggcttgtgatgtggtgattggtttcatagatcaaactaaaaagtagaggttgttgccagatccacagacaaaaaaaagaaaagaaaaggaaaaaaaggtagcaggggatcaacacatatccactaaagcactaaaggggaaaatagataattacctcagtatttcaattatttaaccttagtatgtttttctttctacccactattatcatcttttcttgtacccgctggcttgggatactatcttcagaatcccctagtagttaaaactctgctaaagaaatttaactcttaaggtatattttaatctacaattgtaggtcaatacagaaatactttttactgaagccactattttatttttaacatggtgctatttgtacatctggaagcctgcagatagctggaaacagtttggatgtccttgaaaggaaaaatggttataatctctggatttctatttagatttatgtaagtcaaagaggttgagacagaaatgattattttccaaatatcttcccccatactttattccttttctttggtttattttacagatgtatctctgtagatagatgtgttcctcttgaaaatgtttgcagtttccctgttttttctttttttttggaaatgttactttgttaggaaaatacaccctactaattgcattacaaatatctagttttatcttagttataaactttatattttaatatttttaagtttaaaaagaagaactaaaccagatattgagacatttagatcctcatactggtgaaaaattaaattttgcttcttgtgcctctgtatctgtagcagataatggaaggcatttgtttgagagggccccaaatgatcacatgaaatatatggaataacattggccatatgaggatgggagatggaacttgtgttatttgaacttggaaacatactgttttccaaagtatattcttagagaactaatctgcaaggattacttggtcagacagatagggggaaatacgatgctttacttttctcttgaagactaaaaataaacatgtcattaagttttctggcaagttctgtaatttttttaaaaagtgtttaacactaacatcacatttacgaaacttattttgaccacagtttttttcccaaacttattttgaccagttttttgtttgttagcatgagcagctattaacatcccctggaatcaaagggccaactttgagaaatgtgttcttcacagtattgaaaaaggaacccatcatgtatgttggtaaacacccctttcacaaaatttaaactcttttcagtttaatcaaaaggaaagggagcttttcactgtacaaatatgattgaaagccctgtatatattcactcagatttctcaggtaaggggaagggtatgtatcctggaaatgacagcatgaacacttgccaagccctcatatgaatcagtgttcactcttgtaaatcataaatccattagccaccaagagaatttctttgttttattctcaaatttgcaatgaaacctgttcttaaagtaattcctttagtaatatacttgtgcaaagtaaaatcatctttaaaattaaccatttctcatatgtaatttccaaagttaatttctgaaaagcagaatataaaaattaaaaacaaacttcagtgaagttcattgtaatctgtctaaggtttattcactctgataagaactgctggtaaatttagctaatttctcagaagagctgagtctgaaaatatttccttataaattagtttatttggtttgtttatactaacagtacagttattttgatatacctttaaattatattatctgtactatgattttatatgcttttagtttaaaataagtatttcgcatgaatgcatgagaacccacacttattttatatttgaatgtgaaaagcgattctgctaaagaaattcactgccaacttactgaaattgatggagtgtatgtttttagtcagcatattatcaaagtgacatgcaaagcctgagaaagatgtagccccaggaggaaacttcatctgaggaccctgtaaatgcaagtaaatcaatttttaactacagaaaaattcaaattataaagacatcttatccacattaccttattacaaaatagaaccaataatatttgtattaccaataaattgaaaagtgccagaatgaaaaccacaagagtacttttcaaaacaatatcattaaataataaagaaggctaattgcagaaaatttggaacaccgtaaggcacataaagaaataccccaccatcctaacaccaaaataactgcaatgtgttggcatagttcattccagtctcactcatgttatatttcactaagccataaactatggtgttttcccatgtcgttttaaaccaagtgaacatcactttttaatagcagcattatatgccttcacatgccaaaacaaaatagtatttttcttaatgaaaatataatgaaaataaacttttgtttctattgttttgctttttcccctgagaataaaagcaagttcattgtaagaagggctggcatcagctttttataggagtacgtgcacagatttcaaattactgtgttctgttaggaatatttcataggaaaatcagcaaaggtttttctctagtttcctttccttagttctctaatcaaggcatagaaagaagacagcctaggatgagagaggccaagaactcccttataagtagttgtttggaagaagagtagaggaattgtaaaactcagccagataaacaattctattgaagaagccttatctgctaggtaaatctgaaatgtgttaaagtgattttacctaagccatactcctaccctttggttccttaggcctcatcaagcaacccccttgtgagcctcccccttctgaatctccttccctattttcctgatactctccccaccacacacccttattcctctcctgcgcttagggaactctggcacttggaatggtgtagccaaactgtaatcatgccttcataacattgtattgacaggcatctgtgacaatttcactctcccacctgattcttagagtaatgtttaaaaatttttggaatatccactcatgtttctcttgaatctcaaccaatccaaaaggttcagctcagtgtgattttgtgtgtgacatttccaatagttacacaccttagaccttggtccagcatgaggggataattaataagtacactttttctgcgggtgcttttggcaatactactcttaccactaatctctgagcataattgactacaaaaaaaatcatgtgctatttcataaaattccaagcatgtgcagacaccaggtagtatccaccaactttgggccaatactgcatacttggcatgtcataatgatttttttttaccccaggaagccatgctgaattctggtgataaaacacagtgagagaaacatcagctcttaattattttcattaaaaaacataattccaagaacaactctgaaatcatctagagtttggaatatattccagagacacacattctttctctttcttcctctcatcttataagatagggttatatttagttggcttttttcataaacatgtattttacctgaatttgaagattaaatttcttaatatttatatgaagaatgtagacaagcactaatggtgttttgttcagtctgaggagaagaaagttaacacaccatgaaagcataggaatgttttagaagatttttagctctcgcaattgggaatctcctggtttaaatttctatcatttcagcctcagggcaatccaaatcatacagggcttggacttcattgcatcaattctaatagtttttgcttttcttccccatgaaaacccccgtactttccttgtattgaggtgtggcttcagccttcaagggtccattctcagtatgcttgaaatctgaagatgaaatgaatttcataactggaaaatccagttatcaggcatgagcaaatggctgcatttgtttcagattcttttgctagtcgcttcattttcttctaatttaacaaggtcatgtatgaaattagactcagctgttatttattttattactgagctccaaggtataaatgttcctctcctatctagaaatttgctttcgactttctttctctttatatgtacgtacctatatcatgttttgcagcctccatagatataagctcaaagttaattttaccacgtcttttactcatctagaaaagaaaggtagccattctctcccagtgaacaatcaaattctgctgccttgaggaacaagtgatcagagcatttcgttttaatagaaaagctgtttttgttttgttatatttttttcttgcaaggtttgctttcagagctcttaaataaggatccactttcatattttctgcttgtgatttggactctgcttccgaaatgcatttgaagctgtctgataacacaaggcacatgtattataacatcattaaaatagaaagttaaaagttgtgggtgaaggaaggcaaacatttaccagcagaatgaatgaataccatgaatgaatgaataccaagaatgaatgaataccatgcataaatgaataccatggatgaatgaataccagctctagtgaggacctagggctaagccagagatcttactgagagccctgggcagtggaggcagaaaggagaaatgatggattacttagttctggttggagtggtgctggagtagggaaacctactggatcatcaggagaggcaacttttctatagcactgatttatgaaaggcatttgtaatatgtgtttttaaagatagggtagactttgaaatgattttaatgatttttaaaacatttcatggaagcatatcatgccctgagaaaagagcacataagaatagggctgcataaattttcacagactgggcacatccatgtaaccagcacccagagcaaaaactggaatgtctaagcctctcaacagtcccccgtgtctctttccggccacgactccctcctccccaaaggtaccattattgttgacttcttagaagataaattggcttaaacttgtttactttatatattttaaaacacatttcaatcatttgctctatctttacttttaaaataataattttgttcacttatggtttcatccatctattcattcaacttattgattcaaacaaaaattcttaagcacctgccatacgagtaacaaccatgaggtttagaatattttaaacctttcaattgtttcctattttttttaatttgtatgcactaaaattcacttcttttctctttctttctttttctgtgaatgattacatgaattttgacacatgtaaattaatgtaaccaccaccttacaagagattcagaacaatctcatcaccccccaaaagcacctgttaataccctctgtagtcctacattctttgcagacccctaagttctggcaactcctgatggagctttatattttgagtttcaaggcagtaatgaggatacatttttcattcttcatttctcagctgcaaacattccatttcaccttcctctatctctgcatctccatcatgctaaagtcatttcattttctgactgcaaaaggccaaagtttttctatccatattaagaaagatatttttctggtcaaaaattgcagtgttccaccagactgactaactttgttttctgcacaaaatgttttttttttttcttcccagaggttgagtcacttatgctgctgagcacaggaattttgacctttgggtgaggctcactctgaatcttccactgtgaataaaacagatcccaagatagagtggaaaagaaatacccagagctgaattaggagcagctggcagatgggctctgaaatgcaaaaatacccttttgagtttctcaaaattctagttctctaagaaaatatttattttttcccaattaatccacactcaataatttccccaagttatcttttgattgggaagttctgtaccacattgtagtaacaccgataacagtgaagtaggtggtgctttggaaggaaatcaatcaacttacattgttttatgcataacggcagttggaaaactgttcctatgatttcggtggtattctgccttctccatctgaagggaaacacttcatacacttgcctgtgtaagaaaggtgagtctgaattgcaaaatgggctttgttgataacttccttagtcttttatttagtatgtcatattacgaatgcaaaatatattccgtagagaaaagcatgaaaatacaatcaagcaaaagaacattgaaaacaccctactcctttgtcttcagaagcaatcactctttttttttttaactttttataatggaaaatttcaaatgtataccaaagcagagaaaatagtacagtgcagtcaacacacctattgccagctccaccagttatcgactcacatctactcagagttcatatctaccccaaccccaccctgcgctgagtattttcaaacaaatccaagacatcgtatgatttcattcataatcccagtgcgtatgtacctctaaaaggtaatattttaaaaaatataactataatgccatcatcacagctaaaaaacattaataactcctgtttatcgttaaatattctgccagtacaagcttctctgattaactctttttggccatatttgggtataaatcgttggaaaaaccactatttgtaacatcttggtatatatcctttccaactcttgtctttcttctccgtgcgtgcgtactccctgcgtgcgtactccctgcgtgcgtacatatttatgtgggcatgtgttcccctctagatttcctgccatagataaacacatgtactcatattcataaattggcttatatctgcaatacttttctggaacatcttttcataagagtacatgtgcttccctcattgttttctcccgtgactatttagaatctcataggatggattactattattcattttgtcatttccttttcactgttgattgtgaaccatccttcactgaaagtaaataacatttaaattatcactgaatataaggtcagttacctttagatattagcaaaggtaatatattggtgagtgaagcaatgagcaacacagaatctgtctctgatgactatttttgggcaagtgtgttttactttcagttaatatgcttgaaccacatgctcctataactttgtatgtttttgtagtttgtctgacaccaagttacactgccaggaaagtggccactgttcatattaatctggaaagtctgagttgccatgataagttgggtgcatgatcacaggtaaatagacacaatatttgagtcacagtgttttcagaccctgatgagttctgatgattcaggaccacttggccttatttacatttgtgatattctgcatgggtgggacgtgtactttggagtcagataaacaaagcgtgaatcctgcctccagcattttttgccgggtgacttagaacatattaacatctttaagcttgaaatgtcttcacctgcttaaggaagatagtaatagtgcctactcatgaggtggttgtgaggattgaatgtggtaatgatgcagttatggggccttgcatagtgcctggcaagagctcagtaaatggtagcagctttcagttatagttaaaagaccaaactaaatgccatatgccagagactatgcacagagagattccatttatgtacagtataacaacaagaaaatgaatctaagccatgagaagtcacaatggaagttatcttccagagggcagtggctagaaggaggaacaaggggctcctagggtgtcgataatattattttcctgaatatgtgctggtgacttagttgtatgcagtttcagaaaatccgttgagctgtgacttcattacttacgactatgcatcttcaggtactttatgtttcagtgaaaagctaaaactgaaaaaatataaaacaaacagtataacattaatcttatttgtggtaataaggcacctggcatatagtaacatagaagatagacagataaacagatagatatagcgatatggggaatactaatcattgttagcaatttgaaccgttttttaaaattaaattttaggaaaattgagttgaaaataatattgattcaagtcaaacactacatatattttgaattggtcgttctaaactcttctccctcatattttcaagacaacattccatatttaagttggaagcagatacttgctttgctttctctggttttctctcgggagaaaatattaggggtgcaactgtggcatcaccagcctcatcttgcctgtctagagcagagcagagctgctgctttgaaatgagttattgggagcctcagaaaccctgaagaggtttggccatacccagtagcaagctctgcttatcaaattgtcccaaagagtaattcttttctcataatacctccaagaagcaacaatcaattcatgacctttttttgggtagtgacatttcaagtgctcagaagaacatctgaagtttgagaaaatagacccgagaaataggtatttaatttacttgttctccagcaatcacactcattttgtcaagcagaatgaaatgagctaggcacagcatttcatatggtgaagcttgctgtttggtacagctttaactgccaaactgaggggagccctcaggatgtgtttgtggaatttcctttgtggaaaaatttcagttctcactgttgttagtccttttgtctcacaatcatacatgtgtacttaaaaagcctaagaggtaaaatatttgataattctccttttgaaatgcaatgcatacagtgtagtcagatttcatggaagtcacctagtgtagagattttaacaattaaaaactagtttaagcagatgggtcataatcggtatttcctaatgtgaatatggatatggaaaatataattataaggatgttagaccctctcttttgctgtcacagcacacagctggaaattgcttattattagcttgcaaatcctacaggaaaacacagaattatttttagtactcagcaaatttatggtggtaattatgagtacttgcatcacttccggaatgcaagagtcctatatctttagtctccatgttgagaagataatttttatcacttgtatgccctgcatattgatttctgtggtcactgggaatcaaaagtacttttctggtaatacaatgggtgacagtagtcattttgcaatgtaaatggtttggaaggctctgcagccgtgggtttcttaaatcttgaaaatagataaagtaaaaaaagaattgccttattttcccatcaccaaatttgccaatctacctgcatctgaagtcacaccttctgcctccttcccgtgacaatttggagtcattcttctggctctgttaagagtcaaatccttccctggtgtccgggatcctatctgcctttagcattacttaagaactccactcccactcccacactccatctccctgggatcatctgtgtgcccccattagtctacatgccgtaactgtggcctcatttactgcaaaagtcctcagagaattagctatgttaatggtctccacttgctctcctccccttctctcctcagtctagtccactgggtttccaaacccataagtcttctttataagtgacacctccatctactatttcctcaggctgagaacactggagtttataagttttcttataaactcaatctccaaaatgtagtggccaatggaaaacttcctctttaccctctgaaggtttgctgaaaatcaactgacaaaaggcagattaataggtgaaaaggcattcacattggttaacattcctggggagaaccagagtgattaccccatcacatcataaccataacaaatggttatggctcttcttcttaggggaaaggggagggagaattttagatgatttgggggattagtaaatgatttttaggggaattcagtgaacttgaagaatacacaatggcataggataaagtctgtggggcctgcacaacagacaatggttgggcctgcagaacagacaaagtctgtgcaggtgtgttgacagacttccatttttcttcctgcaacatgagttcagtcaatacaaactcagggaagggaccagacatgactgttttcttctttggcaggtctggactttaggcagataaaggaacttcagagaacaatccatcatgtgctttgggagagacagaggattgagagagatggggaagggagatgtcagagagaccttgaggcttctttttcagttcggaaggtggaaacaccatattataagatactggtttctaagacctgacaagaatatatttgcaatccaaccatttttcactgtctctgttgatgtgttcccaactccatcatcagtacacagacgtccactggttgtcacccaagccctgcttcttgctgaatctaatgactgtcaattatttggtctttttaaatttgacctctcttgatgaaactttttttctctttgtgcctctgtgacctccagttatttcagtatggagaacttaacaaaagaatgttatctgggtaactgaaagggatatgtagaattgtgtatccttatatgatgaatgtgttaaccaggtaactgaaaggtgtgaaaagaggtctctaaggcgttatggaggcagtaattgcaggaaagagccaccagcttgagggaagaaatctaaatgacttaaatgtagattttcagaggagcgtccctgaggagctgaaactctggcctctgaggagggaacttgtgtatttgaggtcacaggaggggcctgtggagctgagatctggtccttgaagaagggtgtgctggctgttgccagctctgcagttgctgagctggggactatgttatgtgagtattggaaaaacagcaaaatgaaataaaccactggctgggcacagtggctcacacctataatcccagcactttgggaggccgaggcaggtggatcgcttgagcgtaggagtttaagaccagcctgggcaacatggggaaaccccgtctctactaaaaacacaaaaattacccaggcatgatggcgtggacctgtagtcccagctacctgggaggctgaggcacgagaatcccttgaacctgggaggccaaggttgcactgagccgagatcatgccactgcactccagcctgggcgacagtgccagactcggtctcaaaaaaaaaaaaaagttctgccactgccagggtggagaagggagactggaggaggctcacgggagtcttgcctgttccctccagcacctcctagggccagagcctaacagggagccactcaccaatcaagaatgccaggtcttagccccatcccacaaagcagagtgcagaagggtgaatatacatttattggataaattaactaggaattcacctagtgcttggtccatgactgtattcagctagaccctgggaggcatgtcatgagtgcctggtgtgcatatactttgccttccaagctcttggcattttccttgacctcacaactagaaaaaaacatcaatttggttgtatatctgtaactgagagtgcttgtttctaaaaatgcagattatataaacatacagaagcttatatatacttggcaagaaatgtgcaattagtcacgtggtggaaagtccctccgcacgactcatgtagtctacctgctagaattctacttcttttatgtcttttgaaggcaaatgccatgctgtcacctgaagaatccactggcattctgttcatgtaggtagtagccttcctgtctttttgcagtgtggagaagggattgggagaaaagacgtgtcctgcaaaccctgagacatcaccaaggtttgcaaactgtggttcaagttcttcacctcttcacatccacaggagaaatatctgttctgacattgtctttagtgctaaactattgtaatcaagttctgtcggggttgagagatattccttacttagtagaaaatatctcctggagttctggcaattgaaaatggcctcggctctcacctgacttcccctgcaattgcaaaaaattcatcagctgagtcgggatgttaaggcaaaaatatgatttcttgaagagagagggaggagaagagaaaaaaaaaataagtgcagtgtggtctaccggtttgtgtcgatgctattcaaaaacatctctcaatccatttatcctttccaaacccaggagggtaccagtgccatccccttcctaattcaaggcctgctctaccttcaatggcctgtgcaccttgcctacctctggaactagttctgtggtctctttccctctcagttatctctacaacttcttagcttagaagtcctcttaacaaaagactacataaagaaatgtgaaaaacggagaaagtatagggaacacatttaacgggcagattatgtatcaaagctaatgtccctgaagtctcgatattcatccagccttttagcatcgttgcaagattcatcagtggagaaattggggaatgcaatcctgcttcattttctgcggagtggctccgtttggagcaggaacccatgtagcttgtaatctcctacgtaatcttccaaaggctttctgttttcttgcagacaagcctttatgctcttcccagtgccacattcctgagaaccctagggctccaagaagtgttctgtttgcatccttcatgccatgtgttttttgtttttgtttttgtttttttttcttattgagatggactttcactctgtcacccaggttggagtgcagtggcatgatctcagctcactgcaacctccgcctcctgagttcaagtgattttcctgcctcagcctcccaagtaggtgagattacaggtgtgtgccaccacgcccggctttttatattttctggtagagacagggtttcaccatgttggccaggctggtctcaaactccagacctcaaggccaagtgttttggcctcccaaagtgccgggattacaggcgtaagccacaacacccggcctgctgtgggtattttgtgatcacactgtcccctccaaacacaccttgtggaagacacttgctctgccattctggatttaaaataactaaactttaaaagttaggagtaattttctatctgggtattaccctaaagagtcttccaaacgactccaaagattttaccccatagaagtattcctctaagtgtcccctgcaacttcattaaatttatccgggatatttgttaaaaatgcagccccctggatctcactggagacttctaaaacagtttcagagagtgggggccaggtttacatgtattttttaaaagttctacagtctattcttacagaagcaaaagttgaagaacctctggtttattgtgtagatttttggcgtcatagaaagaaagcaaattatagagctaggaaaggaaaatattgccagcttaacacttgagttatctgagataaaatggaatagcttttagaaataattaagcatctattttcatgtgttttgggaaaaaaatgagatgtaatctcaaaccagtgattccattgatattacagttgacaatgaaactgaaaaaaataaataaaataaagtgaatctttaaagaaaaaccctaagcaaataaaagtaaaagggatttaaattggtggaagagttctattgttgttttcaaatccctgttcagccactaatgaacagcgtcacatcagacacacacgtttcttcatgttcccttccttgcgtagtgtacccacagggggcactggtacccatgccggggctggttaccaccttcccgtgggccacagcagcttcccagcaatgctccaggagcatggggctggctgcttgtaaaatcatgacgttattgtcttctgtgtctacttccactttcctcctcacccctatttttccctacaatgtcccatctcccccctgacctgtccatgccagtgactataaccttcatagtcctctagcttgacagaaaggaatagccatctttatggatttctccaacagacgggctggttggcaccagtctttccaggatggagcttgctaatcagatacacataatgatgctgatgtgccagtctaggggactacactgctatggtccaacttgcagtgacacagtggatgcagcagacacggtcagtgggtcagtggtccccctaccccctttgatctctccgtgtgctccatctgacttccagccaccactatctgtgctggagggttcttttttcttcttcttttttttcttttttttttttttagatggagtctcgctctgtcgcccaggctggagtgcagtggtgtgatatcagctcactgcaacctccgcctcctgggttcaagcaattctctgcctcagcctcctgagtagctgggattacaggcatgcagcattgtgcctagataattttttgtatttttagtagagacaggattttaccatgctgcccaggctggtctcgagctcctgacctcgtgatccacccacctcggcctcccaaagtgctgggattagaggcgtgagccaccatgcccggcctggagcgtcctttttaccaagtgcagagagccttgaagcccacagtgctcaggaattaactcccctaggagcatcactcatccagtgactctctgaatatggcatataaatatccaagctctctcccccagggatgggatcattctgtggcctgtagttgcaccttttccaagagctttccagtaggattaagctccagttgctccctgaatcatccgtcttaatagcagacactttgttggttgccttcttttccctatttcactgcctcattttttttttttaattcacacttcctgggactacctcaaaaataaactactagccctgaatttgtatctcagggtgtgcttctgggaaaacccattaccaaaacccgtcacactatcaacagaaacctcatagtgctgcaatgcctttcctttactattaaccaaagtgagaatttaggattatgcatccaattcaagtaaagggctggagtatctttctgattggggaaggacaaagtttgtaacagacgaaagctcttagcaccctcctagccaccctccagctgtgccccatatggttgttaattgaatgtcagttatggcttttccctactaataccctaaaatgcccttgttcatcatctatttgatctgttaatccagctaagcccatggttcccaaacattaacacacgttgagatccactagaggaccttgttaaggccacacattactggaccactacttcacccccagtgactctgatacagtaggtctggtgtggggccttaggatttgcatttctagtgggttcccaagtgatgctaatactgctggcccagggaccacactgagaactgctggtgtgagcctgcattcaccataatctcttgaaacatgaagcttggtgtttgcatctgagataaagcattaattgatttttcttttaaaattttatctattggttttgattaggtaatttatttacctggcttaaaagtcagagcatataaaacaatagatggattctttcttaacatgataaaacacactgatctcaatataaaagccagcctcatgctgaccaggaaaacactggaacatttccacagaaggaatacaacaaagatgcttattatgtctacctaatttatcattattctggaggtattctttatgaataatatagagaaagaaagcccaggagaagcaaatgaaaaacaaactatttgtacaatagaaatgttcaataacttggctgtgtacaatattaatgtgaaaatatcagtaaattttctgtacaagcaataaacaaagagaatatatagtggaaacagaagccccatttttcaaaaatatataatataccaaagaatatagcatattttaaaaatttgtgagatctacataaaaaatcttaaaaatatcctgaagtttacaaagaaagacttgaaccaatgaaagagacaatgttcttgagtggcaagactcaacttcatacatgttgctttcctttaaataagaaataaattcaatataattccaataaaatactatattagtccgttttaacactgctgataaatcatacctgagactgtgaagaaaacgtttaattggacttacagttccacatggctgaggaggccccagaatcatggcaggagatgaaaggtacttcttacaaggtggcggcaagagaaaatgaggaggaagcaaaagtgcaaacccctgataaacccatcagatcttgtgagacttactccctatcatgagaataccatgggaaagaccagcccccatgattcaattacctctggctgggtccctcccacaacacgtgggaattctgagagatacaattcaagttgagatttgaatggggacacagccaaaccatatcattctgcccctggctcctccaaatctcatgtcctcacgtttcaaaaccaatcatgccttcaaaaccaacagtcccccaaagtcttaactcatttcagcattaacccaaaagtccacagtccaaagtctcatctgacggacaaggcaagtcccttccgcctatgagcctgtaaaatcaaaaacaagctaattacttcctagatgcaatggacgtacagttattgggtaaatacagccattccaaatgggagaaattggccaaaataaaggggatacagggcccatgcaagtctgaaatccagcagggcagtcacattttaaagctccaaaatgatatcctttgactccaggtctcacatccaggtaatgctgatgcaagaggtgggttcccatggtcttgggcagctctgtccctgtcgctttgcagggtacagtctccctcctggctgcttttgcaggctagtgttgagtgtctgcagcttttccaagcacatggtgaaagctgtcagtggatctaccattctggggtctggaggatggtggccctcttgtcaaagccccactaggcaatgccccagtaggaactctgtgtgggggcttcaaccccacattttccttccacattgcactagcagaggttctccatgagggccctgctcctgcagcaaacttctgtctgggcatccaggtgtttccatacatcttctgaaatctaggcagaggttcccaaacctcaattcttgacttctgtgcacccgcaggcttaataccatgtggaagctgccaagggttggggcttccacactctgaagccacagccagagctgtatattggcccctttcagccatggctggagtggctgggacacagggcaccaaatccctagactgcacacagaatggggatcctgggcccagcccacaaaaccactttttcctcccgggcctctgagcctgtgatgggaggggctgctgtgaaggtctctggcatggcctggagacattttcctcacggtcttagggattaacattaggctgcttgctacttatgcaaatttctgcaattggcttgaatttctcctcaaaaaaaatggggttttcttttctaccatatcatcaggctgcaaattttccaaacgtttatgctctgtttaccttttaaaatggaatgcttttaaccgtacccaagtcacctctttaatgcttttttgcctagaaatttcttctgccagataccctaaatcatctttctcaagttcaaagtaccacaaatttctagggcaagggcaaaatacctccagtctctttgctaaaacataacaagagtcacctttgctccggttcccaacaagttcctcatctccatctgagaccacctcagcctttatcttattgttcatatcactatcagaatttttgtcaaagccattcaacaaatctctaggaggttccaaactttcccacatttttgtgtcttcttctgagccctccaaactctcccagcctctgcctgttacccagttccaaagtcgcttccacattttcagttatcttttcagcaatgccccactctactagttccaatttactgtattagtccgttttcacactgctgataaagacatacctgagactgggaagaaaaagaggtttaattggacttacagccccacatggctggggaggcctcagaatcatggcaggaggcaaaaggcacttcttacatggcggcagcaagagaaaatgaggaggaagcaaaagcagaaacccctaataaaaccatcagatctcctgagacttattcactatcacgagaatagcataggaaagactggcccctatgattcaattacctactcctgggtccctcccacaacatgtgggaattctgggagatacaattcaagttgagatttgaatgagaacacagccaaaccatatcaaatatcaatataaattttataaaattttgttaataataaaaactttttagggcacttttattctcacatcaaaatcgagtgaaagagagagttctcatataccccctcctcccacacaagcacagcttccctcattatcaatatttccaccagagtggtacatttgttacaactgatgaacctacattgacatgtcattatcacccatagtccacagtttacattagggtgcagtcttggtgctgtacattctataggttggacaaacatctaatgacatgtatcctataatatcatacacagtagtttcactgccctaaaaatcctctgtgctctgcctactcatcccttccttccagcaatccctggcaaccactgatctttttgccatctccatagttttgccttttccagaatgtcatatagttggaaccacttagtctgttcagactggcttgttttattttgtgaatatgcattttaattttctccatgtcttttcatggcttgataactcatttatttgtaatccccacataaatttttgacctaaatttgtggtttctagagtacacaaggaaaagtaaaatagcaaggttagctagaaaaaaatctataagagtaatgagaaaggactaacatcaacagttattcaaacataatataaagtcataattatttaatcactgtgatatgagatcatgaatagagaatagaaaacccagaagtagccttaaatacataaaaatacttagtatattataaaattatcattttaattattgataaagggatggaatatgaaaggtgtggaaatttgtgttattaatattgttactttcagcactgctttggatttgtttacacctagtgttgtggagaactcactatacgccaggtagcatgctagacatttccataggtgttgacttgtttaatcttcataaaaatttgtgaggcaagagttcatatttccagtttaaagctgaagaaacaaaggcccagagggattaggtatctttcttacagttgcacagcagtgaatggctcagctggaattcagacccagcctttaactccctacttagagcgatttctatacatggagcttctagcctcactaagtagtttgctggccatttcttttaccatatgtgtactttctgctcatcattatttcatttgagtctttcttttctggtgcagtcaacatgaatttctagttagcaacttagatcatagaattgattttaagaaaagattcgtggccaggcacggtggctcacgcctgtaatcccagcactttgggaggccgaggcaggtggatcacttgaggccatgagtttgagaccagcctggccaacatggtgaaaacctatctctacaatacaacaattagccaggcgtagtgttgcatgcctgtaatcccagctactcgggaggcatgagaatcgcttgaacctgggaggcagaggttgcagtgaggtgagtccatgacactgtactccatcctggatgacaaagaaagactctgtcaaaaaaaaaagaaagaaagagagaaaagagagagagagaggaaggaaggaaagaaggaaggaaggaaagagagagaaagaaagaaagaaaaagaaagaaagaaagaaagaaaagaagagagagagagacagagagagaaaaagaaagaaagagaaagaaagaaaagatttgtaactattttcttttacaggaaattgactaatttgtttagttgagaccagccaggtagaggaggattgatggtcttcatggtctgaactagtagttcagcggatttgagcggtacctttctggtattctatccctgggcctcagacagagagaatgtgatcactagcttgggaaatagcatggccagttctgagcaagagctgggaaagtgatagtgtgagtcttgggttctcccattcctggggcttctcccttacctcaagaaaatgtggatgggtaatgaggctcctctgtccagggaatactggctttccagctactccagatacctcacaggtattccctctgctcaactggtaaccaaccggtcaacaccaacatgacaagaacctgacatgacacctaattcctctgcttccagggcctgtcactgcccctctgtcccaggaggaggtaatcatagacacgttgctgcttacaatgatgctgagttcattcacagccaacttacggtttaactcctagttctgaggaaagccagtactaaaaaaaaaaaaaaaaaaaaaaaaaaaaaagacaattacagttcacctgttgagtaaattcatgatttactagtgatttctgacttttattttttcatctttaaccggaatgcagaccttgtttcattaggtttattatgtttttaattactttaggacctatttggtggctaattatctgtatgacaggaaattaaactgagcttccatttgtctgtaggcactgtgaaacctgacttccttcctcccaccctggcccctttcttttttcaaacaatgataacatgaattgtaaatctggaccaaagtgatttgggtgcaacatgctcaggctatgcgttataaaacacttagtgaacatttgaaagatggccagatttttgtcaattgattatcaattgtcacctgttgatcgattcaatgtagttgacataggaggctcttccaccatctcggtcaagtgtaagacctctcacgtctgacttctgaggtttaaaacctggcatttgctactcggtagctgtgaaaccttgtccagtttctaaaacttccaatgttttagtgtccttacctataaaatggggataataataagacctcatggggtagctgaaaactaaatgagacaatatgtgtaaatacatgtcaagtatttcgatcctggtacatagtcactgctcaataaataatcacttctattgttaagacagagccaagagttgcagagatgggtcagcgattttgttgacagccatctgttgtctatttcagataagagaagagcattgagaagagctgcatgtttctgctgaccttgatagtagaggcagggtttgccccttagtctgaaattaggcaggaaggcctgcaacatatggactgtcacatgctgcaagctctgattatgtttgctcttgacttctcagactggccaggagatgctaatttaaagctcacagtcataaaagattcgtccttgccttactttccactgtctaactcttgcagaagctctcagtaatgacttctacaggtggtgtgattccctccccaggaaagtataaaagcaagagaacaaagtaaataaaaactccctaattcctttagattttatttatattcccatagcaaagctgaagacattctttatttagaatatttgtctcagttgtcttcattatttgcaatctcaggtataaaatatgctggaataactggagagtggtgaaaacatctaaagtgtatttacaggcctaggttcatttttcaaagctttctcttcttgtcagcctttgtcaaatgggttcaagcttttaccagtaagaagcaaatattacattggtgcacttcaatctcggtagttcagaaggaacccttatgcccccaagagctaaatttaccaatctgagtgacatatctgcatggaggaaatatagcagcaggaagagagacacacaagcacacacaaaccaacccgggctgcaatgataattgcagtgtggcggtccctggtatcctaggagtaattactctgacattctttatcattgtgtgttagatgtgatatgaagcaattatcaagttgttttttggaatattgatgcctggccgtctttgcacattatcctcatctcatgctgtgacccacaggacttaattctgacaccttgagtctctcatggcagattgataaggagccctggcttaatcttccctttcttaggatgagactctggtgtttacccttgttattaaggagaagtactgataacatgcgctactgccattttctttttccacttgcagaattcgatttgtatctcaaattctctagtgcctggtctcctactgaaaatattggcacaatggcatttattgctaattgtaaactaccctcataacaaaggcagacattattgtttttccttataattacttgcaatagtccccgtgttaaccctattttaatagtaatctaaggactatggaataaggtttattaagaccacatgcttcagatctgtgcagactttgttggaataatgcttgtgggtatagaaatttcactcttcaagaggtggtctattttcttaagttgaaattggcattgtgtcagtattttgctttcatctgaatagctgtttctctgctcctttatttcatttttttctgagagcagacttttatttggagcatggatcagcatgcccacatttagaatatttcatatcatatcagcttgtttgtaccacacacaataagaggcatctggcatctttcagaaaggctggaggaagccacttattgatgctgtgtatggctggccctccctcgccccatgtacaaggtctttggtgaggtatgggttggtaaacagaaaaagcagtggccaaaccatgcttatagctgtggcctgtggtgacacaggacacatatctatctgtgtgttcttctgtggtcagtgctgtcatccctgggaagagatttcagcatggtggtttggaataatcaagagtgtgggcattgaagacaggctgcccccatccctacatgcaataagacccacccatattttatgactataactataatttacacaaatatggttgcactaaatctcatccttttctctcttttttcctttccttttttcttttttccctttactttgcttagcatgatgtttgaaaggcctatttgtgttgctggatgagcccattgctgctctgtgctctatggaattccatggtgtggaatctgacttagccattactccatgacagccacttcaattggctccagatcgtactactgcaaacaacattcttgtgtatgttcctcacagacctgtggaagaatctctttgatgtacaccttgggtggggttactgggctgccctccagaaaggctgcaccaagcctcactcccattcataacatgtgcgggtttccatggcccccatcaccacattcccaccaacactaggcattactcagctctcattgctattttaatttctgcttctgtgagactaatgactcttatctctctgttgacttttttcccatgataccttttatggaatgttaactcctaactttaatgtaatcaaattaataaatgtttaacatattgatttgtgttttcaaatttttaagatgtcctttctcacatctaagtgacaaagaagttttcataccttttcttcttttaagtttataattttacttttacattagttctttaattcaccaagagttcacctctacagatgataacaggtagtggtccagtttatttttctctatattaggtaataatgtcactaaaaagtccttctttttcctattctgttatggtcacctctgttgatttcttagtgttttctttgtttcgtgtttccaaacattacttcattgtctttactcttcccagtgttgctttttgagcttgataccaatccagttcttactctgcactgtattctgcatttcttagtttttctttttacattttctttttaggagcttgggcaagagtgaaatgagagattattgttaaggggtacagagttttagttttgaaagatcagaaagttctggaggtccactgcacaacagtgtgactgtacataatactactgaactgtgcactaaaaatggttaagatggtaaatttatgttacgtatagttcacaattaaaaacttggatcttgcaattagtttaagaaataaatttaggaatcctcatacaaaaaatttatagcacaggaataaactttatggaaagtaattagcaatgtatgatgagccttaagaatgtccattccctcttctaggtgtgtcctaaagaaaaactgagaaaaatttggagagagaatcatttaagtttattcattgcaacattatttatgatataaaaaatacttaatctaaatgttcaacctgaggaatagttaaattaaggctggtacttccacaggaaggaaaatgcagctatcaagaacttgttttgaaatatatttaatgatatgaggaatattttaattataacattattttaaaaataagaggcataactgtgactttagtatgaatctaattctttaaaaattacacatatatacaaatagaagttaaagtgggagaaaatacactaaaatgtaaacagtaataatctgttggtggtgggactatctgtgatgtgtgtaaatgctttgtaaactgtaacttggcacactaatagaggcagtggttgtaagtcactcagaatgaaaaacttgagctatgccaacgtaatagcctaatttaatacttaaaaacccatatttagcatttagcatatagtaaaaattttcctatactatctacatatattatgttactcagttctgccaactacctgtaagataggtactattactgttctatttccttcatgaaaaaagtgaaactcagatgtcatacataggaagctgaagaaccatgatacatgtacccagaacttcctgacattaacccctactttttaccaattccaaaataatctaaacaaagaagaacaagaaaaggtagtcataattgcctaaatgttttagtatcttgttggcttgtggctcggtcaactctactgagagctcctgttgatggccagacccaagccctgtgttgaagatgactgagcaaagagctcaacagaagagtggctgctgggaatgccttcttatggtgggtgttgtaatgcttttattttgcagactctactggggccagtgaacaatgagggaatgaagtacatcattccacatgttagctggttaaagtcatggcacttggcagcctccttgagaaggtactcagaggtccgtggtcattccttagaggcatattgactcattgattaaaatgtgctggatttggtcaacttcctccataacaagtcatttataacacatattatttaggaaatccagaatgctctgagagctaatttaaattataagtactcttgaaagccatgactggaaatgactctcttagcccttcaggcccttgcagtgattggcagtgtacttccaaagaagggcttttaagtggtttggttcattatatgtgcattctacatccaaaagaacccatgccttgcatgggaggaattatgaggccggagcactcctctttattagaaatgtaaaaacacacagccttgccctggtcagacattcctacacccctggagagtcctaacacgggcttaaggtccacagaatcattgcaaattctgaatatgcatattctctcaatggcagtacatattttcccggcttaataggatgttaaaatgtggctcttgattttggctcaggcataagacaatgcctgctatattccatggagatcatcctacaaaacttttaaaaaggaaaggtatgatcccttaaagaactcaaaccccttcctcatactgttagtctgaaaggattgtggaaagttgtttttatgtttttatttgtttgttttgaggacaaactttttgaagataggtgctggtatatggtgaatctcattcttctcccacaaggaggagaggtggagaaagtgtttgcttctcaccttaagcctagtgagaaaagcttcagtaaggccattccaagaaagtcaaaaactttccttgaagttagggaatatattggcctgaggcgtgtctccacatgaaaaatgtaaaagattagaaatggtttatcagcttttacagtggtgcaaagggtaggtcattgctctgttaggattggatttattggggcaaaggatacaagagtggtacacacagaccagaaagttggaaaaatgctggtgtaggactatcttggattctgtccagtagggctatccagaagtgtaaacaggccttagcagttagaatctaaagggagtgccggattccttggtcaagtgagagaaagatgatgaaatagagtagacacgtcacctgtaaaaggctaccagaggtgggcagtatctgatgatggcatggggttgaggcctttgaagaatcaacaaaaatgcttcataaaaattaattaacttcaaagatcagcttggcccaaggaaacaaagccatcttttctgttctctgccctctgcttcctcccttctttttaacccagaaggcagtagaaacaaaagttaataggaaaagagttgaggtcagccgggcacggtggctcacgcctgtagtcccagcactctgggaggctgaggcaggtggatcacctgaggtcaggagtttgagaccagcctggccaacatggcaaaaacctgtctccactgaaaatacaaaaattagccaggcgtggtggtgggtgcctgtaatcccagctgctccagaggctgaggcaggagaattgcttgaacctgggaggcagaggttgcagtgagccaagattgtgcccactgcactccagcctgggcgacagtgtgagactctgtctcaaaaaaataaaagagttgaggtaaaggaggaaggatgaccacaccccactttcccaactttccacctatgaaaagcaccagctggcaaaggggaaaggctttaacttcaaaacaaacatgtttgaagtttaaattattatatagtaatcaacattctaaattttgtgaaatactgtatctagtgacttaaagtatctttaagacacttcatttcctaagcatgaccagtaaagtcatggactgctcagaacttttttaagaagcagggaagaatgcctttctctaaacgcttttcttcgggggatgatgggagacaaaattaagttgctttgttccatcccatgagttgtgtctgttgcatgtaggtgtaataccctcagatgcccgactgaggttatcctgccaacccaccagtctgcacttctgatcttgccagtctggtaactgctctcagagcgtggtgctaataagacctggaaggtgagatcccaggattctaaagactagtcagttatctgcaatgtacattttgcaatgtgaactgagcaggagaatagggttgggtcagggcattcagagggaagataagctcaaagtgggtgcccttcctattgccttggggcctgacaaaaattatttcccatgctcactggaaacaaagtttgaagttaatatcctttactagggtttccagatcaaccttgccatccaataaaaatacaggacactctgtatttaagtataagcatgttctaaatatcacatggaaattcatactacaaaattagtcattgtttacgtgaaattccaatttcactgggtgtcctgaattttaactggaagccctaagcgaatcctctccctcttctgcataataggatcacatttataccattatttctttaaaaatgcccagtgctggagccatcaatatctgcaatgatcccagtctccacatcaacatttggcatacgttgtctgatacccatcaagagaacagtttaaagtgtttaaattgaggccggccgtggtggctcatgcctgtaatctcagcactttgggaggccaaggcgggcggatcacgaggtcaggagatcgagaccatccctggccaacatggtgaaaccctgtctctactaaaatacaaaaaaaaaaaaagaaaattagccgggcatggtggagcacgcctgtagtcccagctacgcgggaggctgaggcaggggaatcgcttgaacccgggaggcagaggttgcagtgagccgagatcgcgccactgcactccagtctggcgacagagcaagactctgtctcaaaaaaaaaagtgtttaaactgaaaccatccgagaatttcaggcctgtgatccttttaccactgccctttacacgaaacagtggtcaaacaccaataactgttcttgagtaacttttctgccaagctggaaaacttccagccgtgtggtcttggacaagccacttcacctccctgagttctcatcacctgtaaattgataataataaactcctaatgagaaccaaataagctaatgaaggggaattagcatgcaacaccataaaagtccttacaaatgtcactacatagcaatagtgtaggaaccaatatgtctatattttaaattttttgctgttggtattcagtttacacacagaaacacgcaaatgcatgaaaattactttttaaggtaacatacaactccagaggacctgactccctgaggacagccatggctattagaaccaccacagaactccaattaatcagttcagatgccttctccatggaatgcttttccagaaccccctctaagtatccagaccttttaaatccccctgtcttttcctttggctgccaactctaggatggggcacacaacctgagaaagatctcaaagatgatgagaaaagaggaagaaagagtgggtgaagaaaagctgcagatcagagctcaatatgcagccctcaatggtgcaccttcccctcacctagaagcagtgcaagtggttaatagccactattcttggggagctggcaattctccacactcctcaggccagtacagactaagccactggagcaaggcaggcctgtctttctaggtgacactgctgctgtgcaccgagacccctgggatggcttccagaagttcattctcactggtttcagcactcattctacatttgcttcttccaagttcctggcagcctgtctttacttccttattaattcattcatttttgctgttgtttttgttgttccggctaacaagacttaagaaaagcccatttgatcttaatttcgtgttgctcattatcagttctcttttaatcgttttcttatgatcttcatcaaaaaagttacctgtaaaacccaggaagaaaagtccttcatatctccccgccctccccttcttctttctctatctcttttgatgacaaagtggcaagtgactttccagagagctttaggaaatctaaccaaatgacaaaatagttgtgtgatgtccaatatactgaataaatgtcttacagaaaaacctttagcaaaaagcctggggaggaaggtaacggcattttaaaaaatcagaagctcagaggagacaaacactgcttgatgagcacttgagatgaatactacaagctaatgcgagcaatcagcaggtttgtggagaatatgctgatatctgcagaaaaaaaatgcagtggcagagaagagcttacagataaacacaggagctcaaaaatatatatattattgctagaaaaaccttgacattttgaccatcttttatgttgcaactagaagggaaatacagagtccagttcttacaactgaatatccttctggtaatgaattcattctaaatgttgtttcagaactcctctacatcatgcttcatcacatagcaaattagccaggcaacccctcattaataagaatagttaaccataagaaccaacaagaaacatacattaataacatttaaaaatttaaatcagggattcaacacaggaaggtaactcaattcaggatccatatttgttaccttctgttgagcattctcactactgactccctcagcctcactggggttccagttgtcagccccccttattggcaaaggagctgtctattggactgtccaagtggtatagggctcatcttttcacgcctctcaggagctcctctgtggatgtttcttgtaaagcctgcatttctttctttccttctgcagaaagcctgaacagttcaaaacacctccacttaaatgtgtgcgcccattcacccatcccaaatggcatatagtcttttagtgaacctcagctgaaatgaacaaaaaagaaaatttaagttcacaccttcatgcaaaaaaaaagaaaaaatcatactttgtgcttatagagatggtaatgaaagatatgatttaatagatgtttattggatgttgacactcacccatcccaggataagagttcttcaaggcctgctatccagtgatcggtgatcaccttaccgttagtttattggctctgactcgccaggtatcaataataaagcaacaaatattctgaccctcaagcatgactcatttatacttttaattaaggtttaacatggtgaaacaggtaaatttgtttaaaagtgaacttgaggccaggtgtggtggctcacgcctgtaatctcagcactttgggaggccgaggcgggtggatcacaaggtcaggagatcgagaccatcctggctaacacagtgaaaccctgtctctactaaaaatacaaaaaactagccgggtgtgttggcatgcacctgtaatcccagctactcgggaggctgaggcaggagaattgcttaaatccgggaggtggaggttccagtgagccgagactgtgccactgcactccagcctggacaacagagcgagactcagtctcaaaaaaaaaaagaacttgaactgtttcgattcttcagtcattactgaatcactaaaaataacgtgatggatgccaggatacactgtctaaatccctcactgaagaatgtagaccccaacctcctgccgtgatgggagtgttaagctggagctaccagcctctatacggattgacttagctaaagaaagcccgaggttgtatccgcattctaggtggcccacatctgatgaccaatcaacccaggagaacaaaggcctggcccgctagtttcaactcagcacagctctgaaaggtcatgctagtttcagactttcatcaagttgagttctgtctcctttgagactgacatactttgacttcaatcctctgcccagttttactgccctcccttcccgtctaagggtgttgatctcaagagcgcttcctcattatctttctgcatgcatatcttcatttcagagtctgccttctggagaacccaaacttcagtagctacttcagtttgttttagactattggcttaacacacagagacctagtgagtttctttattagcccaggatctatgaagaatgtgctaaataatactctttccctccaaaaacatcatacaaattgttcgtagttttatccagaaaacagaagcctcttgaggagagagtagtggagaatgagtttggtaagagaagaggagtctagaataaaaatgcctgtgtaatgagggcagaagtgagactagtaggaaagtagacatatgcataagatatttccttcaactacctaaataattgttgataaccctgccattttacttcctgcaatggaatgaggtctctactaatggctaccctttgggagttcttatagtttttttttaatatgtcccagaaaatttaaccaatgcccattttcttaaaaaaaaaaatctatcctatttcttgcttgtgtttctgtctaaaaattacattggtgtaagtgtgggtgtgagtgagggcatgtgagggggaggctttatttatattgtgtctttcagagcctacagctacttctaattgaagcacaataataaatatgactagatcaaagaaatgttaatattatctgtggagcttccttatttagactttgaaacactcattaattttctttgattcatattcagaatatcaaatcaagatctaaaggaaataggctggagtggtggctcatgcttgtaatcccagcactttgggaggccgaagcaggtggatcctttgaggtcaggagttcgagaccagcctggccaactggtgaaaccccatctctactaaaaatatttaaaaaaaaaaaaattagccagacatggtggtacgcacctgtagtaccagctacttgggaagctgaggcaggagaatcgcttgaacccgggaggtggaggctgcagtgagccaagattgtgccacttcactctagcctgggtgacagagtgagacgtctcaaaaaaaaaaaaaaaaaagatataagggaaatagccataaatctattcatagataaattgcaatctggatggaggaaagaggagggaatgaaacttacccctaaaggcagttaaatatttcataagggatgcaggagccatgggctttttcaccttttaccatttgtgaaagccagtttttccagtattgcaggaaaaatcactacactagttagcataaaaggaaaacagaagagaatttcaccaagcctgtcaactgagagagtcactgaagccagcaaagattattcatgttcaacctgcagaccttttagaggacatcaaagatcaaaggtttacccaggaatgttttcctggaaagagtgtctttaattgttttaaaaaaatgtattgaacaatatgtgttctggaattgaactttggaataactcatcactattttaaattagtggtcattcctctattccttgttatttccaagcttagtatctgattcctaattccagtagagtccagaattaggcaactgctttttatgatgtcctgtttgtaggctagctttctgcatcccactgcttctactagattgacaagatgaggcaccttagatccactgtggaagtatatgtaccacatgggcttctattaaggcatgagtatagaaaggggaaatggcccaaaccagagagttgcacagagttttggcatccacaaactcagtgcagaggaggaaggattgatcaaatgagcttatttggttcccttcttttctccttcctccctctttccatcttttctccctctggcttttaaccctggttgtgaaacaaaattaccaattcagtttttttatttgcctttttaatgtttttaagaatgcctgtgcccaagcactgaaacaatttctgggaatggagcctgaacagctttatttgtaaaaagcaccacaggcaattctacagcagggccagatttgagaagcacagagctcctctatccaaaagtaaagcaccagtggacaagaggaccaaatgggacgtgcccagctgtaggctcaaccacaaattgtcatccatctccattaagtgataccacagaatttgtataccacctctcagagtcattattaacttcccaagaatgccacagtgttctgagggacgcagatacatgccaccaacatatgagaacattcttggtgaaatacgatttggggttcttggttcttctggggtttctgaagtctttatgacacagcaaagtctgtgctacggggacactattaactccttagtaactggttatcttagagttgcatatttctgttataaatctcaacaattatgatgaaataatttcataacacatttcaaaagtgtccacccttctttccctttagcagttcatgttaatttttaagtagtgaccctttacaatttctcacccaaatctggccttttggaaacagagctataaacggatacactgtggatggagttttactggcaaaaggcattttttaaaaattcccatatgttcctttaagtgattttttttgttctctgaaaccaaaaagcatatgttgaatgattttttcctcacactaatatgtcgtttcagacccttaccaggtctcttaaatcttttcactttcttcttttttcatctacctacaaggcaacttatgtgtagtccatgacttgatctcttttatttcctttgtatgaggagaaattgtgcctggatggaaaatcatgagtcttcctctctctgagcactcttgactctcctgtcttggggcatcattctttgtaatatagatttttttttcataatttcccacagttgccatagacagatgcaaaatgaaaagagggtattgattctctttcttttgtggggcatagactctttcagataacttcagttagaaaaaacaggatgtaagcgtgtgtgtgtgtgtgtgtgtgtgtgtgtgtgtgtgtatcagtgttggttctcaaccctgatttttcttttggagtaaatcagtgttggacccaaaaagcaaaaccaaatagaataaacaaaatgaataaactaacaattacctaatagctaagaacatgaactctgtaatcacatgaggtcacataacatgtataagtttgaaaatacctatttggaaaaatctggtgaaaacttggttctaatttagaagcagtagttctaatgagttttgtgtataagaaataggtgtgtcttagtccatattttatgacatagccattgttgtctagagcctcgtgaaactcactttccatcatgtccgctaaaaccattccctacttcttacaccatgtcagaccttccttgtgttgttcaagggatcttatatttctatttctaagttacaggtaaatcacgatgcttgctggtatctcttcacagatgttccactgccacatcaattcagcatataacacagtgaactgattacatactcccttaattttacttcctagatacttgtcaacctgtctctccccttctctacttttaatgcctttgtttggatttttataatgtctcatttgctctattgcaaatgcttctggcttagtttttctgtctctagtctcttaccctccaaatctattctccgcctgtgtgagccatctgaaaaaggcaaattcactatgatactttttcttgtcaatttttcagtgtctcagtcgcctttttagcagaacatataagaatttggatggccccactctcgactcgacttctctaggcaaatctaaccatccctgattcagacgctaggcttctgacttctcacacatctcaggctttttcctgcctctactcctggcttgcttctgcctccacctgggatgctgtttttttcttcttcagttgattagttggcgttcatttttcaggactgaacacaggtttcagccttcctgtgggtctgggcttgttacttctttaaccctccaaggcctcctgaagatttctctgtgcagcacttgccacattaaatcgtatggtatttgtgtcccaacgcactaattttaatgttgagaacagagccttgacaacttcatcttgccacccctatcatgaagctacaagtatatgctcaataaaaactttgcaaatgcttaatccagaaggaaacttacagattaactagtagaatgactttatttcaaaaattggggaactggctaggcgcagtggctcatgcttgtaatcccatcactttaggaggccgaggcaggcggatcacctgaggtcagaagttcaagaccagcctgaccaacatggagaaaccccgtctctattaaaaatgcaaaattagctgggtgtggtggcgcatgcctttaatcccagctactcgggaggctgaggcaggagaattgcttgaacccaggaggcagaggttgccatgagccaagatcgcaccattgcactccagcctgggcaacgagagcaaaactccatctcaaaaaaaaaaaaaaaaaaattgggaaactaagactgggcatggtggctcatgactattatcccggcactttgggaggccaaggagggagaactgcttgaggccaggagttcacgatcagcctaggcaacatagcaagacctaattgctaccaacaaaacaaaaacaatgggaaactaacatacaagaaactgaaataacatgtcagaggctaaatgtgaatttgtagctgagttgaaactagggcccagatatccccattgccttctgacacattttattttgagttgtataatttggcgtattcatgagaaacattgttaattggattatattaatttcccctaattaggtttgcttgggaaattgcagagatgctcagttctttcctgttcacagtgacccaagagcttgatacttttcagccattggccatttcatcctgcatctattctgctcttaatggtactctaaatagcttattttgcaatcttaaaaatctcatgcattatgtcagtagagatgtttgtttgtttatttatttattttttgagacgaagtctccttctgtcacccaggctggagtgcaatggcactatcttggctcactgcaacctctgcctcccgggttcaagcgattctcccacctcggcctcctgaatagctgggattacaggtgctcaccaccacacccggataatttttgtatttttattagagacggggtttcaccttgttggccaggctggtctcaaactcctgacctcaggtgatctacccgcctcggcctcccaaagtgctgggattacaggtgtaagttaccgcgcccggctgcaataaagatgtttctataagccaaactcattgtaattctgtgtgatacattaattcagatggtataaatgtttgctaactaaaatcaatatccagagatggaattcaagaagtgtcatctgagttgggaaaaaaatagtgcaactgatattttggtacaacttagccatggcttaacccatctcaatacagccacatgattcttctcctagcatagctactgagggaagaggaatataaagaattctctacttctcatactggttacagggcatgatattctttaactttgtagattgcgagatataagcttgtgtcttggttatatgttgcattattgtcacaaatttgtgataacgtcctgtatcttctccctgttttacctctgtgattaaaatatttttcaaacgtgcactctctccctgtcacctccatgggaagagcattttcttgcaccattaagccttgtgcttggccacaggacataacttggtcaatggaatgtcagcagatataatgtaaacacaggctttaaatgccttgatctcttatgctttaccattgccatggaaagacctttctctgcgtagctgttatttcctcacccttgttctaggaggagcacacgtgcaaagacctagaccaacctgcatcaaggagccgagcctaactaggcctcagattgaagcagtttcccagacaagcccaacccagatcaaccaaccactaagtgacccacagaggcaagaattgatacatttaagtcattgacttttgagtgatttgttttacagccagctgattcaactcctccctaataggctacttaattaaaaaaccttaagccttttgcataattgatcctaggacacttgcttctcctgctggtcttcacttccttctcttttgctgctgtcttaggctttttgaagtcctgtttaactttagatacctgtgcttgtgttcttttaagttgcttttcttcaatttctttttcttttcttgctcctttacctgatctgctacttctcctggaatctttttctttatgttatattttatttctgcttttatcttttgctgcccctctaaatgtctttaatttataatttctctccccttatgtgcctgatgctgctcattctgggctcttctttttgtttctgcctctacccaattcttgtgggatgatgtcccagctacatcctgctgttctttcacctgctctattcctccagaagcagaaaggcagacttaacaaatgatctgaaatcctccccttgaaaattccaatttgctttctggctccaatggcccacccacccccaggtgctctgggatggagcttattaattacactcccttcagactaccctgacttgaacagagggaaggaaagagagaaagtcgatagggaaggtgagagaaggaagaacttgggaatcttattaatggtatctttgttttctgaaatgagaattggagaaaacaaggcatacggtgcattcattgttttagaactgagaaacaagctcctattcgtcttgccaaaaattgcaaatgtgtgtgattcctctccattagctcacagcaatattggaaatgtatttgactaaactggaacacaccatcagcccaagatgcccagaggcagctcaatacagccatccatatgcttctctgagttaatttggaatacagagaattcagtttccaaactgtccccatgaacatttgtaaaatcctgcccatgtgagtggaaggtgatctgtaccaccacatgcaagctctcaataatgccggaggactgtgtcatgatagaatgcaaaggaacgacgggaggtattgagacctgcaactcttaactgctactgttttcattggtttaaacatattgctttatagaatttctgatttctcaatgctttattaaaggatcagcaggggttaggcagttgtagtgtaaattatataattgcagccaccacaaatgtatataatggccctcggtcgcttaccagccctctcaggggatacagattgaccatagttactcaactcacaggcaggaagtcccagaacatgctattacttccttctatagcatcatagtctgtgcattcttctacagattatcccaggcaatgaattgcatttaatattgctgtgggtaatatttcttcttctgtctcccttttgctagcactcctggaaatagctgaagcacagtacaaatacttacattgcaaaattatgttaagaatttcacttaacgtaaactgctccctagctcatatatcaaacatgaagtgggtagattgaacttccgtttgctgggcaacctcagtatgttacccatctacttctcccacaaccgttgccactttatctcttcccttcctggacacgatcttagttgcctagagcaccacaaactgcaaggcttaaaataacagaaatgtattctctcagtttaggaggccaaaagttgaaatcaaggtgttggcagggttgattccttgcagaggctctgagggagaattcattccttgcttctcttctagcttctgatggccgtcggcaaccctaggtgttcctggacttgtggctgtgtaactcccatctccgccttagacttcacatggccctctcctctgtctgtttcttctccttttctttctcttacaggggcacttaccactgggtctaggatccatccagagatgcatccaggatgatctatcttagcataataacatctgcaaaggccctttttccaaacacagcagcagtcacaggttccaggtgggcatattatgggagaccaccattcaacctactacaggcatcttgtgtaggcaccctgcctgcagctctcagtattctctgcatttaccgtgtgctttggatttggagttgaccagaaatatctcctcacctccactgcagcctgttctccaacctctaaatcggtgttggcagtggaaaaccactggaccagtaaaaataattgcgtttctggcctggctgtggcctcatgcagaaggcagaagagaagccagatgctctttctcatttcaggctattcagatgactgggactttcactgactcacttcatcttgtgcttttctttttatgtcttttagccaaaaatctttttttttttttttttttttttttgcccccagtgagcaaagtccactctgccctctcagtctgccaatacccatggatcatgattgctattttgcaatcctaagagactcatgtcagtctgtacagctaagagcacactgctcattcatggagagcctgctatatgtatgtaccagacactgcacatgatgtgaattgtgccttatttagtccttgtaacaaacctttagggtagatagcaatgcttcattttacaggtgaaataactgagtctcaaagaagttacctgcctcccccaaaaaatgcccaaagataacacaatggcagagtcacgattggaagcctgccctctgattctgccaccaagctgtgtccattggcatccagcttcctctgcacatcatttaatcacttgctaatttggcatatatgctctggccattttttatacctatggttttctgaccaaggttgttaataaacaccctgcatgcttgccaagcacctacctggtgcctagtctattcttctacttccagttggtgtgcatgaaggaccctatagttattttagtagagtaggtgctggtcacagtcccatgggagtgaatatgccagctagcatccctctgatgttctcttgtgattaattacctgtgactctgattattccctcactgtgaccccctcggcacttacatgctaaggttgtgcagtattcatttgttcttgtggaaatatggctctgtaattgcttctaaacaattttatttatgcatctgttgtaggcagagatctaaatctagcaatttaagccattactagatgatgtctataaggctccgagcaaattcccgggagctgggcacgtagtggggattgggcatcctagatcaacatgcatttgtgtgtatgtctgcataacaaagcaccttttaatgcaggtcagggcttttttcttgtatttattccctagttctccatcctcctaccaccacccggcaacacacatgttgcagtactgcccacagggagctaacataatggtgaccgactggtggagtcgattttcatacagattttgagaaagaagcagatatccaagccacagcacactatgggttcatttgctaccttagtaaataaaacccgtggctttaattccaagaggagttagtcttgtttcaaattatagaatacagccaatacagctatagcatgagccatgccggctcatgattgttacctcttggctgttgcccaaatctgaacattgtcttgtccccaagactttacttctggcctggttagaaaaatgttctaatctaattgtctgcctctattgcgtcgactcttctgggagataatggtccctgatgctgttccacatcctcacttttagctaactttgcataatgcacattacattatctctgtcttctcccattaaggcctgcaaaatcatgggcgattgattaaggctgagactaggctagaaatttcttttgcaatgaagctctttcaggagtaacattttttaaaaaacatattcataggacacgtagcaaaataaatgagactgcagacctccacgttctgcggaagaaatgctctgctgccactaaagctttagctattcatcaggggcaatggaattagagtcacagacgttccaatattgtaagagagaatgaatagaaacgatggctctgttgttttcttgtagtcgtttttaaaatggtctgtagaatgtgcctctgggcagaaaggaatgaatgcaaaaaagagaaaattttacacatttctgttaaacatcttaggcttctggctatagaaaataggacagcttcttttgagagaagtgtgtctagtgcattttcccatcacttactaataaaacaggacagacagactgacaggctgcctgaaaagcagcctcacagtggaaggacagcatgatcacacatttcagcctgggcacgggagccaagagactgtcatttaataagtggatgaagaaatcattttccctgtggcaaaaagggagagaaatattcagctgcatctctagacctctatcaggttaaaatgaatatgttaagagaattaagctgcacctcctttattagtgtgacagtaccctggctagttggctatattaaaatggcagacacagtgaccctgttgaactcttcatgttgataggcagtcagaaaataatggctttatagttctgcatctgctcagatctttccagatttgctaaaatttccaacgtctttgtctacttattatgacagcttgttctctcctgattggggtctttattggcatgtgagcatggcagcattatattttggcatgtctgtgtaatactgcagaaatcaccttacttcaaacttatttcggtgcctgtccttcctgccttgaaaaaggtggatagcagtataatgcttagacatcaaaccttcattttttctctccctatgaactctaaaatcattttaattgaaacaagaaggtttttgccccctgcattagcatgtggtgttttttctttgtatcaatcaccacattaagaattttaagatatcatcccattaaagctttacaataaccatgaaagctatttataatgacctattccactgataagaggacggaggcttccagaagttaatctggcataaggccacttggctgggattcgaatccagtcttttttgacttcgaaatgtttgtggttccacccactctaaggctgccttcacacagtggaacttgcctcttagtgaccctgttgaaaagaatgtaggagggtggaaagtctgaccgtgttatcttaaaattgataagttggctgaatacagaggcatagtgactgataatccaaatggcatggattgctgacctgctgctgtcatggctcaatagagccacttactatttttgactgcaccttacacctatgggagcaggtggtgtgaatgagagatgggaagaaggggtaaactttctttctaaagtaggattatatcaataacccagactcacaggtgtaacttgctgcttttcagttgtccgcaggaaaaccagtgtaagtcagttcattcctgctgtgtgatcttgaaaagtcaccttaattaccttaattacttccatattctgttggaagaaaagaaaatgaatgtaaagcacctaacgtcatgccaaacaaataggaaacactcaacaaatggtagatttagatgattctcttcttgtctgttatctattctattatccatttgttattcctagaagtgaaaataagtattacacctttgttgataattttctcccataaccagttcccctggttactcccattgcttgctgtgtttcctagcttctaaaacacatatttttttccacatttggaaaatcctggaattgcaattcattttataattggagtaaagggaagcatgccagctctccagaatggcatcacctgtgaaggtgtgctccaagccacatgttcaaggtatctcttcttctgattgtcaactcaggtgagctatttgcattggcaataccacatacatctaaattttaacgtaaattggaatcactacctattgctcagtataccacatgccctgttacaataaaaaagtattgtatacaaaaaggattgtcatgggagtgaaaatccaattaaagacagtagacataaagaattgcaaagctcgaggagattgatatatcttaaagaaccaggactcagatactcttggttttgataacatacagaataatgggtgttaacttttttattaagtttctaagatctctgccaaactaatatattcatgcctctattcaagagaaaaaaaaattcctgccagataattcttacttcttgctttaaaaataaaattctgcatacttctgtttttagcacattccctgttcctctgaggtaactttgtctctgctttgctgagatgctttctgatcccatttgtggtgtgtgcagggtatggggaatggcccctaaacatgccttccctgaattcctcatttgctactgactttcctctatcccgaaagggtagccaaggtgaaggcctcgtggttctgaggagacgacagcacccaatctgcaccaagttctactcaaaacacaggcatgctcatgtcatcagaatatcgaaatgcagaccaggatggaagagcttttgaagaaggagtgtaagatcgcatccccaacctgagtgaattcaccccctctccatgtgaagagagagagaaacttctgcacactgttaacctagatgtgaaagaggaattttcagagatgaaaaaccatttccaggttttcacagggtcaagttggtaaggtgggaatttctagtttttcaggaaaaatctagagtagtggtcacaaaaggtatgttgtcctctcgatgcctcagggtgagagggaggacaccttcatcagagctgagagagggactcccgtggggatgtgtccatggagatttctagatggcacccagagatcatctgtgattgagccggcactcgatactagcagcacaagaacccagaccagtgaaagtatgagcagaagaggccagccaagaagtgaccacaggccacacactaccacacccaccatggtccaagggcctgtgtcggactgaggagtgtcctgctctttcccaattccactttgaagccctcacacacaaaaacagacatttatccctccctgccactgccagatgacagttgcaaaattagaaatcggactcggggaagaaggcagggaggtacctgtgagaagcatgagggagccctgagatgcacattatgagctgcagtgtaaaagtataataatatattaattccagtgaaactcccaagagagactgtattaaaccaggagtgactgaaaacaaatttggttactaaatgaaataaataagctgttggttccaggcagatcgtaggccaaagtggaaagctggtatttgttatgagtaaaagtgagggcagcctcctaggtatacacccctggtgggtggagtttgtctctcactccatcagttccccattcttttttttttttttttttttttgagacagagtctcactctgtcacccgggcctggagtgcagtggtgtgatctcggcccactgcgccctctgtctcctgggttcaagtgattctcgtgcctcagcctccctagtagctgggattacaggtgtatgccacgacacccagctaatttttgtatttttagtagagacagggttttgccatgttggccaggctggtcttgaactcttgacctcaagtgatccacccgcctcggcctcccaaagtgctaggattataggcgtgagccaccgtgcccagccagttccccattctttatgataacgtacagtcatatcaaagaagaagttcaaagaagagttcctttacatttgggctgaaacctactcttggaccttcacctggtagctcattagtgttaacctaagaaccctgtttttcacctcagcaggcctgttactctggtaaacgccccaggacatgactgctctgtctgcccttccatacctctagacgctggcttggattgttcttcaccctgaattgcctggttctaactttaattccatctcaaattggatttcctctcttgcctctatacaatcttctctaccatccctcgtgctagtaaaactcttcttccagttctaactagtgttgataggcccatatggtattctgggctttgtcactgaaaatcctgaaattctttgcttcagtcatttgcagtgattcaggtttatggagcttctcatgttacacatggctactagagtggtgtacccatatggggttcaatttcctaactcccttctccctgactgctaatgcttttccttctgttcaggctgggcacttcagatctcaaacacaatttgttagtatccatctccttagctatggtagaacagtgacttctccagggatgtttctgagttcgagactaatgttccatttaccacatctcaagatcctgttcctgttttgcggaataatccctgctgcactgtttttattttgtttttttcaagttaccaggctttgtgctctttttccctgtagtttttctcccatgtttatctattgtttcctacgaatatatgctgagagtcagtgggcctagtgtgcataattcaaatgtggttcgacagcacagggacacaacagacatgattagatcattcatgtttagatcaggaaggatgggggaaaaatttgatttggggcttggggagcacagttaacgtttttccaggatagccaaggaggatttatagtaatttttaaaaattgtgtcaggccaataaagtttatgaactagatcccgtcacaaaacttagattgaaaactcatccaacaatggctaatagctggaaagaaaatggttgccctatgtttcaaaacaaaagtagagattcagttgaactgataaatatgaatgtgtttatacagacaggtgaacataagttttcagattgggggaaaatgcaaagtatacacatcccatatattcatggccagagaattctatcttgttcatcattcattcatttcataaatagtaggtataggcatatcaactacgtgccaggcactgtgataagccctggggctacagaaataggagacatggcttttggtctcttactaggaaacagaatagcttcaggctgtgtagtgcaaccatggtcttctgtgctggttgtgttaggtagggaaggtgggggtggagaggaagttcagggaaggctttctggaaataatgatagctgactgaatattgaagggtggggacagggttttaggaacaaagaacaattgatgcaggcatggaaaacaagcatggaacataccacatatggaacatgtgggtgtagaagggaggatgagtgaaacagggcaggtaggatgggcacagatcgagatggggggtttttgatgtgttaagagattcagattagttctctgatgtctctagaaggccatcattagtcttttttttttttttttttttttggtggggtgtatttcaaatactgaaaaagtcctttgggctcttggggctccccacactcatggttcctttccccacaactcactgccctcctcccaacagaaaatctatttcgaggacagtatgctttttaaatgaataactaacattgtgttctcagctaactgcagaaccagaggagctgtttgcatctgtctatgcagattgagtttctttaatctcacaccaggcctccagccacatggaaacaaggcagttatctgcaaagctgaactagatctcatctctagtggactccacttccccctctcatatttatcccacaccagcctcatggttaagaaggaccgtcaggaatgtttttatcaactccaagctctaattcatattcctccaagtctctcaccccaccctcccaaccctgcccccaagatttcattgagatttctcccaacagttatttggaaaaaaggtaaaacaaaacatgttcaaggtcttggtgcttagcccaaggggctccatgtgctgggacactgatgggcaggggcttctgcctctctaacccatgcccaagccacctcctgacccctggctgcaaaagatgggaggggcagaagccatcacaggacttgtaactgcccaatgggctcaccttacccggtgcctagacagagctgatttatcaagacaggggacttgcaacagagaaagagtaaaattctcagagccggctgtgcggagacaggagttttattattcaaatcagttttgcccaagcattccaggatcagagattttaaggataatttggcgggtggaggaaggccagtgagtcaagagtgctgattggttggctggagatgaaaccatagggaactgaagctgtcctcttgcactgagtcagtcagttccagggtgagccacaagatcacatgagccagcttatcaatctgagtggtgccagctgatccatcaagcaaactatctcaagcactgatcttagaagaagtttagggagggtgagaatcttgtagcctcaggccgcatgactcctaaaccgtaatttctcatcttgtggctaatctgttagtcctacaaaggcattccagtccctaagcaagaaggaggtttgttttgggaaagggctgctatcgtctttgttttaaactatcaactataaactacgttcttcccaaagttggttcagcctacacccagtaataaacaaagacagcttggaggttagaggcaagatggagttggttaagtcagatctctttcattgtctcagttacaattttgcaatggcgatttcagacccagaggatcagcatctcaggatctggcagagccccgggcaggatcattcagcttggccacccgctggcttgctggtgatgagtgaggattttctgggcagatcctgtgtggtggggatgtggtcaccagtcatcaggttcttgtctggttgtgcacttggcagctgcttattctcctatttggctttggccatgttgtagtctcctgaggcaaagtactttttcccttttcggagtcccttcataaggaagctgggcccccaggcctttgtcctaggcttggatatttggcctttagcttttccttctccactgtctcagggagagtacattctttctcccgcatgccctgcttcttcttgcctgtctcctccacggtgttctcgtttagtttctgggacattgtgggactgggacaatagagtataggaggtccaggaagtcaaccaactgagaggtggggaggggaaacgggacatcctgcgatgctgctttggtccctgtcaatagggttgctcctcatcagtcatcttaagcagggcgtggtctaaacgaatcttcattccagatagctgaggcagaggcagggaggctggtaggagactgccgttgtgatctaagcaggaaatgatgaaatgatggcaaggctgaatccaagcagttctccaggacagaaggacactcagaagatatgtgactgcatggagatgggggacaaggcagggcagtgctttggatatggcccagtttccaagcttgtgaaactaagtgggttatgtcccattcactgagttaagaaggaacgaatgagtgtggggtggaagagaatgaagttttttcctgaatgtgtttgtgttggggtttgttataatgagtctcagggtctggggccatcaaagaagggatgatcatgttgcttctggagcataagagagaaaaacccaggttggatatttagatcattggaggaaaaaaataaaagggcaattacaacatcttgttagttaacctctcttgccccttgcctcctggtctgcagactgaattgtaatggctcctacctcaggcagtaataggacaaactgagataacaatatgtcagctatgaagaacacacctgtgcaatgtgcaatgactgctgcttattattaatattgttattaatttgttgaaggtggaagaagcacttagactattcatgtaatttatttctaaatttaaatttaaatgacagttcctagagctacttacagagactccagagagaacccaccttctcagaggttcccctgtcatcacccaaccaagtggacaaaaagctgttagagtcaccaagctgtttttttgtttgtttgtttgtttgtttacatcattgccggttagatggcatctttaatgtcagggcagactcacacataactaaggcagtgctataaggagtagaaataataactgaaaatgtgttatcaagcagtagatgagtctcaggattctgggaacatatggttggtattggtttgactttagagaaggtcacagaaaaaaagttttgtggactccccggtgataactgggggcctgggggagagaggcagtgaacatcatctggcccagaagggaatgttctgggtcacaggcagttcctgaggatacttggggatgtcactttgttcatgctgttctaaaagtcaaggtggatgttgggctgaacttttaggctgcattcacgtgattggggtagaacattttaacacattgccgtttgctctcattgagtcatgtgcatttgttcattcttagtctcttctctctatttcaaattatttcttcccacctgtttggaacaacatcagcattgcatattggcctcaaatgagttaagattcctaagttcctaactagccatagcacaaggtttttcagcttgactggtctcaaggcttttctcagaatccatcgattcttccagaaaactttgctcaggacatgcagattgcaataatttgttttccccaaaatgtattaagaattatttatttaaaaatataaaaacttcctctaaacagtttgagaatctcattgctgaaaatatataaaatgggtacacaattaatttctctccagatgtgatactataactagtaacttatttaaagttgaaagagaataatttgcatctggaggaaggtgttgtaaatgcaagttctggtcctttcatgttcctgatgtctttggaatttgtctttgtctttagagtagtgctgttttggactcagctccaatacagatgacttccacgctccccttggactgattaagtgaaaatgagagaatgaaataatattatccaggagattcacataccccaccaagccacgcagaatgtacttttaatacataggggtagtttagacacctcaagtctgtatggatacctcagggtttaattgggttttgtggtgatgccccaagagcttcatgccatttttagatatatttgttcaaaaacagatcaataattgatttagatgtgggaggtaaagatagatgcgcactaactgtggatgggctctgcagtgagaaggcagtgctggggctgctaatggtggctcaggtggatgcacactgaaggggaaggaccaggggatggggcgaggcattgctgtcattcgtcttgaacggaacagttgtttcattctgaaagtgcttgagaatatactctttggtgctttgagtttggctaatggttcatagtctcattgttctgatgaaatgacttcaaactcattgttgtcattattgagaaacaagttctctccaaataagtttgaggagacattctccaaggaaacaatctcttaaatgtgagatatttgtgaactttttccataaaatacagcagtgcccccttatttgtggtttttcttttcacagtttcagttgcctgaagtcaacttgagtccaaaaaatggcattactactcttgcactttggagccatggtgaggtaaaatacgggtgacttgaacacaagcaccatgataccatggcagtggctctgataaccaagacagctcctgaatgactaacagggctggtagcgtctacagtgtggatacactggacacagggacgattcacatctcggggagcaggatggcatgagatttcatcacactactcagaacagtgtgcaatttaaagcttatgacatgtttatttctgcagtttcccatttatttcacaaggcctacgtcatccacctcacttcatctcctcacgttggcacatcacaggaaaaagggtgagcacagtacaataaggtattttgagagagagagaccacattcacataacttttcttacggtgtattgttataattgttctattttattattaattgttgttaatctcttactgtgcctaatttatataaattaaactttatcttaggtatgtatgtatgggaataagcatggtgtatgaagagttcagtactatccttagtttcagatatccactggggatcttggaacatatccttcacagataaaggaactactgtagtgatatcaatgcgttaattctggaaaaatattacatttcagtcttggtgtcaaattctagcaaagaataatttttaggactatgagtaaaccaaggaccaacaatgaagtagattccatgtcactaggaatagaagttttggggatgtgtgttcatgttttcatatgacttgcacctgtctggaaacaaaactgtttctaattatttttaaataactagagttcaatctaatgtaaactatatacaaaagccagatagcaatcactaactttgttacatcataggcatagataattttaatgaaacatatccaccaagtatgtccaatttctctgatgacagtgctaacttacatgcgcatcaaacatttgataaatgaatatgttaatgactgtaatgtcttttctgggaatgcctttgttggggctcaacacattgttaaggagaagaaagcagatgactgagaggaggtttgtaaagtggggatggggagagtagctggaagccatgaacaaattcattctcagaggcacagatccccctacatgagctaggacctatgctaggagctagattcacagatatggggacgctatgggctttgccattcccaagcttcttgtccagtaaaaccacaactcagaaatcttgcttaactaagtttagcaagttatctgcctatctatctatctatctatctatctatctatctatctatcgatgtgtctatgtatctatgtatctatcatctatctgcctatctatctatgtgtctatctatcatctatctactgtctatctctagataaatatatagatatatacacataatgcatagtattcaatagtactatgtgaaaattatgttaaaggagatgtattagtcagggttctctagagggacaaaactaatggatacatatctatatatgaaggggagattattaaggataattgactcactcgatcacaaagtgaagtcccacaataggcggtctggaagctgaggaacaaggaagccaggagtggatcagtctgagtctcaaaacctcaaaagtagggaagccaacagtgcagccttcagtctatggccaaaggctcgagagcccctggcaaaccactggtataagtccaagggtccaacagccaaagaacttggagtctgatgtttgagggcaggaagcatgcagcagaggagaaaggtgagtgccagaagactcagcaagcctgctcattccactttctgcctgccttttctagccatgctggcaggcaattggatggtgcccacccacattgaaggtgggtcttcccctcccagtccactgactcaaatgttaaactcctctagcaacaccctcacagacacacccagaaataatactttgcatcctttaatccaatcaagttgacacttaatattaaccatcacaggagataaatccctggacttcaagagaacctattgtcaccaatcattttaggcatcatttcatatggtgagtagaactgtgctatatattatattatgtgcagaccggggttagaaagctatggcccacagactgaattaggcccactgactgtttttataagtaaagttttattgaaacacagccatgcccatttttaaaatataatgtctccagccgctttctgacaaatagtggcaaacaatgacagagttgagttgttacggtggaaacaacattctccaaagcctacaacattttctctctggccctttacagaaaaagtttgctgatttctggtataggacaatattatataatatgctttcattttaaacattgggcaccactggttaagtcttattttcttccaaacataacaactatatgaaatctaaccctacagagcccaggagcctacacaccactatttagttcttacacctcattgatataagtaatttttaatatcttgttattatttctagaagtctttttggtatggttctttccatatctagcagtttgtgatttttttactttaactgcaatatgtagcagtttgtgagggataaaataaaacccccttttccttctgtttaaatatatggaatgtcagcaaaagcctcctgttagcagtagctgaatctaagaaatgaaccttttatacattggcttacactattttgtccaaagccaaaaatggataatgaaggaggaaaatgacaaacgttctttcctaaagagaagcatccaagtgtagagaagaccacaagtgactataaaacgaggaagccccgtagctaagggattcacaggtaagcccaggacatgtggactgtggaaggccattaatgtgacatgctctgtggtattcagataccttgctgcatgctgggttcggctctagggaattaagaaaagaggaagatggatatggaaaggtcaatggcaatgggtaaagacatggaaaactatttctataaccgtaaaggagactgagttaatttatcttgaaaaataaaaaaggtaagaaatggcttgccgtaatttttctaccatttatatccattatgatacaaaaagtaaacacttgctggttgattgattaaaacatatgtaagatagagagtggcttagtaaaaggtattttagttgcaaagacagaaatacaagaactagtaagtctaacaatgtatctttatgactcttgaactccaacaaagactttaacagcaaggagttagaaaacttaggctgcacatgggtcttgggaatgattggaacaacgttcctagattctgtctggattctctttccagcaatacatgcaaactttcttctctctcctttcagtctgcccctctccttaccgctttgagcatggcagatgatagcttttgaaatttgtatcagttatccttggccacaaaaaaaaaaaaaaaaaaaaaaaaagacatatctcaaactctttttatgatcccagggaacagaaaatcctggggaaaagatgcccaacttgggtcaggcatctgctcttgggcgagtcaccttagtccagtgagtgaggccgtgtggtgatagtgataatatgctgcacctgcattaaccatacagatgaaggaaggaaaacttaatagccaagggaaaactggcagaaatttctaagtgaacactgcattatttctttttggaagaaatcttcactggaaaaaatccagaagaaatagctcagtctgcaacatgaaggatttaggttagaaaaaaatgagattattctgacattagagcttattacacactgggatatgttactgaaagaagcagtaaaatgtcttttcttagaggtttttaaaaatagaattcatttctcatcagttgagatgcaaatagttttcaaaatggattagacacacagaaattttgtttgacgtgcaaactcttgacaaggtcctgcctctttttgccagtaaattcagctcattctagccttttggtacaattcaacaaatatttattaaatgtccactaggtgcaaagcattaggctagagctaaaaggtttatattatgttatggagatttagaaaactgcaaatggggtgggcacgctggctcatgcctgtaatgccagcactttgggatgctgaggtgggcagatcacttgaggtcaggagtttgagaccagcttggccaatatggtgaaaccctgtttctactaaaaatacaaaaattagccaggcatggtggtgcatgcctgtagtcccagctactcaggaggctgaggcaggagaatctcttgaacccaggagatggaggttgcagtgagctgagattgtgccactgcactccagcctgggcaacagaacaagactccataccccacccccccaaaaaaaaattgcaaatgactgtaatatgtggatagttgaggccattgtcacaaaggagatttagatttattgctgtggaattctaaagcatgagagagagtcatgaaagagagaagaagagagagagatgctaacagagaaacaaggaaacacagaattagcaaagtgttagttgatagactgagatttgaaatgctctttggggtaaataggatttcagtaggtagagatgtgtgaaaaggcatttgggacagttacaagtttgtgaacagtgatttggatcatgttcagggaagcagagagtcattcttttaaatggaaacctatggtaccagcagggaagagataacagaaaagattaccaaaaaaaaaaaaaaaaaaaactgggaccatcctctagaaggccttaaatatgctgagtattaagttttgtttgttttgttttaggaagattagtatggtaatgtgaccacccaacaagttcttcctgccccactgcacaaataaagaccacggcattgcggtaaagaaagagtttaattgacgtgaggctggccatgccatacaggagaccaagttactactcatatcaatctcctggaagacttgtaggttaggggtttttcaaaggcagtttggggaagggggtgggtgtggctaaaatggatgcttgctgctgattggctggggcagagatgaaatcatagtgggttgaagctgtcctcttgagctgacttacttctgggtggggcaacagaagcaagagcaaggttggtgggggccaggtggagtcatgggtatcagacctgcaaaaaacctgggaaaatgtctcaaaaggccagtctacaatagtgatgttatctgtaggacagatcttgtgaccagtctatgccttagcagaattcctgcccttctcctagcctgatggcctttcattagctttacaaaggtgattgaattttggggaaagcctattatcatgtaaactataaactaaagttagcttagcctaagaccaggaatgattaagggaaaggcaagatggggggttaaatcagacttgcactgccgtaattttctcactgttataattcttgcaaagtcagttttagtacctctgtgagacatgtcatgccaaggaaagagcagaagttgggaagaagaatttgaaggtcattgcagaaacttatcctgagtcatttaactaggtggtggtagcagaaatggaaagaagaaactatatgggagggagatggtagggaaataacctacagggctgatggattaatgggttttatgtattgtgtactttcaaaacactaagcattaatcaaaaaatagaattctttaatttcctaattccttaaatactagacctttatttacatatacatttaagcctcatatcaaccaaataaataggtcagcctttatccccattttcatataagcaaacagatttagagctcttgaataattagctgaggccatattgctagcaatctgctaagtgggactctgaacccaggatgtctggctctattgctcatgttcttaactacacgcagctcttctctaattgaagtatagagggaaaaggatgagtgtgagaaaacaaggaagtttcaaccctggtggattgagaggtgttccagttatgcattggtacataatagactacccaagacctagtggcttaatacaacaaccattttgttgcagtccgtgattttgtctattagaaacttggacaggcttggctggagaagtctattatacaagacatggacaaaggacactcagtgccattcagctggcagatgggctagtctagaaggagcaagatagcttcattcccaggtctggcaccttggtggggatgactgaaagtctgggttcagctggaatgaaaaccagagccctgcatgtggcatcttcagcaactgggtctcaggcagtcagtggattatttttgcctgttttgggactttatgtaaatgaaatcatatggtgtgtattggtttctttgactcaatattatggttgtgaaagtcatccatgttgttacatgcagttgtacttcattttcattgcagtattctatcacattatgtaaatatactacattttaattattcattctactactaatggacatttgggtcattcccagtttgagctttaatgaatagggctggtatgaatactcttgtattcatactcttgtatattgggtgaaatatattcgcatttctgtggagttatattcctagcagtagaattgctgagttgcaggatatgcttctgttagctttaactattttctatactgtttttacaaatttgcactcttgccagcagtgtatgagaatttcagttgttccacatccactgttaatatcagaccttgttaattttagccattttagcttttctgacgcgactgttttgatgtagattgaccccaaatcagagtgagggcgtctctctcccactgcatcattctctgcttaactaactctctatgccttcccaagagattatgaaagacgcctgtctgattcttccatttaagtattttcttatcttatagaaatacgtgggatatttctcttaaaattctactgaagctttgaaagaaatggttcaaatggaccttacattcaaataacctctcctgatatttaatcagtgctctttccacatctttcagccaaataacattcacttgcctttgctgtatatgttcttatgtagaaataatagtctcaacatccatcacagtgcattacatgtgggaaatatacttccaggtgaaaacttgttgaattttggatattttgaggattttcagatttagttcaacctcatccaatatgtttcctttctaagtaacagacttaagagtaaatttgggctcagctgccaggaagtgaaagagaaaatgatctgtacatgcagatatggatgtagcagaagatgttttcctaaatcgcaaaatcaaaagaacgatgtctacacaggactcagaggaatgaatgctttgaagtaatttagcaatgtgggaatggtcaaacattttcttctgtaaaatctcctgctctctgccctttcattttttttccgttctcattctttttcttcccaggtctgtgataaggctagataacataaggaagtcacttggcaccgtgtccagcccatagtgcttccggtcctgcttttgatgatgacgatagaggagatagtagtatctccttctttaagatattttcaagtatgaaagtaactgagttagtgtatatgaagtatcttctagaaagtttgacatatagtgatcttcagagcagatgcagaggaagccagacaagagggataaataaagcaggcaagatgatatcgcaagagataagacaaaacttctgtgctctctgcatttgcctttccaagaagctggtagtttaactttccttgggctttctgcaaaaatgttgtgcatctgaacttgagcaattttgagtgtttctcttccttgcaaacaaatgagccttgacttgagcagtccctttagtaggcatgtcatacattatagtagtttttgtgaccctctcatctctccaactggattataaaatcctcaagggcagagatgtctctaatatgtctttgtattctgcctcgtacttagcacaggacgggagaaatgtcatgttatcctgctgattaagtccattaaggattcaggttgcataactctcctaatggggaatggagaataaattctgcaagtgagtttaatgttcacgaaaatcatcaacagcaaatgtagatgcatgccctttggccgtgcacaaaatgcaagggagagggtggtcttttcctaactctttgtgaattaccctcgctaagttctcacctcaggggcagaatgcaatttgttttttctcttatagattttttctcagccttggtgtgaagcctccaactgagttggaagatccaaactgggacagggaatttaaagaggggaccacaaaatcgattccaacagaactttaagtttaccccaggttagcttcatctgttgcacacagaggcatctgcttaacagatcattgtagatatgattgcaaattccacataaagggaatatttataggaaggtctgcctttctgaatacgtaactaaaaattagtttgttttgtaaaactgtactttaggccaaactctgattcactgtattaagagtcccaaactaaccaaatgagagggacatactagcaaagacatcttcatccacatgcgggagggaagagggatactgccaagttcttgcagaaggacagcacggtctctttcagctccttaaatatgttctgatgaggcacttcagtaaaacatgcccatctgcgtgttccactggactaatgaatatgaagtgtatgttcagctattgatctgaattaagtcctaggaccagaatttagtgtcattaatgatctctttaatgaacgcaggcagaaaccattatcaaatgatgattttttttttcatcttggaaagattattttaaatccaaacacattctttcaactctgttttaaccccccagagatatattttaaaagccattgtgagaaagtaaatgagaacattgtccaaagcctgggagtgaagcatttggtaggaactggaggtggggagaaggaatgttaaattcctctttcttgaaccattacagtactttttccttatttggtgcatgtctggagggacagggcttgggcaggggaatgccccttctactctgctgacaaaaagcaccaagagtggctggaaaaggctgtagagcactggtttccagattttgttgcaccttggaaccacttggagagctttaaaaaacactgatgtccagctcttacctgcagacattttgatttcactggtctagagggtgatctggacatggggattttgaaaacagtcagctgggcatggtggctcacgcctgtaatcccagcactttgggaggctgaggcaggtggattgcctgaagtcaggagttcgagaccagcctggccaacatagtgaaaccccgtctctactaaaaatacaaaaagttagctgggtgtagtgacgggtgcctgtaatcctagctactagggaggccgaggcaggagaatcacttgagcctgggaggtggaggttgcactgagctgagatcgtgccattgcactccagcctgggcaacaaaatgaaatttgagcttgagcgagtttgagcgaaactcttactcaaaaaaaaaataaataaataaaaataaaaataaagaataaaaataaaataaataaaaagagtcttggcttattctgaagacagtcttttaaagtggccaaatgaaaaataaatgactgtgtcaattcagtttattgtaaacatttactgagcacatactctgtataaagccatatgctatgctttagtaatgcaaacaaaatgtaaaatatatacctacccctgaggagctcacaagtttagcggcgaggggggccagttacatggacagataaatgcaatgaaattacaactcagttaaatacaaaacattgtgatatatacaaaatcaaaaattgtcccaaagtagtgcaaagtacagaaaaagagacaggaccaggaaataccttacagtgtaatttccagatataaaataacaaatgatcagtatttctgaaactttgagggccagaggaagaatgggttgtagcaaagaactctatcataagggattttctatgttgtaataacatgaggtttcataggaataaccagcatcttagaatggggtctgtcttagtaatagtctaatgtaaaacaacacgattatttatttatcttgcctgcctactttccgttctccttccttccctcctcccctgctgtcctcctttcctccctccttccctcctctccttcttccctctctcttttcctccttccttttctactctcttcctcccttccatccttctttcgttcccttctttctcccttcctccccttctttcttccttcctcccctccttccctctttccttccttctatctgttcatctccccatgttatacctacctacctacttcctacagaggcacctacaactttgcctttcattgtttaactgagttatagattgtgaagactagagtgacttaaccacccaccctcctttcaactgtgtggtttattacacatatgtatctcattgatgttttttgtggacattgcacttgtgtaatttattcttttctcatttgggtaaatatgaatgcattgaaataaagaggactagttttttttttatttcaaaattatatttaaaaggaaaaaataatgagacaacagcaagagtcactatttaactcaatttgctgtattcttaaaactggaccttacagtaagcactataagtaagaaaacagctactttccaatggagatataaataacaatgccagatgagctgttgctcttaaatcttacagtgggacttcattagtgtgacaagtgagaagtaacaaatttattcccagaaccagaaaatgccattcaggataagtgttttgattaattcatttttagagaggtagggctgttttaatcatgacaactcttatttgccataatagaagcatccgtgaattttttttttttctgaacacttcatgtgtatttaccattccactgtcatgatctggttattactaggactgggttgctattaataatcaacacattattttaaaattgaacaagctaatatcaccagcctgtaattttctgggtttacacattgaatctattaccataattaagttaatagtattttaaatgaatgtttattttttatggctttgtgtagcaaactacaattagatgtttgtctgcatacacatgttttaggagtgttcactctgtaaatggttttgtatgaatctattgtaagaaaaagttcaacctcttttgcatctccgatgagttagaattaagtgatactgctcctgtcaattcatttttttaaactcaaaagtttcactttatctgtttatgcctctttagtttgtctgtataccatgaacacatatccttcatctttccccaccttagtatccactaggttttttcctctctggttgcctatcattagtcaattgtttttcatgctaatcaaagagcagagaaaacaaacgatgagcatacaggtaaaatgacattcatgggtttcttagttctttggacactcagagaagagaataaaatagcagtttgaatcatttgtggttctgctgtatctgtaatccacccatttgacataatgtattattggagtggctaattggaagttcatagggtgtgtttccatatgcttattataaagaacagatgtaagagtcaatttcctgtttgaatggtgatttgagcactgagcaatttatttaatcagaaatgtctttattattcataaaactgttccagtctgatcccatgtgtttgtttcaattctgaatgtgactctctacccagggctgataaactctgttgttcacattaggatgttaaacagaaaaggtcacgcatctgatcccatgtggcctaattagtgtcaaacaaagaaaatgtctgtaaattgttataggctgcagtaccagaaacccacgttacttaccttatggggattaaaattgccacaaactctgtgccagaccatccccatggctgtggcaatggtactaaagccacattccattggtggtagagatggcagccaggagtaatgtgtcggatattgtcagttatcgctcagcatccattttcacctttttcaatgtgtcgtactgtgccacaggggcttgagggttaaaaatcaactttcctgactcctttgcagctagggttctagatgtaaatgatgttctgacaattagatgcacttgaatgagatttgaataaagttaaggcaaaggccatcttcttgctgctatttttgttggtgaagatggctgcagaaatgagtattttcaggtgtctgtggctgtcagacttggccttgtaagtgtctagaagcagttgtggcagcaacagcaatgccttcctgacctctgcttgcagcagctatagttttatgtccctgtactaatttgttcagagtgaggctcctgactcctgatctaccatgctgtctaggaattttgcagccagctaagctactgcattcaatcccattctacatgaaataccaggtttctgtttcctgcagtcaactttgactgatatgaaaatagtcataaccacataaatgaagagttatagtttactgagtatctattaaatgccagacaaattgaggatcagtgagataacttgtacaagttcataaagctaacgaatggcaaaaccagtgtttgagtttcggtccatctgtttgcaaagctagtacacaaagggcagaaactgtaatatgtccatttctattttcaatttttaaaaagaatgaaatcatgtcctctgcagcaacatggatgcagtcagaagccattattctaggcaaattagaacaggaatagaaagccaaatactgtatgttctctcctataagtgggagctaaacattgggtactcttggacataaagatgcaacaatagacattgaggctactagagggtgggtggagggagggaggggagcgagggttaaaaaactattgggtactgtgctcacaattgatgggaccactcataccctaagcctcagcatcctgcaatatacacatgtaacaaacctgtgcctgtgcctcctgattctaaaatagaagttgaaattattttttaaaaccccacattttagaaatccccaagggcagctgggcacggtggctcacacctgtaatcccagcgctttgggaggccgaggcaggcggatcacctgaagtcaggagtttgagaccagcctggccaacatggcaaaaccccatctcttctaaaaatacaaaaattagctgggcgtggtggtgcatgcttgtaatcccagctggtcagcaggctgaggcaggagaactgttcgagcccaaaaggcggaggttgcagtgagctgagattgtgccactgcactccatccagcctgggcgacagagcgaggctccctctcaaaagaaaaaaaaaaaaaaaagaaagaaaagaaaagaaaaaagaaaaggaaaaagaggaaaaaaaaaagaaatcccctagggctagggatatttggaaatccccaagggtttgtggttttctaaatttctattcaacattttagaaatccctaagggaaggagacttttgtatcctcaagtgcttgaggtctataacatcactgacaaaagaacacattctagaagaaccagatagaatatgtgcacccttgagactggaatagctgcatcattgaagcaagtccatatcagcttccacctccatggtaatacttgggatgcatagatgtagaatctagtctcagaagacaatgtgattctttagcccattcaatttgttcatccattattttttgtatgcatcatctcaaccctatagggggcagttaatgggttcggtttcatgtttcagatccccttgaccttgtttgtatgtatatcacagtgtttatatagtcagatctttcagggactgaagcaagccccgaaaagacaaagtgcatcattagctgggtttttcaggatttcgtggccagtgtaaaacaaaagtgggagagtgatagggcagaaagtgctctattatttctgttgtcaacaaagactcagttacctggactgagagcactgcccttcccagcctgcaggaagactcaacgccggggtcctatgatgcacaagtgagagaagggggatgttttgcctgagaaggtatgactctgggggccaagcaggaggggatgagctgtcacatgggagagatgcaggctaagaactaaaactaatgaatggaagttacagagaggtaagaaatttttttccaagaactgcctgggacaaacacagctactccaggaagccacttcactgctgaaggtgttttgtgcaaaggtgtgctggcagttaaagaggaatgctgcagataagattcagctccataaaagagtgtgaagatgtctctcatccctgaagtttataggatgctccccacaaagaactgcagatttcctttctaactcattgactggagctcagggacaccatgggttgaagctatggctctggagggaactagcctagacttacatcctggtcctgatatttacttgctgtattaattctgcacttcagtttctccgtctgtaaaacaggggaaagaacagtgtctctctcataggggtaagtgtgaaatcaaatcattcaacccatgtaaagtgaattgagcttcttattcctattggctatgtggtgattgacatcggagctcccaaacagttcaatgggagaaggttgcaaatgaattctgcactcagatgctcactcaaatgtcttgagaactaggagaacccaggggaccctgtgacaaattttcaacaccatttggtccagccaaagggttgtttcagactggctttctcagtgcttgagagagaatctaaatatttctcaaggcatgcattacaaaatgttcaagtagctgctctatttttgagaacatgcacataagacaggcccacaacattgggggatgttcgagaaaagaagggagaccgtgagcccaggtccaattagggatcagcaccttctgtgtccccgatctttacatggataatgaaggactggggagccgcggttgtgggctgataccatggcaacccctcttccatgattgtcacatacagatgagtgagtttttaatctcaacatcagtcctgaatctcattcattatttttaagccctaaaccagaaaataaatattgcttgtctttctgcctttgcctaataagtaactaaagtttacataaagacttggcttactttggttgtttctctgttgggtgtgtgatgtccaaatttaattaaaggccatgctgtcggctataaactcctttagtgagagaaaatgacaggaaggcccagaatttttttttacgaggcttgtgttgattgagttaaagcatgtgttctaactgagctcccttggaatgagccgtgcattgttccatgccacctggctgcaaaacaaacacaaggaatttggctctgacatgaagaaaccctcagtattagggaaatggagctgcattccacatggaagcatggcaacctcgggctctgttcctccccctttgccctctcaccagacccctgtgcatctctgttctttccaggagagggagaaataaaaaatatctcaatagaaatggaaaccagtgttgggtttttttgttttgttttgtttttctagcagggtacaccactcactcaaccataccaaatataagtgtgcgaggcttggaatgaagaaagaaatggttactttttaaaagctagcaatattaacaggtgaatgtcataggccatgagtctgaatgtgtcagaaaagaactgcaagtcattagacaagaccaatagtcctcctggagggaggcagtgaacctcaggactgtgggcactggcctgcctttgtcttgggtattgacttgctgagtggcctctaggaacttaattaagttcctggattcctcttttgacaaatccagattacaaacaataaccaccatggccagtgctcttgaattcatatgatagtagagcattataaaatcagaattctacttaagagctgataattatgtaggagagaagagcatgctgactggggcaaaggggccaggtggttaacttttcacggttcaagagttgataaaaagcatatgaattacaggccagtgagaaggacatttttatgattatttggaaatttttgactccatccggaacagagttgaaatattcaggtccgcagggtgtgagtagacagttggcttatgatctcagcagtcaggatgtgtcatttctgtttcctaaaaggctcccgataaatgctttctggaaggtgccagtgaaagacatttggaatttaacagagacagcaacagcaggttcggggcttatctcgggctgcattgtagatcaatcctgggcacagtggaaggaacactgttacaaaagagccatttctaagaaggcttcacttcaaaggagatcacccacagcagaggagctgatgcagagctgaataaataatgaaaaatacaataaagatcaaatctgatagggatttgaattatatgccaggaaaatatttttgatgaaaatgaaatggtagggagggttagagacagattgaagaattcataatcagaactgctcacgacctgcatcgcttagtcctgtacaattttgaggctccatgagaaggcagttagtgaaaaatatatcagtcttttctctgaaattcgaggtcatccttatcttgagactgcccgggagttcctactccctactctcctcagcccccactgtagtgcaggaaaactctggccctgatggagccatttgcaaagatgttacggaagaagctgctgtggccacccctgcagagccaggcacagatctaggacttcaaggcagatagttcctgttcatagtagaccagccagagccagcttttgggtatctctccagccctgaagtatctctccatcaccaatgatgggtatctctccatcagcagtgatccccaagaggtgatgtccttcctggccttcagccatgtttgttcagtgggacctcaagcctctttcctaccactgatgggtttgggatatagaccatgagaaaagagagtggggggaaagagaaaaggaaagaaacaaagagaagaagagaaggaggaaggggagaggaaagagagaggagagagatgtaggagaaaggagagaaaaaggacagggagagaaggagagaaagagagagaggcagaaaaggagagagaggggatgagagaaagaaggagaaagaaagagggggtgagagagaaggagagagaaaggggatgatagagagaaggagagagaaaaggggtgagagaagaagagagaaagggggcgtgagagaaggtgagagaaaaaaggagataaaaggatagagggagagagaaaaggggatagagagggagaaatgataaaagagagaaaaagagatgtgaggaagggagagagaaaaacaggaaaagagaaaaagatggtgagggagaacacatgctagaataaggcagatacagatgaaatgagaaatagtgaaagagtgagacagtgagggggaaataaaggaaaaggagagaggatagagagagaagtggatagcgagagagagagagatggtgatggagactgagacaaagacggtgagacccaggtacagacgcagagtgacaagagttgggaagaggccagagggggccaaacgtgatgcttgggtggcctctctgctcttgagaggatattggcagtgtctccagccctgtgcacatgtcccactgccatagcaaatccagaggctccgctctgctgtggttctatctgccgttacacaaactatgaggcagccctgcccatgcagagaacatagtcatgtggcctttcttgttttatcatcccttcactctttcttacaggctctcccccatcctcagcttctgtttgaaggacctgcaaattattcttgaaggacagatgtgatgctgtgctgggaactgctcttctcctcaaactctggcctgtttccttttcatgaagcctgggagcctctattctccctttttatgatggttctttttcaggaggtttctgagtcccaccagcaaacagacccgggtgggctatcctgccaggctgacagtgagacagagatggacccacaagggcccctgctgcctcgtctgccatcccacagcttacccgccagctgggcttattggaagctttcctttaaatttcactgtctcacattccagaccttcctcatttccttgggccagtgggctcaatgccctggtagctgggctgtctccctcttacatatgcacattattttacaaagaagcaatctagccagagcaggtatattgaaaatagagtttattggagttgctgattgtggatgcttgcagagggctctttcttatttttctaaaagttgcattgcttcagttgcgaatcaaggtcccttgatcaccatgcctcctcttgcctcatgctcagtttttcttattcttttcttctctttcatccaactgctttctccagacttcaactcttatatctaagcactttgggcctttggtgctgttttgaggcagactaactagagtagaattcactggcattaaaacagtagatccagcaaagtctggtggaaataaatagtgtagattagtggaaggaatatgaggaattggtaaaagattcatgcctctatggaggacatgctttgctgaatttctggagaatccgtggtcttctctagaattgtgtgtctttcatcatcacccagagagacaagcttttttgctcttcatggaatctggtatataatgcaacagagctccattattagtggagaagatgtacagacaaaaataaaaacaggggcagcgtgcattttggtagggtcttctatttcatcctaacacacaagcgtcttacacctctttgccttttcccaaaaggcatatatgttttagaggcaattccagtgagtaaattattcatctgaagacaaggaagatatagaatagttagagttttattataatttttttatactgcaagggagatttttctttgtctcctaaccaaaaatagcccagctattgccaaatgaaaatttcttccacatatccttctcttgccaaaacccttaataaaattttgtttaaaaaatcagtgtgaaccatgaaacagtaaaactcattctaatgtatgaaaacatgtatatactgcaaagtcttcttcttttccaagtggcctgaaggtggctttgctgcaaacagtgccttttgggcataagaagccctaagaatccagagacagttgagaaaacctattttctttcctgtctactcagtatttggggaagacaaaaaatgagaacataaagaaaggcaagctccccaagcttacaaaagattccatctctggtgatcctgtgagccacaaaataatagaagttttgaaatcagtgtagctcatttctagacaatggaggggattgtggcaatagttcagcatctgtcctcggttatttctgaaaggatagatagtatcgtagaaaaacaatccatacaggaacgcttgaacaaacaattacaagcatcataaagcaagcaggtctggaatcgatcccagcaaccatttcccattctcactcttctttaactttgcctgttaggtggttttcgaattcaaccttctgtgagtgtttttaatggtacactatcaattaccccaggtaaggaatgtctatgcccggttctctctcaataaagcaaaatatcacatcattaagtagttttcctctctgatttgtggttagagtaacctaaagagggagggaagtagggaactgtgtacctgtcatgaacacacacacacacacacacacacacacacacacacacacacacgtgtgcatgcaagaaaaacaaacaaaaataatacataaataaaaataatcttttctttgctagaacatttctccctggagtaactgctgaggagaatctctatcctgtcttctgtgtgtgtttgtgtgtgtgtatgtgtgtgtgtatgtgtgcacactctgctctgccttcacgttcctctctgagcacactgtacgtctcctgccacatgcatacacacgggacattctgtctggactcatgggacaagattacttgcatgccaactcactgcctcaggagacttcctgtttatattcaaccacgcatgggcccttataaagtcataattcttgccaccaattgaacatcttgttggaatatttatccactttgctttagctggaaaacaagtttttccatattgcaagaaataagtgcagtaacttgatggtgtttaattgcactaattttggatttgggggtgacctggattatacagatcctacttccatgatgtatatttatgggtacctcttccaccagctgttcaacgttctctacaacctgacctgcttacatgttaatctcaccttctaccctcaaccttgttccccatgctgtagcctggaaggcttatttggataccatactaatcatcttcccacttcagcatcctccaacttaccctcttcgtcacctggactgttcttccttcaaaatctgtatctgactcatttcttatcattctgatgtcattgaaatgtcatttccttaaagagactttctttgaccactataatgtcctctccttcattctactttcaacagcataaccccatttaattttcttctatcagatttcagtctctgtcagattgacttatgtcattgcacgtttgtcatcagtctcttttatggaatatggtttgtttgtggtctgagccttatagtcttattcacctgtgtgttctcaatgccaaggagaaggtttgaaacagagtagatatgataaatatttaatgaatgaatgaatttataaatacacaaaaccaaatcgtgtgctaaccactttatcaagctaaacttgataaatcactacaaaaatcttattggggaggtaccattattatatttgccttgttagaacttaggtttggctgcatgtgacagaaaatctcaaagtagaggcttaaaattagatggacatttatgtttcattcatataaaagcattttgggtgttccagatgtcatctgctctaccatcctcacggtcttaagatggccactaggggtccagccatcacttctgtttctagacaagaggatggaggtgggaataaaaaaggataatgcctctctccctttaagttccatgatagtcctcgcaatgtgtctcattggccattatttagacatataccatacctacttataagctggaaaacataactcagggcaggaatgtgcttacccaaaacaaaaacaagatcttgttcctaagaaggaaaggaaccagccctctacactgcatccccattgactctcacagagagaaagtgactctggcaaagtcacacagctaatatagcatacagtgctgagatagaaaccctaacatcgttacatccccaccacctccagcatctaaacctcccccacttacccagtaatatagtacacagagaatcatccctctctgcagggatctttggtagactgtggagccaaggttgaagcttctttcttcatagtccccaaatccagggagaatcctagtaattgtcagatgggcctgcatagagtctgcattcacccttcccctcctcagcctcactcagcaacctctttccttctgttttcttacataaattctcttttgtcttaacagtactaatgacaataatacttctttctatcgagaatttacttctattcactatgcactctatggttttatttttataagaattagtttatacagttctcacaagcagctaaatgaggttaagtaattatttaactcatttgaaagatgggtgatctatcagacctaaagaggttaagtaattttttatttttttgacatgaagtttcactcatgttgcctaggctggagtacaatggcacggtctcggctcagtgcaacctccgcctcccaggctcaagtgattctcttgcctcagcctcccaagtagctgggattacagttgcccaccactatgcctggctaatttttgtatttttagtagagacggagtttcaccatgttggtgaggctggtctcgaacccctgacctaggtgatccacctgcctcagcctcccaaagtgttgggattacaggcgtgagctaccacgcccagcctaagtaatttttttcaagtaaatccagaatttgactccaaagttcaccttacaagccttctccaattcaaacaccaccttgcctttaatgtcttcatcaccatgtttaaagcacattctcgtgactcaaaataaatgattgtctctgagctgaaggggaatgatgtcttattttacctgaaccacagatcagttgctgcaccggaatggtggacagttgcctcctcctagcgtgaaattacagtcaatgacccagaggcaagagggtccccatatcatcacagagccctgagactctcaatctctgtagggatgaatgtggaatttttctgttgcttctgtgtttccgtaactgtttacatactgtgtcatgttaatgcattctgccataccatttttctccaattatctgagcttttgcaggaactctgaggtagtgagacatacattgaagatgttccaaagaaatgaatggaggagttttctctgcaaatcctttttctctgaaaaactcggaaaagctcactgcctcatcttgcatgtgagcactccactctgaattctgaaaagcagcaaaagagaaaacagaatctggcagaggagagatgaatattacagaaattgtattttaaaagatattgttatcggggtaaaataggtgggaagaaacctcatgagttccctaagaaaatatctttcaaaagttaaaaagatactcttacttatagtaagtaagctggaaccaatacagcaaggctgtgtaaatatataatatgtggtattaaggacaggctgaatgcatggctaggcctttatttttaagaaatgtgtatttaatgcattgcacttgctccttcagctttgttacactctgttggattaagaggtaacttagcaggcaagctaatttgaaatcacatacacatgcgatataaatggtagacatggctttcagaagtattatttgctgttcacaaatccatattatgcaaatatcaaaagaatgactggtattctcttgtagtcaacattttttaaattgtactggttccacactgcctcaacagctcctgcttctttttctcggggtttcttttgtgattcacagtggactgtctcactgttctgagctgataggatcctattattatttacttcttcctttcaacacacccctgaggcagttcaaaggtgaattcaccattattaggtattaattcacagcaaaaacacaggcttatcatttttaaaatctgttgtcaggactcacactggttttacaatatcaccttgtcacaacaagaactaaaccttctgatgagccccaagcctgaatttctcaccatcataaatagtatggggacatatttaacatttattgatagagaatggctaaaatgtattaaggtggaaatttgtgctgaaaagtcttcgtattttagttcctttaatccttaaaacaatcttgggagctacgtgttattttatgactcctattttacaaaaagtcaactgaggcttggagaaattctctggttaaggttacatagtgatatggttaggctttgtgtctccacccaaatctcatcttgaattgtaatccccataatccatatagtccgcacgtatcgagggagagaccaggtggaggtaattggatcatgggggcagttcccccatgcttttatgatagtgagtgtgttctcatgagatctgatggttttagaaggggctcttctcccttcgattggcacttctctttcctgcagccttgtgaaaaaggtgccttgcttctccttcgccgtccaccatgattgttaagtttcatgaggcctccccagccatgctgaactgtgagtcagttaaacctctttcctttgtaaattactcagtgtcaggcagttctttacagtagcgtgaaaacggactaatacacacagcacagacatagtgcagccttatttggaacccagactgtttggctccagaatccatactgtgtgtccttcacctgaccatattgcatctcattctgtggtatcgtttacttaatcatttattcattcacccattactttttccaccataaaagttctaaatgaatgcgtactctttgccaaatgcaatacagaacagtcggtgagaatataggaaaagggaagtagcagcgatgctatggaatcttagagttctcctctcccagcctgggagtacaaatgtcatagaattatttatggaagagttgtcagctaagtagacaccaaaaggttaaggagaaattacctagatagactgggaagaagaaatgacaggtggaagaaacagcctgggcaaaagcacaggggcaggaaacaaagatggtatgtatgaagagttacaaacagcttggttctattacggcataaacatgagacaagagaggaagtcatagagttagcaaagggctgaaggatctgccatgctaaggagtcagcaatccccacattaggatgcacaaaatgatccactgagacacaagaagaaaatattaaagtttgtctttatatttctctttgatactgttttttctttccgtttttggtaaagctttaaaatatgtatagcatacaaatgcaataacagaggaaatataattcttgtgggaaaagtatgtgctaaaattattttactgatagggtctggatgaatataagtttgcaggtcactaccgtaagtaatggagagacaatagatgatttttttttttttttgagatggagtcttgctctgtcacccaggcgagagtgcagtggtgcaatcttggctcactgcaacctcagcctcccaggttcaagtgattctcctgcctcagtctcccaagtagctggaactacaggcgtgcaccaccgcatcggctaatttttgtatttttagtagagatggggtctcaccatgttggccaggctgttctcaaactcctgacctcaagtaatctgcccgccttggcctcctaacccaaagtgctgggattacaggcatgagccactgtgcccagaggacaacagacaattttaactgaaggctttcttggcgtatgcatgtgtctatagattgttctcaaaacactgtaatggatgacggcagaggtgtaacactcagggagggaagtgcactgaggagattgctgccaccagggaatttaatgttgatgaagatagaagccaaggctgtggaaataagagaaagtaatagattaaaataatttttaggtggttaacttaatagggctggtgatagattggccatgatatttaagaagcatcatctcactctacatgagctccagccacaagccttcttgctatcacttgaataagtccaatacaggactccacaggaccttgggcctcctttttctgctcctggaatgctttccttcatctttgcctggctggcctcctcatttatttctcatctctgtggcaatgtccattcttatcattgtggccttccctgaccatgttatacaattcctcaatacttcctatcaaccttagtgagctccatggcatacacatctgagaaattctgaaatcacttctttgttgtataatagtgtaacattagggactttgtcatttgtgttcattgctctttctcacgcgacagtgtttgacacataaaatgtgctcattaaataaaggagcaaatagatacatagatgaacaggtagatggatgggtggatggatggtggatggatggatggatggatggatggatgggtgaaagagtgactcttattaaacttatcccttaatgagaccattagagagatggaatgtttccactgagagatgagaaaaaggatgtcctaaacagattagaaacttgtctaaatttatcctatctgttaaaactctttacttagtctataaagaggaaaccaaataaaaatggcttatgtaatagaggaaatttattgactcaggtcactggatagtccagaagtagaacagcctcagaatagcttgttttagaagctgaagaatgtatctggaactggatctgtttctttctttctttgcttttttcttttctcctcccctccccttccctccccttccctcccctcccctccccttccctcccctcccctcccttcccttcccttcctctttctttcttttctttctttctctctttctctttctccttctttttcctttcttctttctttccttctttctttctttctttctttctttctttctttctttcttctttttcagtgttcaaacattttattaaatcggatagcattgttatttccacattgttgcacatactgacttgtattcaattataagagtatagcacatgtttacaaaggtatggctgagcagtcagttggtaagtttaaaatttcaagagcgctccaagagcaaacacagtaaagaccatgcaagttccagagtcgtgaattatgacagagctcactcattttattccttgcctgcagttgttccaaatctcatagcctcaactctcactgtccagacacagagaaaacatctgtttccaaaatcccattgaaagtcctaagctttgccttacttggggccacttctgagtgactcacagaagtcattaggttgctatgtggcaattagtttaggcctgcgatttcttaaccaatctctgtgtcaagaaagatagtaccactctgattggcttagacaaattagggtctactttttgaggaggggatctttggggaggaagccacaatgtcctttataggcttggaaaaaaatctgggtgtgtattattgcaaagccatttaagactgtgtgtttctttatcaagaatgctttccataacccaaagatgtcacatatacaaaatttgagcagaagatttgcttctaaaatagtttcatatcttttgtaattcttaattatggtatacataaatagacttacttcttccccattggatgctatgaaacatacccatgactatttaaaaataataattcactattaaatttagataacaaatgttaatattgtaagacaatagcttcccttaaattctagttctctctgcttacttgatgtgactatcagtagataaagggtcatgatttggatctggggaaggacttgctgcttctggtttgtataaaggaattaagtagggaatgtgtaggaaatctggctgggctcagcaatgccagctttaatggaatccaaacaggttttcttaaaaataaatggtcatgagaaagctgaacgtcaacctcctttcctgttgataaatgacaatgtataccagattgtatcaacagttccgtggagcaggacacccctctgcttttgagtctctgaaaaaaaattatgctgctttccagcaactgatctcctttttctccatactaccgcctttctttgtcatttctctcacacttttgttatcttctttaattgcagtatattctttcgcttggcaaacacacatacagcaaagtcaatccaaagtgcttctgatttgagcaagttccttgctctaggctcacctgaaaatgaccatctgtgttcaggtcatagaacttataaatatacatttaattttttttctgttttccactcactttttataaaataaaggaaaacaaatttcacagtgttgtctaaagactgttcagcagttctgttcatgatactgcctatctgcaccactgatgttggatagcacaatttttttttgtttttcaatgaattaaaatacaacctagtatgcaaaagatgctaaaataggagaaacaaggcatataacatgtgaaacctgagaaccccttgcgcttgccattccacaccttttcagaagactgaaaactctacattattgaccatgttggtgtcatcagcacacctgacaatgatcttcttatccttatggaactggacatcctagcctttctatctgctcttggcataatctcttctcttagagggtactgtttattactttttgaaattgaagtgaatacaaattatttttgcttggagaatatctttgagaacttcatgacaccctttgaaaatttgaaaatggttgggtttttggtttgttccagaggccatatttggtaaacaccaacttctgaggcaaacaacatttctgcacagctggccccagaggcggtccttgtgccaaatccacccatgcaatggttgatgccaaagagttcagaaacacaaatccaatttaattctggctcaaaaaagcaataagtgtttaaattggatttctgtggagtttgttcttattaagcacagcacgcaaactgctttataggcatttattatttagttatttctaacaaaggatcttatagatccagcatctataattaatcgggaatgagagtagatgctagccaacatatgctctgtgacccagaacttgcactaggaaagctatcaggtttgtaccaaacaccagggtcgttggcaaaagtttgcttcattaaattcggctttgtgggttttatgcttttaatccaggctctcagctctgtctgtcagccttacctgtatcatattaaacttaacagggtcaatatgatgcaaagaggtggcacctggaaagtggtgtatcagtgactccgctttcaatccaatcatcctcccattatgtcttgtcatctttcaactccagtggtcctgaggcttcttccaggcacctccactcgagattattcctggatatgtgctcacccccatgtggcccatgctccataatgatgggtcccatctcgatctctataaatttccttttctgttgaagcactaatgaaaagataatttcataaatggttatgggaatggcttacttggttctcggttgctttttatcttttcctaattactttgcattttagtaagagccttccagaaacagagcctaaataaaccagggttgtaatggtggagatggcagccccatgaagctaatgagatagttggagtcagacttattgcgtggccatgggaggtctggctctgcttacctacattttatacttggcccagaaccttgctcacagcatttgataagcaacccattgttctgattcctagacactgatgtcagaaacaagcactcacctgctagtgttgatcacatactccatgattatttatcaaaaaaggccttttctttatgagactgttgttcagtaggccctttatagtcacaaaggataattctcataagctttaataaattccaaatatgagtttagaaatgttagtgctagttctggcttttcttggtttctatttccaatgagagtcatgtgctttcaatgcatatattcacattacaagttaattcttttcatctttcacactaagcttttgtattttgtttagtgtattttttttatttcacaggagaacagaaaagtttactttgccacagtcagtaatatagaaaagatcgaaaagagaataaagaaagtgttctaagaagtggctgctgtgtggatgactaggttcactaactagctgggtgacttatttctatgtcagccttgcagtggacactattaacatttgggcatctgcaaaattataccttactacatcatggattttcagattaataatcaagatgtaaactcataagtgctaaaagtgtgaatgccacaagtctattttattgactttgacttttgtggtttcctagctctttttttttttacatagttgccttgagtaattcatctactccctttctgccctagttttctcattcataaaataagtataacagtacatacaaatgctgtcttccacagggttggttgttatgggaattaaatatgttaatatgagtaaaatgcatagaaaaatgcacagaagtcttactgttgtaacactaaagctacaactaatattactgctataattattgcattattgttaattggcctgataattgcattatctcattttgtataatgttgggcgaggaattcattcaagtaggaaagatctaaaagataatacattagaaaagacaaaagtaaaacaagtacaaatttctaatttctcctctaggccctacacactcttcaaatcctaaacttttggacttctatctcttacacctaaagtgaaccttctagaggtaattgccatctgcatagttagacatgtccaaaacagattagcactctctttatttgtgcacataaattgctatgtcttttattcaataaataatttttggtcacttattcatgacatcgtggatgatacaaagatgagaagcacatgatttctattatcagagagaaagaagaaaaatatatggacatgtgactaaagtcaaacgtgccatgtcaacaagtatgggcagaatcagctgtcgtgcagtagatgaatattttggctatatgcaagatcagtggagcatcaatcactcagtctgaatgtgcagcaattagattcagttaggttaatctgttactggattccaccattccaacatctggttggctcagtcataaaagtgtttattatctccgtaagtcagtctaaactcatagtaggctgccacttggagcttctgcagtgataggacaccagcattctttccctcagtggcctatgactgctgttggtcaggtgtctacagtgacttcaagatgattccacatccttgaatcatttctcaacacttaccagtgcactgggttgttgggatataaacacaggaacccacaaacaagacatcctctttctgggactgactataaatccctatcccgtattcatactggaaaactggtaagaccttgtaaccctcagcattcttttgctatctgagaattaggggctggaatttaggccagctcttttctaggctttcttgatttttccactccaatggaagaaaagcagaggaggaagcaagcaggaagacatggaaaagaggacaagatctatgtccctccgactagggcagagtttggataagcatcccattccagccctattctctggttaccttgcgcttttcatggttgacaggatgggaaccctcccaaacagcaggctgcgccggccctaacttatgtgaccggttgtaaaggagaaaaggctaaatcaatagggttataaaagcacataccatgcagaagttcagagaaagcaacaaggaagaacctgaaaagtcaagagcatcaccattatcagagaagtttcacttctaaccccatttacttagcatactgagctccacctttaccatagtgacctcctggtaagtgggtgccaggagctccccctagagtttaaaatgtgccattgtcaatacctcttaacagcctgggggaaaatgcttgtctggcaggcataaggcccagaggagatgggagttcagaagtctacgtattaggttggtgcaaaagtaattgcggcttttgccattcattttgcaccaagctaatacacaattacaagccaaagtagatatctctccctcttccctaagcacccctccacttgaagtgattttgcccacaccacatttgaacaaactcaaactgcccccttcaaaatgatgggatgggggagtggggaaatggttaagtctgtcagctaagctgtcccagagttctcagagtcagaatggagacgattgctttggtatctgtttgatggcacacaaggaagaaaaggcagctacacatctttctcttgccctttggcagcagatcacaaatgtcacagcttgggagggtgccaattagtgccccttgtatcctaaataacctgccacagaaataaaataccaagcagtccttgctttgtccttgtgagttggggcccatgctttcccccatatagagtatctaattttgaaaatgtcactgtagatatcggcacacagtgattctacagctggagagatgaaggtggaggccgcatatgatttgagtcaccatgcttctccacggactgcactaagtctcgtctataggactcaagttaggtagcagttcatagaaatggcatgaggtcagataaagtaaacgatttcaatcacacttgaaaaatacaatgtgtgtgtgtgtatgtgtgtgcgtgtgtgtgttgtgtgtatgtatgtgtgtgtgtgtaaaacacattctcaaaaagggggtgatagtataatacttagatgtgaaaaaggacaactctgataattgtagaaaattaccttggtatgtgcatatataccttttgaaaatagagatgtttaggcattttatattcattttttagagttccacttttttttttttttttttaacattctcttctctttctctgttgatttaccgatagaatatgtgtgtgtcaggacacttggcaagatagagacagctggaagtaatagagccaagctctgtttgaaaagctgaattttcacaagtggtttggggtttaggtgtggggagcagaaatcctgggcttcggaataacttttgaaaagttgctcccttgacgtaaagatttgaaagaagtaattcacagcctgccttgcactttttaaaagttgtgtaacattacgccacctaccacaaaagaaaaaatgtatataggaaaagacacgtcaacattatttcgaatgatgtatttttaatgtcataactttctattattatttaatctgtcaaggaaaacatatactggaaacatttgagaatcctccctccctgccacctttgcaacacacacatgtccacacgcacttttctttgccaaaagtaagaagctggggtctggaaggcttgctcctgaatatggtgtatatcttatgtaaataaaacagagcatgcagctcaaaaagaggaaagtagtttgtttttccatctttgatttctgctgttgtggctcctctttgttacgaattaagtctttaccatcatttagtgaaatgttatcctcgtaatggtaacctggattgttaccaagttacttttacagacaccatctccatttctccagtgatctagtaactccgtggtggatttaactcccctattgtttttggcttatacacatgagtctgtctaatgcaagctgtgtttttctgggggccgaataaaaagtcttcatgagtgatagtgctggggttgcagtattgaaacatactattgggatccgttttctgattttgactcagtagcctgtcagaggcagaatgcttctccttttgataacagggctaactagtttctgaaggaatgcataaaagagtcaggctgtatgaattccagagtcttaaattcctttagctatgccctgcaatctttaagcaggaaatataaacatgtaccagctataaaatgtgtgagaacaataataggaatggctatctttcttgcatctctcaagtgtgacatacagaggagagctgtatcttattactaaccttgtccatcaagctaatatttgtatattgcttttctagggcctaatggctgagccctatctctgaatattggataaaggagcaattagaatcgtttgtgccaaaccccagagttggaactgcaggcccttttaatatgagtccaataaggaaaggtttagtgtaaatgaaggtcagctgtcttgaggtccctgaccaaagctctgtgtgaaagctaaacagagccggagggagtttttttcacctggctataggctaaatgcaacacagccctatagcatgcagatgctcccaaataactaacttattttcacaaggaattataaagcataggaaaattaataaattaaacatagctccagtcctgcccccaagaatagattgcactactaagttttggcaaaagtaagaagagaccataaaagtattagaaaaaaaaagaaggaataatttattaaaagtttctattttttaagtaagtatatgataaaaataaagatgtttccaatttgatttctaaatctttgactcttcaattgcttggtttccatgcttggcatggaaagaagaaaggaaaggagaaagaaggaaggaaagaagaattgcaggcaagtaagaatgaaaaaaggtaaggacaggaagaaggaagaaagaaggcagaaggaataaatgaatgaatatgcctgaatggccacatggaaaatttaaaaattatccaatgctgagtaaaaatcaatgacagccagtaaacaagcacataagcacactcccctaataatccgtcaaataggatgtttttaaatcacagcaatatttgttatttcttctgatgctttctatttgttccaagccttagagcataaggctagctactaaagagcagaaagagaaatcgaattcggctacctgttgttgctggtatggggagggagatgaataaaagcagttccaagctccagtggctggttttcatgaaaatgtattttcttaaatcaataccatttcagactggttagtttttggacatcctttaccaaagatagatagataaataaataaatgagaggtcattttatatttcctttatgaaataaatatgcttaaactctaatggtaaaaatgtatgtgaagatcaaaatttatattgtgcttaatgattaaatgggctacagaaaaatatttttacctagtagacagcatcttagtctcaaactcaggctctatttaacagtcttaataattagcttcaggctgggcgtggtggctcacgcctgtaatcccagcactttgggaggccaaggcaggcagatcagctgaggtcaggagtttgagaccagcctggccaacatggtgaaaccccatgtctactaaaaatacaaaattagctgtgcgtggtggcacatgcctgtaataccccgctacttgtgaggctgaggcaggagaatcgcttgaacccaggaggcagatgttaccgtgagccgagactgagccattgcactccagcctgggcaacaagagctaaactccatttcaaaaaataataataataattagttttgtaccctcagatagtcaagagcaatcagatttttcttaacctttattttctcctttgtcaaagggagctaatagcagagcttgttgccttgagattaataattaaataataattcattaataattaaaaacagtaaaataatacttgaaaacgcttttttaaaaaatatagacaaaacaaaagcttttttcttttctctctctctctttttttttttttttaacttgaatatcaagctcgctatgcaatttgacttatggagtgctgcgggaaacctgttggatattttcatgtatgtccttaaacacatgactgctttccttgtatgtgcttgattcttgtcagtccttctcctcgttattgaaagcatagattgctggctgtgagttggaatcatccactggataacaaaggcagtatctgttttctgggcctcattgtttgcaggtctgtgtgtggtccagcctagaggtttctcttcagagatctatgattggcggtaagagagaagtgaggttggtcaggagggtcaaaacaatgaggaattgcatggatgacccatagacagaccagtggtcatcgtgtcagaatctccctgcagcagcttcctccatcaccgactgagcagggctacccaacccactagccccctacgggcttatttacatgatctgatttccaaagaaactttcttttccagatgttgtgtgctttgcaaggctcagctctgtgggagctctgcttgacaaactctaatatagtctacatgctcacaaggatggtttttgctaaagagaccccagtgatatgttggtgcaattcaggatttctcagggtagcacatcaccaaagtgcctgcaacaatactgtcaagatcttactgattcttctagccagaagagactaaaacaggtgatccaagactcactcaagcatgcttcgtttcttaagacatatagtaacatagttgcttttaatttttaaattttaaggattaaatccaaatttgatcttaggtaaatatgtaaaatctagtctaataggttttgggaggatggaatatagtgagatataatgttcattggataccaataccatatttatttcccactgtatatgatgtcagaaaccgttttaaaatgcagctggtctaagtggaatgttcaggtcttggtttgtaggtatatgataccttggttatttccatttatttttaagatcttattgtctgtgtgcatgcctgccttctgcagacacaaatcaaaagcttgcaagatagcacagctttttttttttttttttttttttttttttgtctcttgatagaattaggacaaagatctgtacatggaatagacctgaggctgggcaaggtcttcctccgcctatctcaccatctttgtctttgctctgtgccctacccaaacccaccttcttttagttcttcaaatactccatacctgcatcaaccagaagttttttgttgcttcccatgtcgtcttgaccacctagaatgcttgtcacctggttgcctcctgcttctcctgcagttattatctggtaatgtctggagatatttttgtttttcacattagggggtaagacactactcaaatcttgtgggtagaggccaggtgtcttagtccattttgtgttgctacaaagaatacctgaggctgggtaatttataaagaaaagaggtttgtatggctcacagtttggcaggctctacaagaggcagggcaccagcaaatgctcagcctcagatgagggcttttgtgctgaatcaaaatgtgatggagaaggttacaggggaaacagacatatgagggaggccttccttaactttctgatgagataaaagtcctctgttataggctcttactgcaacagttcctgtctgtcactgctgtcattagaattgcagttttactttgctcgagtaatatattgattactgtctaccacccccaccagattgaaagtttcatgaaggtagagtctgtatctagtttgggtcttcattgtatccccagaacttcatacagtcacataaaagtgatcacttggtaaatatttattaagtgaatgatggaatgagtgaataattgaagaaataaaggcataatgggaggagagaacaaaaaagaagtcaggcaagctaccaaagtgatgtgcttattgattgactaattttcaaaccagttcacatccatcacaagtttgttcatctatttacttggaaagaatagatggaaactgaagcttgaaaaaaagtaatcatcgagactgttttcatttgacatgtgttaatttcagcaacccctttttcttcaataattcctctgttgagaaagtttggtgatggtatccatgcacatcatttttttttcactgaagctcactgacacctggaaagccacgtagtttttcagatttatttagaaaatagaaagcatctttaaaagtccttcaaaagcacaacagcaggattttggtgtcagtaatcatatgccatatttcaggcttttaatttcctcggaatggtatttcttatgatctgaaagcttttttccctcccctgcatcagatcttattttaacatactgattgagcctctttatcttacacttcctgctgggaaaatagatgctaaaatgtgtgtaatgtcacatttactttaaggcatcaccagataaaattgcaggacccacaggcatgaactgtggtgtgcatgtgtgggatttcttttcctacaactccagatctccatcagcagctcaagccaaacattcagacccttcaacgttatgtttaattggatttcattctttttctttttattaaaagcctttagtttgtaaatttttttcactttgtactgaagcttttagaaaagagcaacctcttttttcaaaacaaagttttgatctaatcatttgcatctgttttgtactaattttctttgcagatgtttcggagtttgagctatgcagttaatagaatgacaccagattccaactggtctcttactatttgtgagacctcactgttttcaagggtttaaaccagtgattcttaactaggagtgattttacctttcaggggacatctagtaatgtctggagatatttttgtttgtcacattagggggtaaggcaactactcaaatcttgtgggtagaggccaggtgtcttagtccagtttgtgttgctacaaagaatacctgaagctgggtaatttataaagaaaagaggtttgtatggctcacagcttggcaggctctacaagaggcagggcaccagcaaatgctcagcctctgatgaaggcttttgtgctgaatcaaaacatgatggagaaggttacaggggaagcaggcatatgaaaagaagggaaaacctgaaggtgccctgactttccaacaacccactctcaagggaatgaattcattaccaccaaaactcatccaatctctcgagagtgaaaagtcattcactactgtagaacactgtcaagccattcacgagggaacagtcctaaaagcccaaacacatcccagtaggacccacttttctacactgcggtactgggggtaaaatttcaatatgaactttactgggaacaaacaaaccatatcaaaactatagcaccagggatgcttctaagcatcctacaatttacagggcagtacccacatcaaaaaattgtctgccctggaatggcaatagtgtcaaggatgaaaaactctggcttaaactcaaccttaggcttccactctgtaaaattaaggtgtaatcacgtgcatcatagcaatgttgtaaagatgaggtaaaataatgcatcccacattcgtagtgtagtcagtaactcatgagccattgttatgaatatggttgcattattaagccctttacgatctggtccttaatcacctttctagatttaccttttccaattttctcttatatcctcagggacctcttaaaatttaccacttgttacccattcttatctggctaacttcccactctttacccacgctgaagttggatgtctccctgaaaccaatagactaatctgaaactaacccaaagactcatctaattttctggtttaccccatttcagagcccagttcccactgcactgaaattgtctgtttattatttttcagagtgtgatcaccacaccttgtgttaaaattaccaatactaaaatgccctttcctggactttattcaagatctactgtatcagtatccccgggcacggggtctggaaatatgggcatttagctcctgaattcattggtagctatactaaagtcatcactgtagatcctgagtttcaggctgggattaggtctttttttttctttgcatccttggtgcttagcattgtgactggcacatagtaggcacttcataagtaatagcactatttgaaaggataaatgaataataaacaaaaacttttattctactcttgtctcttattttgaaaagataaagacccattggtattagcattcagaggggagaaaatgctacttcttctgctctgttcttatatattcttatatacaagcatgctaaggacaagatatgcctttgtttagcaaagtttgaaagtgagaatcattagactgatcaaagaccaaagtcatgttttgtttggcttgtacaagctcagagagggttttttttttttctgtctgttgtggttgttttttcaagcttttaattgttttaagttttgaattagtggccaatattttcatataaaaatatgaaaatattgcagttggtatgttgatgagtggggccttatggggaagaaaaaggcacattggtattagcattcagagtgggaaaatgctacttgttctcttttgttcttgtaattcttttatacaagtgacttctgtcgcttaaataagtcctcgaatgtttacatgatcaaaaataacttatttttgcctattaatgtatggtttataaatacagatgcttaaaggggttatagaaagaaaggtaaaggaatagaagtcagctggctgtaagacaaaccagccaaactggtgagctcatgttctcttatagaaaggatgctgcttctctgatcagtaaatggttgctggttgaatggggaaatggatgaatgagatctcagcaatgccagatgtttctgtttctcaagagaagtcagaatttgatttttttttttttttttttttgagacagagtcttgctctgtcacccgcgctgtactgcagtggtgtgatctcagctcactgtgacctccgactctggggtcaagcgattcttgtgcctcagcctcctgagtagctgggactacaggcatgcaccaccatgcttggctaattttttgtatttttagtagagaaagggtttcaccatgttgcctaggctggtcttgaactcctgatttaaagtgatctgcccacctcggcctcccaaagtactgggaatataggcatgagccatcgtgcctcgcctgaatttgaattttttatgtgaaaatattggccactatttcaaaacttaaaacaattaaaaacttggaaaaaaaccacaacagacagaaaaaaaaaaccgtgtctgggcttgtactagccaaacaaaatatgactgtggtcttttatcagtctaatgatgcctactttcaaaattgctaaacaaaggcatatcttatccatagcatgcttgtaaatgagaatatataggaacagaacagaacgagtagcattttctcccctctgaatgctaataccaatgggcctttttcttccccacataaggccccactcatcaacataccaactgcaaaaacagaagtcgggcaaaagcagtgcgtgttgcttctatgtgagctgaagtttaatcacagtggtgtgtataatgatagctccacaggtgtccttgtctctggaaatcttggctgtgaccctgtaagatgtaactcacagtctgcaatgagaaacggggaataaatcagttggtcagtctctctgtatgataaatcatgagtgtgatgctttggcaatttagatcagcattaaactctgggactaaattaaagaaatcaccttcagcttgagtctgcacctagattaagtagttgtaactttctaataaatgtggcaagagttctgtgaagattcagacaagtctcactttgttaagaaaataggggggatggaaagcaaaggaggaactgaaatatttgggaagaattgaaccaccaagggtttagattaaatgatcaaagacagaagagcaagtgtgatatcctgagtgagcagagtacatatattttctttaatgggatgtagtttaagcagcataaaatatttatttcttgtagtaggtaattgagatccctaaattggggcaattactttgaatttagtcagtgtatcaatcagctatttttgcgtaacacccccctaatcatcagaggcttaaagctccaatcatttattttgacttacatgtctggggctggctggggttggctgacctagtctggccttgcctcaatagctccacctcaaaacgtgtgtccatctgggtttggctcctcactgcgagttgtgctcaggtctgatcctcatatgcttggtctggaacctcaggctgaggagcaacagctggccagaagttgctcttttttcatggtgttgacagaagtacaagagacacgcacagtggcacaagtgcagacccagcctctgcttggatcatgtcagctatcatcccagtgggttcagctaacctcagggtcaaacccaaagtcagggtgtggggaggtatactccaccttcagtgggaggaaccacaaagccacaaggtaaagatacagaatacatgaaagtggtgaataattgctgggcagtaattcaacttattgcactgttatgatagggcatccgtggatgattgtatgggttctgtggagatggcattatctagttggattgcataatgataaaaggtaattaggcagtgctaggcagatgccaaaggttcacacagagactttctccttgatataatttgaagtcttgattgagaagtgaaaagggagatggctaggtttgctggcctagtgctgtctgttttgcttctaaatgattgttgaacatttgaattaatgttaatttggtcaagcttcatcaaatgtctgtatgccagttgtgagtcttcttctaaaggaattattgtgccccctactttcatttgttttaaaagcctcatcactaaacttatggtcggcagtatattgtagtcggtaccttggttgacgtgcgtggattcctatcttcaacaaataatatggtaataagaggatataactcaccccttacatgtaaactacctatatccacacaaaattgtctttcattctctgagaaaccacaggactggccatgtcaatctgaggagcatcctagggaatttgcaagaggacctggagaagcagggctgcaatgtgagggtcacaatagaaactaatcaattgagtttcactccatctgcagaggatggtcagcaaggagtcagaatttgtctgtgcttcttcaaccccatcctaaatcaagcagaacatatatttcagtctccagagaggagaaaagaggccatgggaaggaagatggtgcatcaagccatacttgaagcttgaagtgtcccattcccttatcctgctttcatgtgcatgaagcaaccttggtgttcttgtttatacatatgagacttattctctaagcatccccacttctgggtgccccaagaaactgacaatccacagtccagcctgtggtgaccctcctaaaatcatgccgcctggtgaagctctgcctgttttatgatctgacgtcccagatcttcatctttattttgtttctcttggagatatgcttgatatttcatgctgtagagaaaatagtaaaaaaaaaaagtgttagttaaattaaaagagtataaagataaatggaaaattaaatgagtagccttgtaattaacaaggtagttaaattatgttttaaatgaattcttatctgctgccatctgatttcttaagaccttcataaaattggtccatagcaataacattacttgactggaagtttcagaacacagagtggcatatatcccaaaaacgcaaataatgtgaaactgagtgttagacatctcttatttaaagaaaaacatctcccaaccctccggcaactctagagaggaggagatatctaaatgactaatcaatcaattaagttatctcttccatcttctattcaatgtgatccaatcttccccctttagctcagctttacccttcagcagcctgccctagggtcttttttttgcacacatgattattgtcaggatacttttctaaacaaagactcattttctccctgtggaggaattctgatgccaaatgttaagaaaattgtttgaccctaataaaaatttatgtattttttttctaaccctgttcattattgatttcagtttattctgaacactgaattttttaatgtatcaaaagtgtgttgttacctaggtcagcctgtgtggtcactcagtcaatacatgagttttaattcaattcaataaatattttccatgtgcaaggcactgagatcaagcactgggcatattaactgtaaattagatttagtgcttgccctcaagaagattacagtctagtggaggaccagcacccctgcacaaccacagagtgccacgagccatgtcagaagaaccccctgcattggtaaagaagcacgcccacctttacagttgagtatttctcatgggggaagggatattttccccaatttattataaaaaatttcaaacattaagaaaaattgaagaaatagtgcagtgaacagatatgttccccacctggattcaataattgaaatttgctgtatttttgttttctttttctatctatctatcaatttactgatctatcaatctatctatcatctatctgtctgatatagtttggatatttgtccccacccaaatctcatgttggattgtaatccccaaagctggaggtggggcctggtgggaggtgttttggccatcagggtggatccctcatggcctggtgctgttttaatgatagtgagttcttgtgagatctggtcatttaaaagtgtgtggcacttcttccccactttctctcttgcttgctcctgctttctccatatgatgtgcacgctcccgcttcaccttccgctgtgagtaaaatctccctgaggcctccccagaggccaagtgatgtcgctgctaggcttcctatacagcctgcagaaccacgagccaattaaaccccttctctttagaaagtacccagtctcaggtatttctttatttcaatgcaagaatgacctaatacactatctatgtatctatgtatctatgtatctatctatgtatctatctatctatctatctatctatgaaagcaaattggagaaattatgacaattcatcccaaatgcttcaacttgcatctccaaagaatatagacattctgctgcacaaccatagtatcattattatacccccaaaatggacaaaaattacatatcatctaatacccagccatatttgaattccctcaattaatcctcccacctgttacggctctttactgttgttactgttgttgaaaccaatcatagattaagcactaaatttgtttttatgtcccttcagtttctttcaatatagaacagtgtcctgctttggtaaagtactatattttgaatttttctgattattttcttaaagagctgtataacatttttctttaagtcttctatttcttgtaaactacaagttccatcttgaggtgtgattagattcaggttgaatatttttggctagaaaaattcataagtgaggcaggcacggtggctcacaccgtgagtgtgtaatctcagcagtttgggaggctgaggtgggtaggtcacctgaggtcaggagttcaagaccagcctggccaacttggtgaaatcctctctctactgaaagtacaaaaattagctgggcatggtggcaggtgtctgtaatcccagctactcgggaggctgaggcaggagaatcacttgaacccaggaggccgaggttgcagtcagccaagattgtgccattgcactccagcatgggcgacagagcgagactctgtctaaaaaaaatataaaataaaaaaatgctgggcacggtggctcatacctgtaatcaatcccagcattttgggaggccaaggcaggcagatcacctgaggtcgggggttcaagaccagcctgaccaacatggagaaactccatctctactaaaaatacaaaaattagccaggcgtgatggcacatgcctgtaatcccagctacttgggaggctgagacaggagaatggcttgaacctgggaggcggagcttgcagtgagccgaggtcatgccactgcactccagcctgggcgacagagtgagactctgtctgaaaaataaaataaaaaataaaaatcataggtgatgctgcgcatttcattcacatcaagaggttcccattgttatttgtggtgccatgtttggtcacctggttttgatgtttgtcgcaaaattatctcgattatgaagatacattttctccctcgttttcaattagtaagtgatctgtgagttgacactggcgtcattgcctagcttgcttacccaaacctgaagcttgtattatccattgatgagccttttctaaatcactccagtagggttagcaaaatggtgattctctaattctatcattccttctacatagattaactagtaggctcctgtaaataactttcattttttaatatgcttacagaaagaaggtgtatttgagtggagcatgacctagaaatagcaaatatctagctacacataaacgttaaaaacccaagaacaggaaagaaatttagagaaactagagcatttagagctagaagggacctaaaacaatatatactccaaccttttaacaagtgaaaaaagtgaagtccaactatgttgtttatttttatctcataactaactagcttgatgtaacagatctttgaataaaaggaaacacattgtacacgggtgcaatgaggtcaaagtacgaatataattaccactgatttgttgacaacattgtttgctgcattataattttataggataataggagattgcttattccagcctcagtaagcattattgcacacatgaaatgtgcagggtataagtttttatatttttccttcattatgtgattgccaaggctttatttctaatgctaagatattttcactgggtttaaactgagccgacttatgtaccctggttctttcctactcttgaaactgtcagtaatgtcacagtgtctcatagctggaaatgtagtaaccacatcactccccccaactcctgctccctgatttttcattaggatgcagtttattaatccaagtaaaaatatgaaagcctcctatgattaggtttaagcctaatatatgatcctccttcctggaagggcactttgagctggtcattagggaatggagagaacgggtatcattagggaatttgcctggcaagagcaaggccaagactggaaggaaaattggattttatttgccaaagccgaggtaatgtcctaaataaaaatttccccaaccaggaagacctaagaaaattgtcaagaggtagagtttagaaccaggggcacaaagggcaggtgggagaataggctgggggaagactggagtgctaccaacaactagctttatgttttcctttataaacacgtattgagcacctactatgtgacaggcatggtgctgtgtgttttgtgtgcattacctaatgtaatcctcacaacagcctagaagtcagtacttttattaccctcattttagagatgcaaaactgaggcaacttacctatggtcaccctgttaataagtgttggggtgtccctgacccctgcacttttaatcagtaggtaatatgtagtacctttctctggcttgtaaatgttttcttgcagagaaaatgggaagcaactatctagattggaaaggttaaaacgaaggaatcggaaagcaacagttaaatagagttaaatggctacttttccctctcagagttttggaatacctatgagctttcagccataaagccaagaaggttctggctggcacgacattgtccccgactaatgctaggatggtgttgtcaaacagaggcagaaacagagccctatcctgtttctgctcagttgcccatttcagtctccgtcctgatgcaacacgaacttctacagacagactcagggtctccagaaagcaaagcctttaggaattaaagtcatctttgcttttaaatacttgtttctcccatgttaaggacacttttctaggcaaaaacctcctgattgcctgttgctgtggcatatcttcacaaattcatttttcataaatgtcccaaatacatctgagacattttttataacttgtgtaagcttccagagacaaatgttaaagatgacagtttggaaatgaagacacataaaacatgccttgggaaatagaaatcctagggcagcgacctcaaattcagtcctctgttcctttttagtcaatatattgaatatcatattcatatatatcatatcaacatcatatgtatcgaatatcattgtatgctgcaagtctaaagaaagagagactagaagtgaagaggtcaaggtttcagccatccatggacctgtgaaggcttgactttgaaatagtcacatgatcactttggctattagttttatcacttctcttatcttggtctgaagatctgagctgtgttttatgataaagaaaaatgtataagctagtttttgctgtataacaaaacaacttaatcacttaaaacagtaacaatttaatgtagctcatgatctggtatgggctggctcagctgatctctgcctgggctctatcatgcaatggttgtcagccagtcccttagctggctgctgggtaatccaggatagcatcagctctacattatggatttggctgagcacgttgtttctcctctgtttggcctcttctctccagcagtgctcagacttattcatgtggtacctcagttcctaaaacagcaagatggcaagccccaatcctctttgcaagcttttactttcatcacgtttgctaatgagccattgactcaggaaagacatggccagatttaagagatgagggaatatatcccacctgttggtggaaagatctctgacaccacatggcaaagataagaatgtaaggggtggggggattatggccgtttttatcgtctcccatggaaaggaaattcactggctctgaacagtgctaatcaaaattgttactgaacatcataaagaacgtgaggagaggcctctactatgcattatgttcatagaatccttaatggaaaaaagtttgaaaatactgactacttggtgtctagagccccctccagctttagtatcctgtgactaagaaatatcacttgtccaccaagtgacatctagagactcttcatcaataatatgagatggaatcatgggaacatgtgtttgaacacaacaccttgtggatcaggttctctgcttcacagcggaatgcttatgcttagaatttttgagtgctaacaagtgaggttgagtctgtgagctgcttgtctcaaaactagattctgaaaatttgcagccactgctacagtcttggcttgtagttttacattgaattattggactgaattatttcattttgtcctggcgtgccttatcaactgaaaatattgtcccagagagggagcacaacaatattttgtaaagaaatcattcctgcagagatgtaaagactggttagtaacctgagtctctgacccactgtagcaaacagacacacaggatgctgagaaggatccaggactcactaagctgcttaactcaaaaggaaatagtaaggtttacactggcgacatgaagctgagtctcctttgggtctggagtagattttggtctgtgcttatgaatcgtctctgcacagatgaaataatagacattttaatgactgttcatatttataattatattagctttggatccaggttagaaattcttcattcctcctgtcaagaacttgcataaccctgaatggtgattagtaatgctagttaagcatgctagttcattttcaaaatctgttctattttacacacacacacacacacacacacacacacacacacacgtagagtcattcattcactcattcattcatttgataggaagttaagtggcatgtagtagacatctgttgtttgtttttgtcaccccaaatctgtttgcttttctcctgacaacaccattctgactttcttttggggaacatacccttgctcccattctcactccaggttcttcagatggggtgagttcatgggtgggcatgtgactcagcctcggccaattcacacgacatattctcctggccatggtggtgcatcagaggtggcaaactctcaagccaaagccagtgacatgcgaaagaactttcactgagactgttgagacagaggccgtctgccctttcctgctgattataacttggaagaagaaagccctggagatcttggccactgatatggtttagctgtgtccccacccaaatctcatcttgaattgtagctcccacaattctcacatgtcgtgggaggggcccggtggtaggtaattgaatgatgggtctttgccatgctgttcttgtgacagtgaataggtctcatgagatctgatgattttataaaggtgagttccctgcacaagttctctttttgcctgtcaccatgtaagacatgccttttaccttctgccatgattgtgaggcctccccagccacgtggaaccatgagtccattaaacctctttcttttatgaattacccagtcttgtgtatgtctttattaacagtgtgtaaacagactaatagagccaccatctctctaccacatggagctccagaatgaacctgatgtataggaaattaagaaagaggggaagatatgggatccttctgacatttgattctaacccccaccctgaccttttcagatacaggagtctatatattgtcttttattttcttaagacagcttaagttttctggaacttgcttctgaacattctgttacgtcatttttaaatacttgccaattatttttattagttactcatcagggagggaaatcaaaccagctcctgtaaaaagaatggaatttcaactatccagagtctcaaatctaaaaataggtggctaactcatgtcagaagtatgaaccctcagttccactaaatcccaatcttcataagtggaagcccaagaatctctattaaaaaattttaaaagcttgctagtttatgatgtatcctgcttagcacctgttcatggtctatgtcccagagatattttgaatatcacatgtaaaggggaaaggaaataggatatatttttcactttctgtaggccagatattttttgaagtacttcagcatattttcatgtaagatatttaagaaaaacttttgcatgcatttcctcagtgttctaggtataatactttagattactggttgctcagtagggaggaaaaaaaaaaaaaacagccctgatctcaaggagcttatagtctatcgcatccaatagaaatttctgcccttaaatgttccacgtctgccctgtccagtacattaaccatggctattgggtatgagaaatgtggctagtgagaaatggatttttaaattgtattaatttgagtagccatatgtggcttgtggctaccgtattgaaatgtaaaggagtgtacatctaggttatttcttcttaaacttgcatgtgcgtatgaatcatctatagatcctgtgaacctatagatctgatttagtaggatttggtgttggggtggtggttctgcgtttctaacaatctcagaagtggctgatccatggaccacaccgagtagcaaaaataatcatcaaagtaaaaaagttaattacaaaatatggtaagaccatagtggggacaagatgctataagggagaacggaaggggaagaggggaagggtttgcgactcaatttaaactaggaggggaattatagaaggcctcactggagagggggccctggagttgcagcctgcaggatgcagatgagctagttaggatacagaggtgaggggaggcagtgcgacagggagcagcagtgggtgcgaaggcatctcaaccacttttatgaaagaatctgtgaaataggcgagtcatcaataatagaattatcattacatttagaagccccttactaagccattcttctccttgacctccctgacaggttcaggtaggtgcccttctcagtccccataactcaaggcatattttcccataatcattaacaccttgagttgaaatgtgccctctatcagtctctgctgcccactgaactgtgaacccttaatgtcattttattctctgcatcctcgcatggtaggcattttacacatatttgtcaaactgtagccaaaaagtgtgtttgtgtgtgtgtgtctatgtgtgtgtgtgttgtgtgtgtgtgtgtgtgtgtgtgtttatgaggtatcagggataaaagaagtagatatactgcatatatagatgtatgcattatttttctcctaaagagatgagaaatatttttggagttgagccaagccattcatggcctctccattacttttagttttatggcagaggattgctctggttttgacaagcactaattaattccatctctggggaataatgggaaatgcaggcttatgctgtttgcaccaaggttatcagttatattggttttaatgttctgccctgctctagatataaaacatgcagcaaaatgcacagccacctcctcattagctgtaaacagtgtatttcagatttgtcaagcatacatatttatttttacatccaagcatttttatttatcttccttgcaagtccatgaagtttttgccaataaattaggaatgcagtaactagttctgaaaactatggcacacaggaaattttattgatctcataatttactggatcttttggttaattacaagttctgtctagcttagtacactttttgagccagctgcgcatcataaatatgtaacctcagtactcaccctccctacattgctgacagcctcccatgaggtcaaaggtgtaatagctacaatacccagagcctctaacatgtttaattaaactattaatctacttttatctgtgacactagaaagccagctacattgaattttcagagttcttcaatgcatttgcttacggtaaatttttccaagccatatctttaacagtttagcgctggcaacccttttaaaggcattttgaaaaattgtgaatgttggaggaattaccatatcagctaataagaaaatgtatcatttataatgattcatgaatttgagtctaaatgcagtatatgactaaggcactttattaaaaaaagagaagacaggtttgctaaaggtttgaaaattgtagtagatcaatcagcagcagcctcagaagtaccattattttaaaattgtgtggatgatcattagaagagaagtcatctttgttacataaccttcaggaacttgctgaggacaagtgtaacctcttgtggcagtgatgacattttcagtgatcaggccagcttttgtgttcattaacacaacagagcctcaaaactttagttttgagaaacctgtgtatccatgaagctttaattaggttaacaaggtacccattagtctatctcctttcttgtgtatcaaatggcagtaatctactacagatgttatacaatgaaggaagcaatttgctgcttttcattttatttcctgtactcactcatgagcttgtggatatagaattatgtgaaaaattcaagattctatttttattcatgttaagctcatcttacctgtttgtacaattttttgctctttctttattaaaggaatctgcatcttatgtgcctccataaaagctgtaaaaatatgacaccacgaccttctaactaaagtacctggctttaattttaacaatgattaacagtgatttgagtcatgcatttgaacattccacttaaaagtcaatttagacaggcaatgcccatgcaaatattgattataaacccactgtgtttctagcaagctagattaatatcatgggctaaaattcaaaaatctatttttcttttctacttcattaaagagtataaccaaaaaccacatctatttgcagattggtcatatattttgcaaatgcctgtgggactgaaatttaatttactcaacatatcttccctcccaccctacctccagtcaaaatcatcaaaaccagaactcttgttacatttatggggcagttgaaactgtatatttcactttgttttattgcactttaactttttgcactgtattagctgtgagtattccatggatcttgttaaatgtgagcagcttccttgaaaacaagtcatttcaatggacatgttttggcttatgttcagtattttacagccaatgtatcagagccataagtttataattttaaatgccgcagatcttacttattcatcatgattagatgtttctatctgctattctattgaatggcaagctctaatactgataaataaagagagccagttcctgatttggcaacaacaacaacacgtactgaagaaaataaatgcgttgggttcatctccttgatggggatgcaatctaagtcaaatttttgaatgaccactaactatttgcataatataacatataaattgatgactttgggatatttatatcatcctggtgcctcaaggttaaaattagtagtgtgaaaagataattactagctatgttaaataaaatgagtttctagaatgcatttttatgcaatttgtgagtacagagctattaaaggctgtagttttgttttggagaataagttgtctctttggactattgtagtaatctctttgtaaatgtttaatttttatcctagataagcaagatcttttgggctctctttcctactgttctgggatgaaagcatctaggaaatttagagggcaactccaatgagactgtctggctcacagaaatgaatcaacgatagaaactcgggcatgcggtggtggggggaagtggggtggaggtttgtgttaggggagtggcctatcagctttgacatgtgtggccatcacttatgcagtctccccatgaaggcaggtccaggtagctctgcagcagagctggggcaccgtgcctgctctcccaggcagagcctttggtgactactgctactaccaggaatagctgtggatagagaagagaacactggccactgtgtgggtgaccagaatcccagcccatacctcagtttcattgtcttctatggcacttcaaacccaaccctcaggaaaaccaaccaaccaaccaaccaaccaaccaaccaaccaaccaaccaaatacatccttaggagaaggatcagaactaacaatactgaaactttgagattttcgtttttaccttataaaaatgtattttggccaggcgcggtggctcacacctgtaatcccagcacttggggaggccgaggcaggtggatcatgaggtcaagagattgaggccatcctggccaacatggtaaaccccatctctactaaaaatacaaaattagccaagcatggtggtgggcacctgtaatcccagctactcgggaggctgaagcaggagaatgacttgaacccaggaggtggaggttgcagtgagccaagatcacgccactgcactccagcctggcaacagaaccagactccatctgaaaaaaaaaatgtatttcaagttactgcatactcatagctatatatttcacctgagatttacctggttaaataacttgcctgagaacacacaagtagtaaattatagacttaagatttgaaattgaattagtgtgtaaaccaaagtccatatctaagctgggtgcagtggctcacatttgtaatcccaacaactcaggaggctgaagcaggaggatcctttgagcctaggagtttgaggctacagtgagcaatgatggtgccactgcactccagcctggacaacagagcaaggccccatcttttttttttttttgagacggagtctcgctctgtagcccaggctggagtgcagtggcatgatctcggctcactgcaagctctgcctcccgggttcacgccattctcctgcctcagcctcccgagtagctgggactacaggcgcccgccaccatgcctggctaattttttgtatttttagtagagacgaggtttcgttatgttagccaggatggtctcaatctcctgacctcgtgatccgcctggcaaggccctatctttaaaaaaataaataaataaaatgtaaaaagcctatgcctagttcactatataatgatcctatccatggtaaggaaacacctttcatgattatcagggcatcctttatgagcctaactgagagagagaaaggaaggtatggcaggatgggagtgtagtgggcacagtggtgtgttgggaaactgataatctaaaataagcaataaagcaaacagcataatgagctctgatttggagtgttttcctattttctatgacaggaatattcccatcatggccaatttcaagcttccaaagtgaggtcattgaatgtggagttgaaaagagattgcacaggctgggtgcggtggctcacgcctgtaatcccagcactttgggaggctgaggcaggcagatcacctgaggtcaggaattcgagaccagcctagtcagcatggtgaaaccccatctctactaaaaatacaaaaattagctgggtgtagtggcacatgtctatagtcctggctgcttgggaggctaaggcaggagaatcgctggaacctgggaggtggaggttgcagtgagctgagatcatgtcactgcactccagcctgggtgacagagtaagactccatctcaaaaaaaaaaaaaaaaagagatgcacagaatcagctcagacgaactggcttccacatgccactgagcagggagcacacatgtggccaagggaaagaagggtgaggggtggtcagggaaggagtgcattgctcatagcaggtgcaccaggcaaaggacactcaaggaccccaactcccttgcctttactgtggcagctagctgccttggtggcccccatgaactgcaccccccaaggttcatgccctatgcagttttatccccttgggctgagcctgtgacttgcttaaaccaacagaatgtggcagaagtgatgctgtgcaggttctggagctcagccttaaggtggtgtagcagcttctgatttagcactctcagagctttgagctgccctgtgagaagcctatctaccctgctgcaacagaccatgtggaaagaccacacagagggaccatgcaaagaagcagaggccctgacatcacatagaggagagtcaaggagtccatccattggaggaaaattggggctccagacagatgaccctcggagagccatcccagcagaggcaccacacttgggagcaaagagcccaccttgaggattcctgctgtgcatcatctgaattccagacctgcagaaatgtgagaaaataaaatgttgttttaagccactgcattttgggacaatttattaagcagatattgacaactgaaattattcttttttaaccaatgcaggaatcttatttttacttaacctatgatgttttatggtcagagtggaaagggaagccctgcccctgaagtcatggatgcaccatggaacccgtggggacagtcaaggtcaagtcctccaagtaactggcatgctattccctgcttcctgtgccttcctcctggtctcataaaaaaagtgcatgagaatatcatgggtgatggctttagcattggatatcaccatttccctttgcagtgacggtgtttccaattgaccaaaagggaaaaattaggtagagagcaaagagttctctacatgattgttcaagaaacagaaataaagtatcaagtctgtaagcccagggttctttggagtagtatcattcttaccttggtgacagtttggtgaggattttactgctgcttccttctcctctcatcaactaaacaagaaactatgaagtccctttcctcaaggaaagggactgtcctgatagaatacccgacctatatcatgacttgttggaatattgtgaaagcacaaaattgagagaaaaataaagttatccaatgtttagatgctgaattacactgttgtgtaaccttgattggccactacctgtgaggtgagacactggagttagccattgtgaattcaggagtcagtaaacatccagaggtgtgaagcctgctgcaggcctccagttcccccagaaaacagtatctggttttaatgattttatcagagttgttttcaaggtcagtaagtttgttgatattttggtcatgagattagtgcgaaccaaccacatattggcatttaaatgactagggagataagatgagtgatgatatcataacaatagaacatattgatgatttcagagcagtaaaaaggctgaaaatggggcaatgatacttatattaaagacaaaataggaggaaactttcagcctttgaaaaattttcatttgaataaaactcatcacatgatactccccagtgtaccacaaaggagcatgtacattctgctgtccatttttaggagaaagaaaagtcataaactcaggctgccacctcagttcaatacagttgcaatgtaatgtttgaagacgctctcaagtctttgggaatgaagtgaaaacgtccactccaatcttcttaccaaggtacaggcaagtgtacacttgggtcttgtactctacgtttaaagctcaaatttacttgggtcttgtactcttggtttaaagtttgacttcaagatggctcatgtaaactcttctagccaagtcttcatatgtaatttgtggataattttatctctcttactacctacctgagggcattgttttaatgctcagaaacatacagaagggattgacaaagtataaattgctattcaaaaacaggggggcctagtgacaggtgagaaaacagtgctcctcagaaaagatcacccccatcctgctgaagtctttgaataggcaacccagacaatttaggcctgacattgtagctctttggtgaagaccaaataaaatgggattggaggagaagataacatattttcaattcattttagatcatttgcatcatctgcattaggtgtggcctaatttgtttggggcttcaggtgtatgaaccagtgctcattttcatattggacatagagctggggagatagaatggccagtagtttgcaggtgttatatcattttcctgtgatgataaggacattgcctttcttatggccattcaattacattttttgttctcatttaaagtaatcagagtttcatcgtgacgacttctatgtaaatttgaatgttacatgaggtgtgtaatggaataaaaatggagttacaaggactcctgttcaattgccaacatgcttcttttctattactagagatcgtagagtggctttggggactaagaagcttagacattattttgtaccttatcattggccatttttgtgattcccaaggtgatagattggtggccattcttctgaatagcccttccaaaagtcttggtatttttggctcagagtctttgcagaattgcatcatcatgaatttttacttttaagatagcacctgttttgtcaatcctgtgagaatatgtatttcataacatgtagccacctatgggattaagtaagtactgaggtccttgagccatttccaaatgaaaagagggtatgatttatcagggcagatccagtagttcaggggcagagctaagttctgaggtacaataaagagaaacgtaaaagtaggaacccacatttcaaccatttcttcttgtttttgaggatttaataggaaagatttttagactttagttgaacaaaacagtaagataacataaaatcagactccacttaaatgcttagtttggttttgtggaactggagcagctcatggggaaatgctaattggtcaaaatagataaataggaattccacagagtctgtgagaatgattagattttaatataaggcattactcaatagtagagtaaggattagtggagtggtacaagaattatagccattgtctaaatgcaaagatttttcttcatttttacaagaagaaacttgtgagctgactaaagttcaagtttagtatttcaaaccagtgagaggaccatgtttcattccacatgaagcttggttggccatgcaggtggaattttatcaaacaacacatttaaaattttactttcttatcatatttgactattgaaaacatgacccctccctgcaactctgtttgtgttaaagcatctgcggttaatggctttctgcttcttgtattgcaaagaactttaaaaagagatcattctctgaaaataagtaccttgctggtaaaatgagtttaacttggcaagctctgtcattttttgttgttattgccatcttatgttctggaagtaattcacattagtcatcttttagaaactctaagtcatgtcttccctgtcagatatcatgctctggtagcaatttattaaatatttcctgctaaaaatgaccccaggagatagtagttaacctactcttgagtgtaataatagaatcagagattgatgaacaattttcgccaaatattttaagtaatggcataaaactaaaaggccatgcattgcttgtcttagaaaaacagtacggaacatgttagaatattacgaataaatgaacactttcatttatgagctgtatatagaaatcattgagtttctctgccagagttgcagcctgtatggtagttaatcttctcgtggcacttactgtataatgcaatgcctctttgggcaatcttttgtgttaaaatacagcatttaagctccttctctccacaaagcattgcaagaatgaattgttcaatctctcttttttttgacatcatcctagaaattatttcagaaataaccaagatggtaattcccatttaatatctttctttattgctcattggaaaatagaaaatactttcaaagcatataaaattattggaaaattaacataaccctgtattgggagcaaaattattcctatctcagcattgccacccatctgagggacccagagcaagtcatttaccatccctcaggttgtttttttgtttgtttgttttttgagacaaagtctcactctgtcgctgaggctggagtgtagtggcacaatctctgctcactgcaacctccacctcctgggttcaaatgattctcctgccttagcctcctgagtagctgggactacaggcatgtaccaccacgcccagctaatttttgtatttttagtagaaatgggggtttcaccatgtcggccatgctggtctcgaactcctgacctcaagtgatccacccgcctcggcctcccaaggtgctgagattataggtgtgagccatcgcgcctggctgcttagcttgctgttatcattattattttaatcattaaaatgaaaatattaattttgtttcaaaatgaatggtgcatgaatgaaggaggtagtccatcttcttcctaccacccaaatgacagatgatttcttttcaaaatgaaggaaatattaatttgatgacctcaggattacttccattttaaactatccttctgtgtgtttaaatcgctttcctcatttttattttcttctatcccattccttcctattatattctaatgacctcttattttaaactccaaggaatgatggtccaccccagattggcttgtgatttcttcctatacagaggctttgtcatcctcattgtggccatatgccattcctcagtatgtaaagaaggttgaatggcagggatcagccgggtctagagaaaatctcagaccccatgacagtcaatagataggaaagacataggttgaatcagatagtgcaaaatgccatacctaaaagaaaatccccagaggctctttcaaattgtgagggagatatcttttgattagaggcaaatagcactgtcagcttgaagtgagcagactaggacggctaccacaatcatctgtgaaaattgtttaatacaagtgctaccttctcataaatcacaagggtaagctcatttaaaatggacatttattctgatttttgatccatattggcttaataaaagaccaactcataaggtttaacagttcaattaaggatttttcaagataaaggattatagataggaaatttccttgtgagctgggttagaatccatgggttgttaagtttcttttccgtgtggtaagtgggaaaacatatgctgtaggaggagatatagtatgcacttgaaagtaaagtgtaactattttttaaattaagatatgaccatttttaaaatttcttggcttaggaaaaaaattgaacatgcatgtttatatagaaatgttagaccatacatagcgttattattttgatgcgaaaggatgaaaattatctgcttttggtcaaaagagaggaaatcactcaaatcctttgggacactcatttataagctctatgaaatctttggtaaaatgaactccagaatttatgcgacttcctcaagaaaaagtagcttatttttaaaataaatcataataagtaacattattattattctcactggtggtataaggatcattaataaaatagagtctctgtgatatgtgcattctaatataaaatatacatatattataaatgttctgcatcgagtgaaatacccatatttatgaaaggggttgcatgggatccatcagcaccttgtaccatgaaagttaagaaactctaaatctataccacgagcatttgaattttctggcatttaagggagaagggaaggaaggtatcgtgatggagatggggtgggaaggaattgtaatgatctgctttttatttcttttatttgtgtgcaactagcacttcgaaagaacataagatagctgtaaccttctctgctaaaccaggaggtgaacacagatgtctgaaggaggctttataaggaagtgcataaagctttagaaggttcagaggagaattgagaggtcattgagagctgagatggagagggcttcatggagaagtctttacttgaatgattcccaagaacctagattgaatctagacaagggggaagactcatctctcatcacaccatactgacccactcctgcagctgtactgaatcttgtttcttctagtaaaccatgaccttctaacctccaggctttcacctggaactctttcccttccactactgcctgggtaatgactttgccatcacagttctgtcaagttaggactttcttcagaaagtttcctgtgaccttttccagccctctgacaatttcagtttgttgctcttttttgaggggctgagaaatctgcatgcaccgacctcatcactttgatggggtcagtttgctactcgatattgaaatggactgtttaggccttgatttcctcctatagactgttggctcttccatggcagagtatgtgtgttatttaccactttatccattgcacagtgcctggcacttattagttatcaataaatgtctgtatatttatgaaggaaggaagtaatgaaggatgaaatgaatagggcatgacctacaagggaaaagtcacacaggtggaaatgatgagttggcccaaagacaatgagatgattgatggacttaaactttaactctgatgtcattttctcctaaatgtgcaatatgccataatttttttcagtaaactaggggttgagacatttttgctacttaaatagagacagaaaaataggataaattgaaaatattttccagtggtaatttattagatgcctgtaaaagaaggaacatgaggttttcagggttcaagtggatgtctcattcttcaacacaaaaacacttggagagttgtataaaagatttgaaaatcactttagaaaacaggggctacttggggaagggagttgccaggaaaatgccattattgcaaaaagttcatttaaataggcttaatatatctacctatctagtgcccactatatatataaagcagtagaagggccagctgaaactagaataggtagtagaaaggggctttcaaccaaaagccacaattattagtcaaataaaatacaatttgttggccgggcatggtggctcatgcctgtaatcccagcactttgggaggccaaggtgggcagatcacatgagaccaggagttcgagaccagcctggccaacatggtaaaaccccgtctctactaaaaatacaaaaattagccaggcgtggtggcgcacgcctatagtcccagctacttgggagactgaagcaggagaaccacttgagcccaggaggcagagattgcagtgagccaagatcacgccactgcgctccagcctgtgtgacagagtgagactccatctcaaaaaaaaaaaaaaaaaaaaatacagtttgttgtatatatcataattgacaggacaagaccctgtctcaaaaaaaaaaaatcaccaaggaactttctttcttttatatttctaaagctagtttcttttttttttcttttttttttgcatttttttccattctgtgatggcaaaagaaaatctaaccaaccccaggattttcttagtcacttcaagtttgaatgcagccccttcagaattgctcctcttagtcttctctctgggactccagcccagggagcagctctatcacttaataatagtgtgtcttgagcaacttgttttatatatttgtgcctccatatctcattgatgaaatagatttaataatacctttctcaaaagatcactgtgagtattgaattacatgaaattgtatatatatatattttatatatatatatatcgcatagtgctgacaacataataagcacgtgataaatgatagcagctgctgctgcttctcttcctcttcctgttactatcacggtgatcaacaacatcatcatcataagttccaaaatggaagggcacagtgccttggagcatctggacaccggtcattgactttctattctgacattggttgtcctttggtcattgtcctacattcccatttgcatctgctgaggtttctgtcatgccatactctgaatcttcctcaaacagaacagatgaagcctcctcaggttggccagtgctccctgggaccacaggaagcttggggtgcaggaaggctgacttagactttgtattcttgacatactctggttttcaagtttcaggctacaaatttctgttcctctgcaattgccctggactcactgggaatttctaatgctcccgccacatgcaacatttgctaggtggtggcagcaggaggtgcaagtgtggggagcagggtggaaaaggactatactaaactcctgagctctcttcttcagctttcctctttttttggttaagtttaggaaagctggttgctcatctgttggttatacactcaggtttttgaaactcaaatgtcctttctctcaacttactgtctctctgtggaatttcaaaagtgaatgtagaaatttcagcaagaatttcccatcatttgctttctgtcctgctataattgtcatgcccattgcctgaggccatggtctctgccatgagtttagttttaacaagcaaaaagtaatgaattatcaggcaggaaaataatttaggttaatagtaaaatatttccttgctacatgacaaggtgaacagctgattgccataagagatctaagaaacactaaaaagtacaaaaaaataggacattagttgtcctttggacattgtcatatattcccatttgcattttctgaggtttctgtcgtaccatactctgaatcttcctcaaacagaacagatgaagtctcctcaggtcagccagttctccctgggatagaggaaccagggaagaatcaatgcatagaagcgtcagtattggaaatgggtcttgaaggagcaatctgatattgacagcagatgtatcagggagggaacacataagcaaactcatagataagtgaacatgctttgagatgtttaggaaaaagtgaagaatgtggtgtgttcagaatgtagattcccagggctgcttgattggcttcaatatgtgaagaatattgaatgccatagatttgtgattccatattcttctaaatataagttttaaaaataccttgatatacggaagaaaatgaaaatggcctctacacttattttgatgcatacaatgtgcgtgaactttctgaaagtgaatttgacatatatattctcaaataaattgccttttctttttcagtgggtcctatgccatatgaatgtgaagaggcaagggcaaggaattcacacaaaaaagatagagggggtgtttatggtcattaaaatatgaaaaacgtaaggtgaaatcttaacaacggttagtaatgctttttaataagcagctaatgccaatcactgacatttatcatatgatgtgttgtcgtggataacaagtatttattgctcacttaacatgtgccagtcatttcgctggatactaggaggacattgttcaaaaaggtagattgggccgggcgtgatggctcacgcctgtaatcccagcactttcggaggccaaggcaggcagatcaccggaggtcaggagttcgagaccagcctggccaacatggcgaaaacttgtctctactaaaaatacaaaaattagctgggcatggtggtgggcacctgtagtcccagctactcaggaggctgaggcaagagaattgcttgaacctggggggtggaggttgcagtgagccgagatattgccactacagtctagcctgggtgacaagattgagattccgtctcaaaaaaaaaaaaagatagattgggccctgctccttggaccttagcttttagagtgtggagtcacacaataaatctggacaaacataaattaaaaagataacagattttcataagatctgtggggggaaaaacagcattgtgattgtaatagagaacaactggggagcttcatgtagacaaggtgatcagcaaagatctgaaggagaaggttatatttgaattacaatctaaagaagaaggatttagccctatgaaaaatcagagggaagcattcaggcaaagaaaacatctagtaaaatttctaagattggaataagcttatacattcaaagactacatgggaggcagcaggcgagtgagccctgggggaggagtggtctggaaggacattggagaggcaggcagggtacagaccccaagggtctcaggtggaagtatatctgggagcaggggacaccttgcctcctctaaacactttctccaaaaggagaactctctaatggttggtgacgattatgaaaagatatggtggagaaagccctgtgagattcacagtgttgacatcagaagtcagtccatggggccagcaaaaggtgttgtcctctgtgataatcagttctatcccaaccaaaggcacagcccctccattcaccattgctgatcacaatcaggctgtgagaatcagctcgagcttagcctgcaagtcatggtcaggaactctagttgtgagtgcaatgaaaaaccatctaatggttttaggtagaggagcgcatgaccagacttacatttatgaaacatctgtgtctgctgtgcgcagaatgcttttggagacagggagaatggatataatcagggcagccaggaaggagacaattgcagcaacaccacaggtgaaggcagatgaatggtgctctaggatattgacaattagtatgacatgtggcagatagttttgtaggtagcatagacagtttttgcaggataatctgggatggcaagggacaaaaggaagggaaaaatcaaggatgattcttaggaatttgatttaggaaaatgatgcactgtggtggtgtgatttactgagatagagataagaaacaagttaaagttccattttagtcatgccaagtatgggatatctctaatctgactagagtagagaccaagttggcatttggatatagggtgagggcagcaccataaggatctgaatgtcgagggaccagactgggctggaaaaatacatttggaagacataggcacatggatgatatttaaagccatgggctgaataaaagcacatagagaatcctttctttttaataataactgtgagtatgaatttttgaacaccatgaacccacccctttccctagtataatgtctccctgaataagtggaatgttctgtatacactaaattaaacaactgtggtcttgcctctaaaaactcaaaatctaaaatagaccatgatgacatgaccaaccaagactccatctctcctcttttccctgagcctttgtagtaataactcatcctagtattacagtctgcagggacctttatatttattatgtcatttttcttttttgtccttgcagccatccttgaagtgggaaggttgtgtataatctcttatttgatggactgagcaagtctctaagcaggtatttttattcctactttaggtatatgagaatgcaggccccaaaagattaagcaacttctctggtcaaggttacaaaagtagtgagtgggattgacagagggaaagttgctctgacttcagagttctaaggggtctagttttagatgaaaacctcctggatatgtcaatcttcccaaagaaatagagcagcaattaagagcaactagactcaataagaattgagtcatttccctgctcttcatttgttagttggctgaccttggatgtaacacaagcatcatagccttgatttttcaatctgctgaacaggatgctattatctacctctcaggttatttgtaaattaatacatccatctatttactcaactatccacccactaatttattttttcatgtatcaaacgtattatatactaaactcctactatgtgccaggtaccattttaggcattgggctacatctatgtagaaaataaagcgctgcccttctgggacctgtatcctttggaggaagccatcaatgactagtcaacaaattaatacaaactagaacattagatggtgacaagagaaaatatagcagtcctgtggctcatgagaaattggggaaagcttctctaagtagggacatagacaaggattaaatgagataatgcatggaatgtgcttagcatggtgcctggcgctcactagggagccacacagtcctggaaagagaagagttgaaaagcaaacatggatgttgcccagtacttcttgcttgctgcccagcctagagagagcctctgcttttggggttctttcctcccactggctaagttatgagataatttctgaccgctttatcctatgtcattgagcatgtaatgactccaactgctgtttttctgaatctgttctcaccaaacaccttctaatcatgatttaatttctcatgtcaacctgctcacctgcagagaatattctgatcatatagttttcaagtaccggacctcggttcttagatacttttcattatatgatcatatagagacactctaattataattgggtttcctgtgtagtttggccacatggagagaatatgctgatcggatggactttgattattctagttcctgtgacagcttttgctcattgtacgttaagcagctgccatcctgattgaacacactcacctcctgaacttaggtaatgtcagggcctgccatgcggtaggcactcagtgaatgtctactgattgatggattgagacttctctcaggcccatggcaaaatcaaacttccaagggtaaattcaccagggggatgatgaacataaccctcctaggcctcccaagagccagcatgcctgtctttcccaggcatccacccactgtcacttcatagactgagcacaggggccattttttctatatcagcaatagctttgaactcttgcttcaacctattccagggttgagggggaaaattagaaagtcaagcagggtgacagcagaactgtgaagaactgtgcttctcactccaagtaagcccagctgccaggcaaattcaagagcagaggtcccaaatgcagttatatttctgggagcaatgcttccctttatcttcagagccctggaagcgcagagaaaagaaggtgagggcaggggtagggtggtgggacccacttggctcctgttgatggtaaagaagtacaggacctcaagtcctaatgacaaaagtaatagtaatatgattcacttatgactcagcagacattacacttcatacttgatcctatcatttcccttaattttacccacccaaaggccattgcatatattagctggtgatagggtttggctttgtgtctccactcaaatctcattttgaattgcaaccacatgggtagggaggagcctggtgggaggtcattggattatgagagcagtttcccccatgctgttctcatgatggtgaatgagttctcatgagatttgatggtttaaaagtgtggcacttcccactcttctctctctctcctgctccaccatgctaaagacgtgtttgcttcccctttgccctccgccatgattgtaagtttcctgaggccttccaatcatgcttcctgttaagcctgcagaaatgtgagtccattaaaactcttttcttcatagattacccagtctgaggtagttctttatagcagtgtgaaaatggactaatagagcttgaaaccctcttctctttgattcaaactgacaattttcagaaatacataatgacaatttctggctttggggctaaacaaacactacgcatgaactcattggtttctctgtgaaacagagcccagtcactttatctctctgcgcttcacaccaagagatagtgtcttgtatcctattaggtatgtagtagtattttgctgtttgctacctgtggattcattcctcctgtggttcactttctataactattcttgagggcaggacttgatgattggcaactgatagagatttccattcctctactttcccagctcactctcttctcacatttactgctggctacttgccctgtgaagccgagcagaatctggaaacttcatcttcactaagccatcaataaatggagaaaactgagtaaatataactgagacccagttgttaaaaacaagagaccatcactgatcatcactgatttctttcctacaggtcatgttgtcactcgtttcttttatttcttttttaaaaattattattattattttcataagttattggggtacagtggtatttggttacatgaataacttctgtagtggtgatttttgagattttggtgcacatatcgcctgagcagtacacactctaccatatttgtagtcttttaatcccttgcccccctctctctcttccccccgagtccccaaagtccactgcatcattcttatgcctttgcatccttgtaacttagctcccacctatcagtgagaacatacaatgtttggttttccattgctgagttacttcacttagaataatagtctccaatctcatctaagtcactgcaaatgctgttaattcattcctttttatggctgcatagtattccatcatatatatatctcacagtttctttagccacttgttgattgatgggcattttggttggttgcacggttttgctgttgtgaattgtgctgctataaacatgcatgtgcaagtatctttttcaaataatgacttattttcctctgggtagatacccagcagtggaatttctggatcaaatggtagttctacttttagttctttaaggaatctccacactgttttccatagtggctgtgctagtttacattctcaccagcaatgtagaagtgttccctgttcaccgcatctacaccaacatctactggtttttgatttttttattatggccattcttgcaggagtaaggtggtatcacattgtggttttgatttgcatttctctgatcattagtgatgttgagcattttttcatatatttgttggccatttgtatatcttcttttgagaattgtctattcatattcttagcccacttttggatgtgatgtttgtttttttttcttattgatctgtttgagttcattgtagattctggatattagtcctttgccagatgtatagactgtgaagtttttctcccactctgtggattgtctgtttactctgctgactgttccttttgccatgcaaaagctctttagtataattaggtcccagctatttatctttgtttttattgcatttgcttttgggttcttggtcatgaaatccttgcctaagctaatgtctagaagagtttttccaatgttaccttctagaatttttatagtttcaggtcttaggtttaagttcttaatccatcttgagttgatttttgtataaggtgagagatgaggatccagtttcattcttttacaagtggctagccaattatcccagcacaatttgttgaaaagggtgtcctttccccactttatgtttttgtttgctttgttgaagttcagttgtctgtaactacttaggtttatttatgggttctctattccgttccattggtctatgtgcccatttttataccaataccatgctgttttggtgactatggccttatagtgtagtttgaaatcaggtagtgtgatgtctccagatttgttcttttttcttagtcttactttggctatgcaggctcatttttggttccatatgaattttagaattttttttctaattctgtgaagaataacagtggtattctgatggggattgcattgaatttgtacattgcttttggcagtatggtcatttttacaatattaattctacccatccacgagcatgggatgtttttccatttgtttgtgtagtctttgatttctttctttttttcttcttcttctttttttttttttggagacagagtcttgctctgtcacccaggctggagtgcagtggagcaatctcaggctcactgcaactcctccatctcctgggttcaagcaattctcttgcctcagcctcctgagtagctgggactacaggcatgtgctaccacactcggctaatttttgtatttttagtagagttggggtttcaccatgttggtcaggctggtcttaaactcctgacctcgtgatccacccgcctcggcctctcaaagtgctgggattacaggcatgagccaccaagcccaaaagtctttgatttctttcagcagtgttttgtagttttccttgtagaggtcttttgactcctttgttaggcatattcctgcgtatttttttttcagctattataataggggttgagttcttgatttgattctccacttgatcactgtttgtgtgtagaagagctactgatttgtgtacattaatcttgtatctggaaactttgctgaattcttttatcagttctaggagctttctggaggagtccttagggttttcaaggtaaacaatcttatcatcagcaaacagtgacagtttgacttcctctttaccgatttggatgccccttatttctttctcttgtctgattgctccctctaggacttccagtactatgttgaagagaagtggtgagagtgggcatccttgtcttgttccagttctcagagggaatgctttcaacttttccccattcagtattacattggttgtgggtttgtcatagatggcttttattacatgaaggtatgtcccttgtatgccaattttgctgagagttttaatcataaagagatgctggattttgtggaatgcttgttctgcatctattgagatgatcatgtgattttttgtttttaattctgtttatgtggtgtatctcatttattgacttgcatatcttaaaccttccctgcattcctggtatgaaacccatttgatcaaggtggattatccctttcagatgctgttggattcagttagcttgtattttgttaaggattttagcgtctatgttcatcaaggatattggtctgtagttttcttttttggttatgccctttccttgttttggtattagggtgatgctggcttcatagaatgaattagggaggattccttctttctctatcttgtggaattgtgtcaaaaggattggtaccaattcttttttgaatgtctggtagaattctgctgtgaatctgtctagtcctggagtttttttttttttttttttggtaattttttagttaccatttcaatcttgctgcttgttattggtctattcagggtatctaattcttcatgatttaagctaggagggttgtatttttccaagaatttatccatctcttctaggttttctagtttatgtgcataaaggtgtccatagtagcctcgaataatctttttttatttcagtggtgtaggttgtaatatctcttgtttcatttgttggtaaggttatttggattttctctcttcttttcttggttaatcttgctaatggtctatcaattttatttatcttctcaaagaaccagcttttgttttatttatcttttgtattgtcttttttgttccaatttcatttagttctgctctgatcttgggtatttcctttcgtctgcgggtttgggtttggtttgttctagtttctctagttccttgaggtgtgaccttagattgtctgtttgtgctctttcaaactttttgatgaaggcatttagggctatgaactttcctcttagcactccctttgctgtatcccagagattttgataggtggtgtcattattgtcattcagttcgaagaattttttaatttccatattgatttcatttttgacccaatgctcatttaggagcaggttatttaatttccatgtatttgcatggttttgaaggttccttttagagttgagttccaaatttattccactgtggtctgagagagtgcttgctataatttcaattttcttaaatttattgaggccccttttatgtcctatctaatggtctatcttggagaaagttccatgcactgttgaatacaatgtgtattctgtgcttgttggatgaaatgttctgtatatatctgctaagtccatttgttctaaggtatagtttaaatccattgcttctttgtggactttctgtcttgatgatctgtctagtgctgtcagtggagtacagaagtcccccactattattgtgttgctgtccatctcatttcttaggtctattagtaatcgttttataaatttgggagctccagtgtcaggtgcatatatgtttaggatagtgatattttcctgttagacaaggccttttgccattatataaagtccctctttgtctcttttaaccactgttgctttaaagtttcttttgtctgatataagaatagctacccctgcttgcttttggtgtccatttgcatgaaatgcctgtttccacccctttactttaagtttatgtgagtccttatgtgttaggtgagtctcctaaaggcagcagatggtttgttgatgagttcttattcattctgcagttctctgtctttcaagtggagcatttaggacatttacattcaatgttagtattgaaatgtgaggtaccattgcattcatcatgctctttgttgccagtgtactttggttttgttttttgtttttgcttgtaacttgtatttttgttttataggtcctgtgtgatttatgctttaaagagttctgttttgatatggttccaggatttgtttcaagatctagaactccttttagcagttcttgtagtggtggcttgataatggcgaattctctcagcatttgtttgtctgaaaacgactgtacctttccttcatatatgatggttagtttccctggatacaaaattcttgactgataattgttttgtttaaagaggctgaagatatggccccaatcccttctagcttgtagggtttcttctgagaaatctgctgttaatctgataggttttccttcatgggttactggtgctgctgtctcacagctcttaaaattctttccttcgtcttaactttggataacctgatgacaatgtgcctaggtgaagatctttttgtgatgaatttcccaggtgttctttgtgcttcttgtatttggctgtctaggtctctagcaaggccagagaagttttcttcaattattcccccaaatacgttttccaagctttgagaattgtcttcttcctcaggaacactgattattcttaggtttggtcatttaacataatcccagacttcttgcaggctttgtttatattttcttactccttttactttgtctttgttgtggattgggttaattcaaagaccttgtctttgagctctggatttctttcttctacttgttcaattctattgctgagactttccagagcattttgcatttctaaaagtgcatccaaagcttcctgaattttttattgctttttctttaagctatctatttcattgaatatttctccctttacttcttgtattatgttttggatttctttgcattgggctacgcctttctctggtccctccctgattagcttactaattaacctccaggattctttttcaggtaagtcaaggatttcttctcggtttggattcattgctggtgaactagtgtgatttactggggggcgttgaagagccttgttttgtcatattaccagggttggttttctggttccttctctgggtaggctctgtcagagggaaggtctagggctgaaggctgttgttcatattttttcgtcccatggggtgttcccttgatgtagtactctccctctcttcctgtggatgtggcttcctgagagctgaactgcagtaattgtctctcttctgggtctagccacccaaggagtctacctggctccgggctggtactgggtgttgtctgcacagagtcctgtgatgtgaactgtctatgggtctctcagccacggataccagcacctgttctgctggaggtggtggagggtgcaatggaatccgtgagggtccttagctttggtggtttaatgctctgtttttgtgctggttggcctcctgccaggagggggcgctttccagaaagcatcagagccgccgctgtgtcccctgccacagccccgagtttgtttccaggcggagggtgagacgggcctgaaaacttgcccaaggccatccacctcccagctgcgaaagaaagggctttagttcttccctcctccacctgtgacgtctgcactccggatttgtgccctcccctgagttcttgccaggaggcttctcagctcattcaaattgttacaaagttcgactagagaattccttctccctgtggagttttaccccctgctcctctggccatccttccaatggatccttgtggtgccaggcaggaatgggctgcttggggacctaggaagcccccagggcctttctgctgcttcttctaccctcccccacacctttactcgactcactaacttgactcagctccaggtaaagtcagaaatttctgcaaacagaccttcagcttctccagtgggggtgtgtgtttgggagaggagggtctccctttctcagttccgcagttggggcactcaatatttgggggtctctcgggtcctgcaggagcagtctgcttcctacagagggtctgtgagtcctttcgggattgctggtttgttcttgcagttctgaagctaaaattcacaatgcaagcctctgcatgctgctctgtctagagctgcaatctggtcttgcctcccgtctgacatgatcccaggagctctctgagagagcaacccaaaggagctgagagagatccggagtccccgatgtgagggagcatcaggctgcaaggacgcggcactggcgatggtttcgcaggggcatctgttcccttggggcgtggaatccctgctctgccgctgccccaactcggctccgaagtgcctttgctgcaagatttcctgagcttagcagtctgcccgtttcttttctttctttctcttatttttccccctgaatgtttggtttctctggcaagcccaaacacgtaagattatatgtgaggcatatttatttacataaagatgcgtgttttttcttaactcagcatttacatgtagcttggccaagttaattaactgtagaagacctcaattttgttgtcttttaaaacaaggcagctgtattagattagtggttttcaaagtccgttagatggtaaagtgcctgcaagccatggcctgctttgtgggataccatgaaatattaatacccagagctagacttaataagcacacgtataattttgtgatcccaaatactatcttatatatgattgtaatagagacaaaagttagcatgtatggagatataaatcattaattcattcatctatcacataagtgttattgagtgcctacacaaatgtttctcaaaccagcattcaccacctggagaacctattaaaatacagatcactgagccccattcagctgtttaaccgacgatgctcatgttggttcagctgatctgggaaccaaattttgagaactgctgacctccactagtccagcccacgaattggcaaactacagcccctgagccaaatctggccctttcttctttttgtaagtttcactggagcacctcacatttatttatgtattgtccatagcagcttttgtgccacaatggcagagtttagtagttgtgacagagactatggcctggaaacctgcaatattatccgtgattttccacacaaaaatctgcattctgggttttgtatgcaataagtcatgtacaaaagtatggagctgatgtcctgatggagcttacattctaacagggcactaaaaatttagtgagatttaaagaaaagttataagagaacatcttaattgaggtattctactttcaattattcgtaaccttattattatatatttacttcttttaaggataacatcttcattcatatttctataactctagcgcatgttccaatggcttcaagtttgcatgattaaaatatctctaaactattcttttcctctcagtactttctcctttcagtgtattctaggtaacatttccagagaaaatatccttaatatagttatgaattgatgattgcctccagaataaggttttttaaaagtaattttgactttattttagattcagggcgtacatatgcaggtttgttatgggagcatattgggtgatgctgaggtttggggtgcagatggtctcatcacccaggtagtaaatagtacccaataggtagtttgtcaggctatgcccccttctctttctccccaaccagtagtccctagtgtctattattcacatctttatatccacgagtactcactgtttagctcccacttataactgagaacatgtggtatttggtttcctgttcctacattaatttgcttatgataatggcctctagctgcatccatggtgctgcaaaagacatggttttattcttttttatggctatgtagtattccagagtgtatatgtaccacatttcctttatccagtctaccattgatgggcatctaggttgattccatgtcttcgctattgtgaacaatggtgtgatgaacatacaagtgcatgcatctttttggtagagtgatttattttcctttaggtatctaccccgtaatgggattgctgggtcaaatggtatttctattttaagttctttgagaaatctccaacttgctttccacagtggctgaactaatttacattcccacaagctgtgtataagtattcccttttctctgcaaccatgccagcacttgttatttttttaagtttttgttaatggtcattctgacttgtgtgagatgatatttcattgtggttttgatcagcatttctctgacgtttagtgatgatgagtattttttcatgtgtttcttggccacttgtatgtcttcttttgagaagagtctgttcatatcctttgcccatttttaagggatttgttgttgttgttgctgttgttgaattgtttaagttcttatagattctggatattagacctttgttgaatgcataatttgtgaatattttctcccattctgtaggttatctgtttactctgttgatagtttcttttactgtcaagaggctttttagtttaattagatcccacttgtcagtttttactgttgctatcacttttggggacttagccataaattctttgccaaggaaaatcaacgttatttttcacagaattagaaaaaactattctaaagttcatatggaactgaaaaacaaaaaaagagccaaaatagacaaagcaatcctaagccaaagaacaaagccagaggctttacgttatccaacttcgaactatactataaggccacagtaacctaaacatcatagtattggtacaaaacagacacatagactaatggaacagaatagagaacccagaaataaagccacacacctgcaattaattatctgatctttgacaaagttgacaaaaattagcaatggggaaaggacaccctattcaataaacggtgctgggatagctggctagctacatgcagagcatgaaactggacctctgcctttcaccaaatacaaaaattaatccaagattgattaaagatttaaatgtaagacctcaagctattagaattctgcaagaaaacctaggagatacccttcttgacagaataaagatctgttctaattattccacattgtgacaccaaaccatgaccactactatatcttccacctgacatttcccacagtctcagctctgcatggacctgcccagaatggagatagcaatgggcttaccatgttgacacagcctctgtcacttcctattttctctctgactcaggaaggagtcacttcactcttgtaattcttctgccagaaccctggaggtatcttaacttacaacccccagtctataaactctccactaaagccacactgattgactcaccatcttccaaataaactttattgattatttgctactaatatgagttactgatgactaataacagattatctcaaaattgtgttcttaacacaataatagattttcctttttaaatcttgtagtttccgtggggcagagtctggggagtggcttattttggtagttcttgctttagggtgtttcatgaagttgcacttacaatgctgatctggattattcatctgaaggctcagctgggtctacaggatcctcatacagtgaatgcaccgttgagctggcaaattggtgctggtattgctttggacctcacctcatgccacggaggctactcctcacagagcaagtgaggcaagaaaagaaaacataagccacgatgtcttattttgtaaatttttaaaatttactttacagtgtcttttaagatatagccccagaaatcacactctattatttcagcaatattatatttttgacacagatcagtcttaattaaagtggtaatgacacaggagcatgaataccagggggtgagaatgactgacaccatcttggagccacaccatcctaacccctcctactctagtcagggcttttgcctttgctattgttttcctatttgaaatgtttgtttgtttatttatttatttatttatttatttaatttcctaaatctaaccaccttttaatgctcatttctgttccatcttccccgtgacaccttctctgaatcctttagcctgaagaaattgcatcttccattgttctcctgtggtctcattatcaatatcacacattttagcagttactcacagataggaaataattcctgttcacaaataaaacattctgaggaactcagttcttcctattcgaggaaatcctccactactactacaaaaacctgcataaggcattgaaaaaaaaccctccgttagagattgagctgtattgtagtacataatatagtatgagtaatattaatatggtgtatttgatagatgttagagatcagtgtctaccagagcagtactactcaaacttaaatatttatatgaatcatgtagggacctagttaaatgcagattgagattctgtgggtataaggtggggttgagatgctgccattctaacaagctcccaggtgatgctgaggctcctggtccatggaacaacttttgagtagcaaggtgctagaagatggacataaaatggacataaaatagaataggagttgaaagtagatggaaaataaaagtagtgaagagaatcatggctgtgttcaatcagtagtactggcaaggcataaatatttgaagtcacgaatcactcaagtatttctttattgctctttggtactgcccattatctttatacatgcatgtatgttttacctcttccagccttgattataggcccctttaggattgaaggtgttccagtcacccatagaggtgaaatatagttccctttctggagtagttgctcaataaatgtgtactgcttgattactctgctgctaattctcacggtcatttattaatttctattattacttccccaagttttctcctttcaaaatattataggaaattcaaaatacctttctattataaattgatgtgttttatttacagttccttatgatatataatacaattcctcataaaaaaataaaattttagttggtctaaataccaggtaaattaacatgatcaaattaatagaaaaagtatcatgcccaggtaacatgtcagaccaattaaatcagtctttgagagaggattcaggtattggtattttttaaagccccatgggtgattccagagtgaagcaaaagttgaggatcaccagtttaattatcatcctactatattttaagatagaataattatactttattttttattgtgccccaaagcattttttttttaaatggagtctcactctgtcgcccaggctggagggcaatggtgcgatctcagctcactggaacctcggcctcctgggttcaagcagttctcctgcctcggcctccccagtagctgggattatagtcaccctccaccacgtctggttaatttttgtatttttagtagagatgggtttcaccatgttggccaggctggtcttgaactcctagcctcaaatctcagcctcccaaagtgctgagattacaggcacgagccatggcacccagatccaaagcatcttttacaacatgtaatttggaaatatcaatgaagaccaattcagagaaaaatgtttaccttcctttttttttcttacaggatgtagctgcttcaatttataaataagtatagatatgctatagtaatttttgaaattctatagcaaactaacttttccataaatgaatatggtttcttaattatcccaagcttgttaatgtaggttgtactttttttcttttagcaaacacatcagatcattttgccaaattatccaagtcattttaaaaacataaagatattttgcaaatattttatatctgccagtcaaagtcagtcttggtcctaaataggatgttgttacatgcctgccttataaatgttagcatcacggaaagcatttttgtttaatttagaaatgtttgagctcagaggaaataaggatacttatctcgtttactcagctttagtaactgcaaaaggcagaataaaggtagcttgctggagttgctagaacccacatacagtcagaatatatgacctctcctttaagctctgcctcttactagctgggtgacctttggcaagtctcttaacttctgttagtctccattgcttcatttgtaaagtgaaagggttgaagtagacggcacataagattcttatacctggaaagtgatggggtgagggactactaaggtcctttgagtgcttcttggttacgcactgtgagaagtgatggaaaataattcacactctcaaaaattccatgactctataggagaattttcaagtgaacaggcacaaagtctctagattgttaaattaagcctatgaaaaatgaaggaacataaaataaaaagagagtaattgcattggttctgattctctcatagaaaaggaattttacacgtcgttaattccaatgctttgtattacagatgaggaaaccgaatcccaaaaagttcaaataactttctattactaacacataaaatagcacactaataggggatgaaaatttatccagtttaacaatccagtccttcatgtcaatcaaaagcttctttatcaccatcataattcaacatttcattctgtattgagaaggaggtggatctaagatttatatttatgatattcatgataattcagagtttctgaaactgacatcacaggaagattttcacaagtgggccaggatgtgattcatgggccctgatgttacaagtccagattggcaaaccaagggctgctatcaaagggactaagttggatggctttctggataaatatttctttgtagctggatttacaaaggttatcaaccctccagataaaaagtcatggttcttctattgccctaagagtcatagatagtaagttacacagtaacatattcattttatgtatatacatacatacatatagtcatgtatagtaaattacatgaaaacatcagtggtgccatacactcacctgatcctgggtgacggaaacgagtatgaggaatttaagtagtccttctcaaagtcttccccagagatcaattagctcatcaccattttaccatgagggtatgctcaggggagatatgtaactaaagtcctgataacttgtaccaggtgactgtaaatcattcagtattcagttagtcaacaaaatcaacaaataattatcatgcctctatagtataccaggcacttgctgggcactgggaatatggtgattaataaataagactgtccatgcccccagcttcatattctagtggaaagggaaagatatcaaaacatgtttgcaaggctgggcaaggtggctcaggcctgtaattctaccactttgggaggccaagtcgggcggattacttgagttcaggaatttgagaccagcctggccaacatggggaaaccccgtctctacaaaaatacaaaaattagctgagcgtggtggcgggtgcctgtagtccgagctgtttgggaggctgaggcaggagaatcacttgaacctgggaggcacagagtttgcagtgaccagagattacgccactgcactccagcctgggcaacagagtgagactctgtctcaacaataacaaaaacaacaaatacttacaaaacgtaaaaaaaaaaatccctttagatatttattagtgtgataagaaagatgagaaagcaaatgccatagagaatagagggtgaagagcaaaggctgcatggtgtgagtggtcaccgagttcttctcttaaaggcagtgatgcttaaactcagttgtggagagggacgcagtgtcaccaagttctgagggaaaagtgtttcaagcagaagaagcagaaaatgcagtggtcctgagatgagaatgaggagctctgcacttctgccagaagaggcattgtaatagtattggagatttgaaatcgttattttactcaggcatttattaattaatatattatttattcatcaaaatacatgttgagactactgtatatcatggcctattcaagacccagttcccctgcccttgtgcagcttagttcctggtgggagacacagacaataaataatacccatagtaaaaagcaaattatataatttgtaggaaaataaggactatggaaggaagaaaaatttgggtaaggaggaccaggagcctggggatagggaggtcagggagggcttggctgagaaggtgacatgtgatgcaactgagggatgtgagggaattagccatgcaggtaggggaaagagcatcctgggaagtggggacagagcacagacatgctggagaaacagcaaggaagtcagggaggcggaaacagagcaagtgaggagaagatagtgggaggtctcaccagagagggagccagaccctgttcaataatgcctcgacttgagcccagcatgctggctcacacctgtgatttcagcactttgggagcgaggcagtaggattgcttaaggccaggagttcaagaccagtctgggcacaatatcaaaaccccatctctacaaataaaaaataaataaattagctgggcatggtagactggacttggtggctcacacctgtgatcccagcactttgggagctgaggcaggaggattgtttaaggccaggagttcaagaccagcctgggcaaaatagcaagacctcatctctacaaataaataaataaattagctgggcatggtagcacatacttgtagtctaagcaactcaggaggctaagatgggaggatcttttgagcctgggagtttgaagctgcagtgagctatgactgcactccaacccgggcaacagagtgacaccctatctctaaaaataataataataataaattcattgaataatgccaggagtttttctctgagaggagtggataggtattacagggttctttgatggcaaagaaccgaggaatcttattatccccacctataggaaaagcacctagggaggctggctttccatgcagaggaggaaccaccagggggcggtgcaccgcaaagtcgggctgtggtggccctgcagatggcggtgaacgggaggagcaggctggcttttccaggctcccgctatctaataagtgaatagcattgcttttctgggaaaatctttttaaatgttttttaatatagaagacttttaaaaacattgaaataataactgtacctataggccaggtgtggtggctcatgtctgtaatcccagcactttgggaggctgaggtaggaggattgcttgagactaggagtttgagaccagcctgggcaacatactgagaccctgcctctacaaaaaataaaaataaataaattagctgggcatgatggcacaagcctgtagttccagctactcgggaagctgaggtgggaagattgcttgagcccagaagttggaggctgcagtgagctataattgcaccactgcactcccgcctaggtgacagagggagacctcatttccaaaagaaaaaacaaaatatattataatatttatgaggtatgtacagagttttaatacatacaatgtattaaagatcaaatgtggataattagcatatttatcacctcaaatatttgtttgtgtagagaacataaatcctctcttctagctatttgaaaatatataattgtttactgtagccaccctataatactatagaacactagaacttatttgtcctatcaggctctaattttgtattctttagcaagtctctcactaaccctccaaccctactacctaattctcagcctctagtaaccactgttctactctctacttctataaggtcaacttttttagcttctacagactctgatttaaaaacgggctaatgatccgtacgacacttctcaaaagaagacatacagaaatggtcaagaaatatattaaaaatgttcaacattgttaatcaccaaggaaatgcaactcaaaaccacaatgaggtatcatttcaccacagttagaatggctattatcaaaaagacaaaaaaaaaaaaaaaaaaacaattgcgggtaaggatgcaaaaaaagtgaacccttatacactgttgggattgtgaactagtacagccattataaagaataatattgaggttcctcaaaaaactacaagtctagatggctctttgacttcctaaaatgacaacagcaagctatacacagaattaaaatataaacatactcccaaagccatatataaagtacctgaggcagtccataaaattttaaatttcaatagagtactaatttaatcagggaaactttatctacggcattttttgctgtctccattaagcatgttatatgggctctcagaaccctgaagatcttcatccaaaagggaagttatactctcattttatctctaacagatgtgggcatcaagtgtttatgggcgtgaaaaaggctttccattaaaggaaaccctgtcaagtagcaggattttcttttattatgttgttttacacacaaaacattttttttgaaatcaccaagtctgcataaacctgaaaaaagcaaagtagtattttcataacacatatttgtctgtcactgctgtttttggcggaaattgtcccaacgagatctttgagttaccggtttctaagtagcctccagtcttgaccttccagaggcctcaaggacaatgatgtattggcccccagagactacttttggggctccagcattttgcaaacacatgagcaaagttttcttttcctgaagtcattttatttatcttcgctgtttccttccgcagccctttatagaaacagaattaaattgtattgggaataacaaggaggaaaaataattcacttatattttattgctttaatattttgtattagcattaccagtgatttatgtttcctgctccggtgtccccgttttgaattctccaagtctgtgaagggtgttgaagacaggtaatcggtaaataggctttcaagggagaatgtgtataggtgtgggtgaggtgaattaaggcttattttctcattgatctttcgctttgctttccaaagcagcggacactgggttgcacatctctgttcagttacagggaggggagggaatgcccagtaatttcttatctcgtggtatgttaattgctaaaatataaacaaaggtaagaaaggtgctttgtgcaggtgtaagtctctgggcatttgtccgtgactcacttctcagtatatcaagaatgatttctttcctccacagactaaccaagccttaactgtcaggttagccattctcatttctccctgcttggcctcgatcagctgctggccttccccgggagaaagagcctccatttgctatgagctccttgccggatggagtgattgccagcacatcccagtaagactgcagcaggtgctgcagcttggggaaatggcgtgtgttttccttaccagtacatgtggcttttgagctttgatttcacagaaatgtaaaaaacaggtcgatgctagtatgtactacattcctaccagcatacactttcaatccactttctgacaactggcttgtatcactccctgctttagagtaatagcacctttgcttgaagtttcttaggtgaaaatcatgaaggttcccattttgctgaatctctgtgttactgattaagagagagtaactgcgacaggggtgggcacctgacaacattttctaaataacattagcatgttttttcctcttcagccccctgggtttcaagcatttgatttgaatttttttccctactccctttcttaaaatgcatgactaagaaactgtttctttcttcactgatccttggttattcgctttgaaaaaagacgacagaacaagagtatttccaagaatacaccagtcctattctttggtgatgccactttctaatttaatgtgatccagcagccaaaatgttgttctaactaacatatctccttgctaaaaggtataaaacaggcatcttcaaactatttcttaagaaggctagagtcaatattttaagctttgtgggttgtactgcgtctttctcaactgctcaactctgtgttgtgcataaaaaagcagagctgtgttccaataaaactttattcacaaaaacagatggtgaactggagttggcccacaggccgaatgaccctgggtttggaagatgcttcttggaacttctggcccagctggtttccatctgcctttagctgattaagaagatgtggccaagggttccactgccacctcccccaccactactaatttttactgatcagattacacatcttatttttcactctatttgttctagacctatcactaacagggcaggcaagagccagggaagttgctcttaaaaaaaaataaaagacctggaaacccaaactctctatactgtggctttattttgtcatccaagcttggaagggcagctctcattttggcttccagtgcctgtctccattgccatttctccctctttcagtcctggcaggctgagagctttatggtctcctaaccttgcctttgcagcatcactagccctggtaataagaacaccatccatatactagccctttgacaatgaagaaagctgtccacatgtcttacctgatgtggtcctggtccaatcatttaagtaatttttaaaaattattttctgttttgacaataagaaaacagccctggagaggctgaatgacttgcttaagattctgcatctcatatgcagtgcaactaggcttcacctccactattctcactctaaatcctggtatctggcctctacctggtactgtttctcagtcctgagtcattaagggtctggcttcaggcactcctctgtcacattttttcttggatagattattaataccctgagatgccagataccattctgcagagagaagaagaaagccacagaaagccgttcaggctgagaatgtttaaaaatatatggtgctgaccaccaataccaatggcagcagaggaggatctttagtaaaggattttcaaagatatagagtctgtatctcagagtttaaaaaagaccattgctatacaagatgctccgatcagctctggttctcagtacttataaagcagcggaatctcctgctttatgaactttagttctgggcttcagctctgtattagtctgttctcacactgatgtaaagaagtagctgagactgggtaatttataagaaaaagaagtttaatttgctcatggttctgaaggctatacaggcttctgcttctgagaaagcctcaggaaacttacaatcatggcagaatgcaaaagggaagcaggcatgtcttcacctcgatggcaggagagagagagagagagagaaagaggaggtgctacacactttcaaacaaccagatctcgtgagaactctatcatgagatggcacaaggaggatagtgctaaaccactagaaaccacctccttgatccaatcacctcccaccaggctccacttccaacattgggaattaaaattcagcatgagatttgggtggggacacagagccacaacatatcagggtctggtctggtcaggggtaggttgcaggagactagggaccaaaatgatcttaccaaagggtgaaaaggtaaacacagaagttaaacagcaacactgaaaactcatagtccatgaaatccaaggggccaggagggaaggctgaaggttattaagattaagaagatcaaagcggaagacaaagttgggatatggagccagcagtagatgtgttctagtaaacacacacacatatgcacacacacacacacacacacacacacacacacacacacacacacggtataaatgatggaaaaagaggcagtggtttataaccatgccccaccagaaattctacctggccctaaattagtgtgtttaactatgcacattaaaaataaccaaccaaacaagcaaacaaaaaccagtcaacccaggcctgctgatatatctgcttatctccttggcaagggccaaccacagaactaagatgatttaagtagatctgtaaggtttctcttcccctgttttctgagtagagaaattcactggaaatgggattctttgctccactaagaagtccctggctcctgccactatccctttcctgcataattgtcttaaatcctctggtaaaggacattttagccaccttcttccagaagctacttttaaaaatatttgaagtagagatttgaagaaaagtggaataagtagccagaagccaaagatacttaagaaaccaagcagaggctctttcctgctaagaagaaaagttgggggatggtaagacaaacagagaagctgggtagttgcttaacgagatatagagcttttaggcttgattagggtcttaacaccttcctcatagggaagcactcactctgaatctaatgacattgtattcctatgacacatcaataaaatgcctacaggagaagcatctttgtacaaacttgtgccatatactttttaaaaatttttactaataaatatgtgtcatatattttactaatatgtgccacatactttactaatatgtgccatatacttttttattcctactaataaatatgcatatataaacatgatatagatatatgtgatctatatatgtataaatatatactgtgtgtgtacaagtatacaaattgtgtatgtgtatcttgtttaaagttccccagttttttcaattaaatactcacgaattttaaagagatcaagaagtcttctggcacttagaattgcattctactcaatgatatattgtaggtggaactacatacacattgttacattgttacaggaaaatgccagttaagatgttgtttaggaagcaataccaagggttcacaggtttatattagaaattagtgtctttagctcctttctgttgggatttaattttatgtataaaatgccattatgtccaaatattttataatgatgagaaaaccagttcactttggattatcttcattttttagtgtgattaaaaaaaaatctggctgcaattcttgtgcattagttaagaatgtgatggtgtgcagtcttttaagtcatgtcagcaaacgtgtatttccaaggtcagctctaccaaagagaatagtatttcttttgcaaccctgatcttacttggggatgaaaacaattattgcctaagttagaaatgtaaacacattaatgcaaaagaaaaatcaacaaaaacttatagtattaaaatgcacatcattttatgtgtgtatgtaaatgtatacaaattttactgatgtttttgcataaaaagataatcaaggctccatcactaccaaatttttagacatttagaaaggaactagacagtattttgtggttttcctgtctatgagataagttttgccagtaaatcaaacaatagtgcaatagacatgttgcatatattttgttagtttaatacctctttatcagcacttcatttagggacactctgctaattttacatactgtatgtcttaattaaataatgctgataattggaacgagtacaatgtattgagaacttatttgcctgccaagccctaatcgaagtgtttgatgtttttgttattggtcatttcatcttcgccatctttggaggtagatcattttatcaccctcattttacagataaaaagattcaagacttgctctgcctcctccaagcttgccatgcatatagtgataaacaatttaaggttatatcaacttctttaaaagtactaccccttcacagtaggttggcatttttactccaaattatgcaaggtgttatggcattttacattataatagcacagaaggtaaataaaactattaaattatttatcttcattcattacagatactgcaagagaaggtcaactgctaattctctttcaaccagcctgaagtagtgactaccattaaaaataaaaactatttaaaaatttgtcccaaatatccgcttaaaaaatgctttctgatcagttgatttaaataacgttatttggcaattgaaaggcttgttttgcaaactgttagaggaagaatctctcctacgaatggttttattctgtagtaaatgtctcctccagatacatggatttttaagccagtgtaaggtgtttaagacatggtcgattctagatatgtgttcgcattttgattacaagcaaatgttccagacccatttctatatttctcggacttacttggaaaggcaccaactaaagcagctgggagctgctggagaccattttaaatggttagttttcaggagattagcagggagcactgccttttgtactcaacactgagtttgaggtttttaaaagtgcacaagctttatactttacccccaattctattttacagtgttttaaaaaactttttttgttgagtcaccttattctttttctcgctcatcacaagacaaccctacttttaacaagaaacaacaaaaagaacagaaaagaataaaaactcacagtgaaagccatcaacgggttttctttttctgagcaccacttttggaggcattatcctttataacaggccctaagtgaaaaggaggaaaaagaaactttacatgattaggaaaggctgggaatgaaagatactgaaaggtgtaatgggaaatgaaaatatagtgatagaaaaggaaaagtaattctctgttggcgacaatgttatgttccatgacctgctcacactattttcttgtggacagcttcctcaaatcccattctgttgataaaagcatattaatatgatcaaccatgaaccagcaccaactgagaataccacttctctaggttggttgtaactgtttctttctgacttaaatactaaatatatcctctgaaataattacagttgtttgttacatccctttagttttagagaaaaattaaaactctcatttcttccttaaggaggctagggctaataactggagttgtatttctttttcattgtaagcccaatcaatttgatttctttttctcctaaatgaaaacataggctaaggccagcaaaaagccataattgggtgactaattaaatagtcaggcatctacagcctggtagagttcagggcttcctagttgaaggaaataaaaccataaactgctatctgtgacagtgtatatgaaagaggtgaaggatagagctgttgtgttcactggtggatggaactatgtattcatataactgcaagatttatggagataacatgattgggaaaatataaaacattaaatagattatgccagaagtcttgcctccaaatgtctaaatccttcaaatgtgtcattgccactacctgtggatcaaagaacaaaacagggatgtgagcgtgcagccctaatctagacacctgagacatgaggagtgcctgccaggaagaatttagaaggagcaggccaggagctaggaggagaaagaagaaagggtgacgtggattgtcaaatggggcctgagaattgacccttgcattgggtgaatggaggaccttgggaacagctactttggtggaattgtagggagggagcctgattcgagtgtgttcaagagtgactggaagcaacaaggacaggcaactctttcaaggagatctgctgtaaaggtagagagtgaacagaagcaatagctggcatggaaaatgggatcagcaagagtggttggacacagaaaggctgacaactagtagtggaaggtttttgatattgtggtcctgaaatgtcctcatagcatgttaatgtccatgttttttattgtgttttctctctttttttttttttttgttttgagacggagtttcactctgtcgcccaggctggagtgcagtggtacgaatttccggcccccaggttcaagtgattctcctgcctcagcctcccgagcagctgggattacaggcgctaatttttgtgtttttagtggagatggggtttcactatgttggccaggctggtcttgaactcttggactcaggtgatccaccagcctcagcctcccaaagtgctgggattacaggcatgaaccaccgtggatggccttttattgtgttttctaagcaaacaggcaagttattctttaatctcatttccttgccataaaaatatagcttaatttctaccaaaaacattggctcccaactgtatattaattatgattatgagttttaagtgacaattgcatttttacatagaggtaatgccgaggacatgaagttattttggatttcaggaataggtagtatttgttccaagccctgtggccatgaaaagccatctttgttcagtcctcaccaaggcaatgtagggtggataagcagtgtagggtggatcaccaaggctaggtgtggatcagcaagccttcctccttaaaaccgactctcagtcttgaacgcccagagggaagaggtaggaagtactgtttttcagctgtgatttcagaagtccacggatatttcaaaatcagcagtctccatcttagatccatgacttacgggggaagttataccccctaacgatattgcagaatagtagtaaatctaatgagagaatatatgagaagaactaaagtctgtccttcgattttccttgtgaccttggataagattgttggttatcatctgtcagctcagtggcccttctttggatgttaagatggtggtattaaccaccagaaatgttttcaaaaggcactctgcacattaaaggttctaattatccttcttcaagctagtgtcagtgctgattattaaacagttttctaatcctaactggcctgattttttttcaatgcagtccttcaaattatccttttgcaatgataaatctttcctaaagcatttaattctgcacacagagaaataccactgcttactcacgaatgctactgaacaaaagctatatttatttcttgttcaggttgtaaatattagaaatttatggatgatgatttcttaagaaataagcactataggctctgcaatgactggcagttctgttaaaagggattttgaacaagctttgaggcagagactcctgcagaagaatttatgcactttgccgactctaagaaggtactgcagcaaactaacagaaatttacttgttttcagcatgctgtcatagttgtgagtgaactccagagttttctttactgtctaagcagtctttgaagtcatctatttggtgattagctgtgatatgccttcctaattagggaaaagctattcaatcatctcctcacagattcctccaaaagcttgttttgaatctcagaaatgaccaattttaactaagcttcaatgaaatgacccacttaataaatttaaatacaatcaccaaaaataaatgttggtttgcttggcatcatgtctttccatctttttactttcttttatttttaaatttatttatattttttattgacacataataattgtacatatttacggggtacagtgtgatgttttgatacaggtatgcattgtgtaatgatcaaatcagggtaattagcatatccatcacctcaaacatttatcatttctttgtgataggaacattcaaaattctctcttctagctattttcacatatgcaatatctttttaattactacagtcactctactgtacaatgggacatcactacttactctttttttctaattgtaactttgtacccattgaccatcctctctttatctcccaatgtcccctaccctccccagtctttggtaatcactattctagtcactactttgataagatcagttttttagctcctacatatgaatgagaaaatgttgtatctgctttctgtgtctgcttatttcacttaatgtaatatcctcaagcctcatccacattgtcaaaaatgacagaattttattattttttatagccaaatagtattctattgcatatatttaccacattttctttattcattcatctgttgttggacacttaggttaattccatatcttgactattgtgaatagtgctgcaataaacatgagcaggcagacatcgctttgacacactgatttcattccctttgtatgtatacccagtgatgggattgctggatcttacagtagttctacttttaattttttgaggaacctccatactatttcccataatggctatatactcaaatttcatttttaaaaattttacatatcacctagttatttctctatccttctgccttctctgcactaatcacaaattgccctaacccagggtttcaattgatagaaccaaccgctgcatctttacacgcaacacattggctgattaaaaatcaatgcctcgttagagatgcaatttgtgttttgattagtgtttcggttatgggtttcctgtcctagaatgtctgccttaatcaactatttttgctttgaatcaccctggactattggcagtgagaggtacatctgcatgagtctccactgagaggcttttcttcctatttatgatacctctttgttcaccaaagggacaaaaattctggcaggtcttaattaatgcctgatgtaaagggatgattaagacatataaagccatggcttctgttttagcttttctaaaatgaaaatatagttgagagaagtgcttttttcagtagggtgtagcaatcaaaatcagcctggttcattgcatagttgtttgatttcctggacccattatgttggggttctgtgttttctttgttagtgctgtctctccactgaactttggtcagatattggggggttaattaatgcatttccaaaatccagaaaatatttttaaaacctcaaatccatcttcatgaaaacttttggctaatctatgttaagtaagtctcataacctacacatgggtgggcagattactctgtagaaagtaccttcatggcatgccatgagcatatcactatccttaaaagcacattcatggtgctggcttgtagacgtgcttccagggacattgcattgcaatggtctacatatctgaagtcttgtaacccatgagcatatgcaagaaagtttttcctcagaagcaattggcttgttactcacagacttcacagaatcgtcttgcaaatgttgtaggtttgccaaaatcttctgttaagtgatcattttgctaaaagattaacttcccaaatttctgtgcacttttaaagctatagtttcatccttgaccctttcttgatctctgttgtttttgaagaagtgtattttttagtacaaaaaatatatatcattgtagacaactcataaaatactaaaaacaataccaacgtgtccacaatataaagataactactgttaacattttgattgatttattttagaattttttcctaagttaatgtaaataatcatttttaatttatttttatcacaaatgagaatgattttataacacatattttagggaaattttcttttatctgatttataccctcacagtgtgtgtatgatttgtgtattttgggtggatcacacaaaccctatacataaaagagtgcatagaatgtatctgaatagtttacagaataattatcaaataaatattcctgataaccatcatccttgccaacaataattagcaaaacaggagcccctgattgcgtcacatttttcttctctaaaaataactactgtcctgacttttatattctactaggtgtccctaaaaatacagcatgtttttattgtttttgaatcttatataaatgaaatcatattatatgtattctttaccaaatttctcctgttgcttaaaactacatttgtgaaatgtattcaggttgttgcatgcaactttaattaatttgtctttaatactctatggtattccattgaatgaatttgccataatttatatattcaactttctcttaatagtcattaaggataatttcagtttagggctcttaactggtaatggggctatgaatggtttgggacatgtctgttagagaatatgtgcaaagttttactaatgtagatgcttatgagtagaattcccagggcatagacatcttcagttttgctagacaacgcccagctgtttcccaaggaggttgtaccaaattgacacttagaaatagcagtttcacatcctcaccgacattttgctattatcagatttttaaaaatattttgagaatctaaggtatgtataattttattagaaaatagattaacttggcattctcaaattactactgagtttgagcatatttctagatagcactatattaatcacttggatttcctttttgtgaagtatctcttcaggtctttgatccattttcccccttgttgactgtatttttcatatttatttgtagtagctatttatttattctgaatactagtactttgccaggtatatgtgttataaatatattttccatttcagtggcttatcttttttttattttactctttgcatgatatctttgataaagtgaattttataattttaataaaattgacataatccatctttctcttattctgtactcttaatattctatttcaagagaatttcataactctgaagtcatgaggctatcattttgtattatttctctaaaagctttgcagttttgcctttcacttttacatctttaatcgacctactattgtcaaggatgaactagagatatgattttatttcttttctatattaatatccagttgtcccattgatacttactaataagttcattctttcctttgttatgtgtcaaatgtctatttacctgcaaacgctctgtttcagtccttacatcaacatctcttgcccctgagttttacatgttaatacatagatgttcttttaaatgcagtttaccatcatcttaaaaaagaaaaaactttatttttagagcatttttaggctcacagcaaaggtgagaggaaggcacagagatttcttgtgtacccaccacccccacacaaacatagcctcgcccatttgcaacatctttcgtaacactgatacatttgttacaatccatgaacctacatttacacatcattattacccaaaatacatagcttacattagggatttctcttggtgctgtacagtctatgggtttggacaaatgtctaatgatatgtaccaccactatagtatcttacagagtattttcaccgtggtaacaattctctgtgctctgcctattcacctctcccgctcccaacccactgacgatcgctgatctttatactgtccccatagttttgcctttctaagaatgtcatatagttggaatcatacagtaagtagcctttttcagattgacttctttcacttagtaatatgcatttaaggttcctctgtgtcttctcgtggcttggtagctcatttccttttatagctggataatatttctttgtttgcatgtaccacagtttatttatctattcccctactaaaggacatcttggttgcttccaagttttggcagttatgaataaaactgctataaacctctttgtggtggtttttggaggacataggttttcagccctttgggataaatactagggagagtaactgctggattacacagtaagagtatatttagttttgtaagaaactgcccaactgtctttcaaggtactgtaccagtttgcattctcaccagcaatgaatgagactttctgttgctccacatccttaccagcatttggcagttgttttggattttggccttcctaataggtgtgtaatggtatttcaggattttatttcatatttacctgatgccacatgatgtagtacatttttctcatatgtctatttgccattctttgttggtgaggtatcaagatttttggtccattttttaattgaatggctaattttattattattgagtttcaagagttctgtgtatattttggatgatagtcctttatcagatgtgtcttttgcaaatatattctcccagtctgcatcttatcttttcattttcttgacattatcttttcaaagcagaagttttgagttttatgaagtttagcttatcaattacttatttcatggattatgcctttggtgttgtatctgatgagtcattgtcatacccaaggtcatctatgttttcttgtatgctattctctaagagtcttatagtttcacattttacatttatgtctttgatccatttggagtaaatttttggggaaggtgtaaggtctttgtctaaattcattttttttgtttttttgttttgcatgtgaatgtccagttgctccagaaccatttgcttaaaagactatctttgttctattgtatttcctttgctcctttgtcaaagatcagttgattatatttatgtgcatctatttctggcctgtctattctcttccattgatctatttgtatattttttcaccaataacatactgtcttgattactgtagatttacaataggtcttgaagttgagtagtgtctgtcttccagctttgttcttgtcctttaatattgtgttagctgttctgggtcttctgcatctccatataaactatagaattggccaggcacggtggctcacacctgtaatcccagcactttgggaggctgaggcaggcggatcacgaggtcaggagattgagaccatcctggctaacacggtgaaaccccatctctactataaatacaaaaaattagccgggtatggtggcaggcgcctgtagtcccagctacttgggaggctgaggcagaagaatgacgtgaatccgggaggcggagcttgcagtgagccgagatcacgccactccactccagcctgggcgacagagtgagactccatctcaaaaaacaaacaaacaacaacaaaaaaaaatctatagaattagcttgttgatatccacagaatagcttgctgagattttgaatctatagatcaagttgggaagaactgacatcttgacaatattgagtttttctgtcaaataatatgaaatatctctttagttctttttaaatttttttcatcagagttttgtagttttcctcatgtaactcctgtacatattttgttagatttatatctaagtatttcattttggggatgttagtatgaacggtaatgtgtttttaatgtaaaattccatctgtttattgctggcatacaggaaagcaattgacttgcatgttaaccttgtctcctacaaatttgctataatcacttgttagttctaggggtttttttgttgagcttttagattttctacgtagataatcatgtcatctgcaaaaaagatattcttatttctcttttcccaacctgtatacattttatttacttttcttgttttatttcattagtcagtgcttccaagagaatattgaaaagcagtggtaagagggaatattcttgtctcattcctaattctaggtaaagcttctagtttttcaccattgtcatgtaaattgtagattttttgtacatatacttttttttcaacatttattttagtttagaatccagatatctatatgtaggtcctgtaaaattctcattgaataatatgcaaagtctataatatgaatactgaaattttatttatttatttatattttatattaacttttattttaagttgcaggaacatctgcgggtttgttatataggtaaattgtgtaaatttacctatctaaaaatatataggtaaacctttatataggtaaatctacataattttatataggtaaatctgtacattatgggggtttgatggacagattatttcattgcccaggtaaaaagcatactacccaataggtggttttttgaatcgctctcttctctcactctccaccctcaagtaggccccagtgtctgttgtttctttctttgtgaccatgtgtgttaaatgtttagtttccacttataaatgaggacatgtggcatttggttttctggttctacgttagttctcttaggataattgcccccagcttgatccatgttgctgcaaaggatatgatcttgttcctttctatggctgcatagtattccatgatatgtatgtaccatattttctttatccagtccaccattgacagacatttaggttaaggtttcatgtctttcttattgtgaatagtgctgcaatgaacacacatgtacatgtgtctttatggtagaacaatttctgttactttgggtaacagaataatggaattgctgggttgaatggtaattctgttttgagttctttcagaaattgccacactactgtgcacggtggctcaactaatttgcattcctatcagcagtgtataagcattctcttttttctgcagctttgccagcatctgttattttttgatttcttaatgatagccattctgactggtgtgagatggtatctcattgtggttttgatttgtggttctctaatgatcagagatgttgagcattttttcatatgtttgttggccagtgggtgtcttcttttaaaagcatctattcatgtcctttgcctactttttaatagagttatttgttttttgcttgttaatttgtttaaattccttatacattctggatgttagacccttgtcagatgcatagtttacaaatattttttctgtttctgtaggttgtctgcttactctgttgatagtttcttttgccatgcaaaagctctttattttaattaggtcccatttgtcaacttttgtttttgttgcaattgcttttggcatctttgtcatgaaacctttgtcagggcctatgtccaaatggtatttcctaggttatcttctgggatttttatagttttaggatttaagtcttaatccataatccatatttaagtctttaatcttgagctgatttttgtatatgctataaggaaggagttcagtttcaatcttctgcatgtggctagccagttatcccagcataatttgttgaataaggagtcctttccccattgcttgtttttaacttaacaaaaacagatggctgtagataggcagctttatttctaggttttctattctgttccattggtctatgtttctattttggttccagtaccatgctgttttggttactgtatctttgtagtatacttttacatcaagtaatgtgatggctccagctttgttctttttgcttaagattgcctctatttgggccccttttttggtttcatataaattataaaatagtttttttctgattctgtgaagaatatcattggtagtttgataggaatagcattgagttggtagcttgctttgggaagtgtggttgttttaacaacgttgcttcttcctatccatgagcatggaatgtttttccatttgtttgtgttgtctctgatttctttgaggagtattttgtaattctcactgtagagacctttcatctctctggttagctgtattcctaggtattttattctttttgtggctcttatgaatgggattgcattttttatttgaatctttgcttgcatgttgttggtatatagaaatgctactgatttttgtactttaaaactttgctgaagttgattatcagatctaggaggttttgggcagagactatggggttttctaggtatagagtcatatattttgcaaacaggaacagcttgatttcttctcttcctatttggatgcacttttgtttctttctcttgcctgattgctctgactaggagtttcagtactatgttgaataggggaggtattcctccaggggaatgcttccagcttttgcctatttgatatgatgttggctatgggtttgtcttagatggttctgattattttgaggtatgttccttcaatgcccagtttgttgaggattcttaagatgaaggaatgttgaatttatcaaaagccttttttagcatctattgagataaccatgtggtttttgtttttagttttgcttatgtaatgaatcatatatattgatttgtggatgatgaaccaaccttgcatcctaagggcaaagcctacttgatcatggtgaattagctttttgatatgctactggattcagtttgctagtattttattgagaatttttgtacctatgttcatcaaggacattgatctgatgttttctttttcagttgtgtctctgctaggttttggtatcaggataatgctggcctaatagaatgagttagtgaggagtctttcctccaacttttcggagtaatttcaatatgaatggtacaagctcttctttatacacttggtagaattgtctgtgaatttgtctgatcctgggctttttctggttggtaggctttatattactgattcaatttcagaagacatcattggtccattcagggattcagtttcttcttggttccatcttgggaggttgtatgtttttaaaaatttatccatttcttctaggttttctactttgtgtgcatagaggtgtttgtagtcatctctgagagttttttctatttctgtgtggtaggtggtaatgtcccctttgtcatttctggttttgtttgtttgaatcttctttttttattagactagctagtgtcctataaatcttatttattctgtcaaagaaccaactcctggattcttttctatgtttttttgtatcttggtttccttcagttcaattctgattttggttatttcttgtcatctactagctttggagtttgtttgttctttctctagctcctctgagtgtgatattaagttgttaatttgagatctttctaactttttgatgtgggcatttaacactataacatttcttcttaacattacttcagctatgtcccagagattctggtatattgtatctttgttcccattagtttcaaagagtttcttaatttctgcctcaattttattttattgtttacccagaagtcattcaggagcacattgtttaatttccatgttgttgtgtgattttgagcaattttattagtattgatttctatttttattgtgttgtggtccaagagtgtgtttggtatgattttaattttctgaatttgctgagcattgttttatggttaattttgtgattgattttagaatatgtgccatgtgaagattagaagaatgcatattctgttcttttggggtggagagttctgtagatgtctcttaggtccattggtcaagtgtcaagttcaggtcctgaatatctttgttagttttttgcgtcagtgatctgtctaataatgtcagtggggtgtggaagtctcctgctattattgtgtggttatctacgtctctccataagtctttaagaacttgctttatgaatctggatgaccctgtgttgagtgcatatatatttaggatattaggtattctagttgaactgatgttcgttgtttattttaatgtagtgcccttctttgtcttttttgattgttcttggtttaaagtctgttttttctaaaattcaaataacaacccctccttttttctgttttccatttgcttagtaaatttttctccatccctttactttgagcctatgggtgtcattgcatgtgagatgggtgtcttgaacacagcatgcagttgggtcatgctttttttttttttttggatggagtttcactcttgtcgcccaggctggagtgcaatggtgcaatctcagctcactgcaaactccacctcccaggttcaagtgattctcttgactcagcctcctgagtagctggattacaggcacctgccaccacgccccactaactattgtattttcagtagagatggggtttcaccatgttggccaggctggtcttgaactcctgacctcaggtgatccacctgcctcagcctcccaaagtgttgggattacaggcatgagccaccatgtccagccactgggtcatgtttctttatttgacttgccactctgtgccttttaattgggacatttagcctatttacattcagggttaatactgatatgtacagatttcatcctgacatcatgttgttagctggttattatgcagacttgattgtatggttgctttatagtgtcaatggtctatgtacttaaatgtgttttgggtggttgctattggtctgtcttttccatatttagcactcccttcaggacctcttgtaaggtgggtctagtggtaacaaattcccttagcattttcttgtctgaaaagaatcttacttcttcacttataaagcttagtttggctggatatggaatttggaatttattttccttaagaatgctgactatagccctcaatctcttctggcttgtggggtttctgatgaaaggtccactgttagcctgatgggattctctttgtatgtgacctgccccttctctctagctgcctttaactgtttttcttttattccaacctcagagaatctaatgattggtgttttggggatagttctctcgtaccgtatcttgcaaggattctctccatttcctgaatttgaatgttggtgtttctaatgaggttggggagattttcatggaggatatctttaaatatgtttttcaagttgcttgctgtctcttcctctctttcaggtctgacaatgagtcatacattgggtcactttacataatcccatatttcttggaagttttgtttatttttctttatttttgtctgactaaattagttcagagaactggtcttcgagctctgagattctttcctcagcttggttgattctgttgttaatatttgtggttgtattctgaaactcttgaggtgagtttttcagctctatcagatcagtttggttgtttcttaaaatgtctattacatcttttatctcatatatcatttcattgtattgcttagattccttggattgggttttgactttctcctggatatcaattgttttcatttctatccatagtctgaattttatttctgtaatctcagccatttcagcctggttaagaacctttgcttagaaactagtatagtcacttggaggtaagaagatagagtaagaaggctttttgagttgccagagttcttgcactggttctttctcatgtgtgtgagcttattttccttaaatctttgaaatttctgtcttttggatgaggtttttttattttatattctctgatgcccttgggggtttgattgtggtataaggtgagttcagtcaactgggttgatttctggaagattttaaggggccaaggctcagctcagcattcctggtctgagtgctttaactctggggggctggtaccaggtccccacacttgttctctggcaccttgaggttagaaaccagctgcactagaaaggccaacgtgtttccagtccactggctacaacattcctgtgggaggtactgaccaaagcacttcactggggcagtggcagtgggatccatgctcacttacacatgctaggagccatggcattgcagagaggtgcacatgcgtcgcctggggcaggatactggcagaaacgagtttgcagcattcttttttttctttttatttttttttttttgagacggagtttcactcttgttgcccaggctggagtgcaatagcgcgatcttggctcactgcaaacttcacttcctgggttcaagacattctcctgcctcagcttcctgagtagctggaattacaggcatccaccacaatgcctggctattttttgtatttttagtagagacggggtttcaccatgttggccaggctggtcttgaactcctgacctcaggtgatccacccacctcggcctcccagagtgctgggattacaggtgtaagccacaatgcctggccaagtttgcagcattcttgcatgcccttgcaccacttgtggaacacaggtggggatggggttgctattgtctgtgtttgcactcacaccaatggcaatggcagcggagggttgagcaggattgctggtgtccatgtgtgcattcccactggcagaaatgactaggatatctctttactttaaagccactgtggaaacccaaatatgcatcctgtcctacaagtcagaacactgttgtttcaagcatcatataaacatttcctggcatcttcccagtacctgcaggtcacagagccacaatgactgctgcagagtcacctagggtttcctaggaaatggagcaatggacatggcatcccagctccttgcacaagaatcaatattctttatcaaggtccgatgttcccttctattcctagtttaatgaagcctttttaaaaatatcatgaatgcctgttgaattttgtcaaatgctttttctgtctctactaattaaccgtgtgacttttatttaatgaattagaataatttacttttgaatgttgaatcatttgtgaatattttgaatgttgaatcatttgtgaatatttgggataaattctactcagttgtgtataattttgtaatacatcattggactctatttgctaatatttgtttaggatttttacatctatgtttataagaaatagtggtgtgtagttttcctcttttttttttctgggtttgatattaggataattcctgcctcatggaataagttaggaggtattccctctgcttctgtcttctgaaagagattgtagacaactggtataatttcttccttaagtgttttgtagaattcactagcaaacccatgtggacctggtgctttctgttttggaaggttattaattattgattcataacctttcttaatagataaattaacaatttcttaatagatacaggcctattcacattatctatttcttcttgtgtgaattttggcagagtatgtttttcaagtccatttcatctaagttgtccattacatctaagttgattttcaatccctttcatctaagttgtcaaatttgtgggcatagagtttttcatagtattcttttgttatcctttaaagtctgtgagatctgtagtaatgttcctctttcatgtatgatattagtaatttgttcttttttttctcttggttagcctggcaaaaggcttatcacttttgttgagctcttcaaagaaccagtttttggtttcactgattttctctattaactttctatttttaatttcattgatttctactctaatttttagtgtctcttttttccaggttatttcagatttaatttactctttattctctagttttctaaagtagaagcttaggtagctgattttagatctttctttttttctaaaatatgcattaaaggctagaaagttccctaaaagcagttttgtcactgcttttatggcatcataaaaaaattgatgttttagtttaatttttatttactttaaaatacttttaaatatttattgagatttattcattgacgtagacttaacactgagttaggctggtgctagagtctgtgctcttaactgctattctatggcatttttaggcaagtcaggtccagtccacctgtaaccctacacatttcacatacatacaaacacactaataaatatgagaagtagaatctgaactgcagaaacgttgtgtattttatttttattatctgtatttttgccttatttcctcacttgaattcaacttctttcaccttgacacactggagagccagagatagaaagacccctcacatatgccagccattgagatcattaggatgatgaacaggacacaatttttatggagagttgtgtggtcaggaggagagttgcaagaaccaagaattatgtgctaggaaatgtgtgttaaagtagagatgtatacagagtgctgtagaaacatggagaaagattacttaactctgatctgggcaagggagagggggcaggaatatcagacaaattttacagagggtgttttgaaggaggaataggagtttgacatgtgagaaagtaggatacggatgtcagtaccctatgcaaaggcactaagacctgggcgaggttagcattctgagtcagtgaagagggtgcatttgaagcatgacgccagagagaagaacagggtggaaggtccagatttcatgcagagtcagcaaataggagtaccttaggtcttgacgtcataaacccaaggatcagacaattttccagtgtcaacaaaagccaccataactgatggaagttaacaagacagggtgcagagaggtatgtaaaggaactgagaagacaagacattggtacaagccagtctccagtttcctctattttcccttggcccaaagcactgtcactagaagatttcatgtgataataataaattttctgtgaaatagtagaagcattatggaggagagcagattctgtgcgaggtatccacctaagacatgcatagccacagcactttgttccctgaaactagagtgaataaataggatgcctccagaaaacaaaaatcatcttcaacaagatgccttttacctatttcttgtcccttttatataatttctggcatatgtgtctatatatagaaatttcctttaattaactaattgcacaaacacacatttgccaatgttttctttaataaacctatccttttctgtgattcaatgaaatacattcaattctgctaatttttcataatgctttccattatgatagcaaaataactcagttctgggaaaatataccaataactatcttgaattgtaacaacagtaaaaatgagaacattttacctgaacaacttgagttttgtgtttgtttgtttgtttgtttgttttcaggtagagtctctctgttgcccaagctggagtgcagtggtgcgatctcggttcactgcaacctccacctcccaggttcaggtgatgctcctgcctcagcctcccaagtagctgcgattacaggtgcatgccaccacaactggctagtttttgtatatttagtagagacagggtttcaccatattggccaagctgtccttgaactcttgacctcaagcaatctgcttgcctcggcctcccaaagtgctgagattacaggtgagagccactgcacctgaccaggagttttttaattgaaatatttgtgcacaaaagcccatgatgtcaccactagtggttaatttatttgtttgtctgactcataatgaatatgagagaattgttttagtaaagataaattgcttttaataaggactaaaatccctttagtttaacacaagccactttattagcagtgtttctgggaaataaaagcaagagttggttcttccagaagtttaatgccagatttcaccaccttcatgagaaatcagaagggtattgttaacatgctgtttcatttgaaacagttttaacttttggtggtcagctcaataaatggaattgattgcttttaacccgggacaatgacatactgtaccaggatatgccgctgtgtaactttcaattctactttttgtattggcaggacttggcaaagaattgcagtgcatgtttccatttcctatctttgactatatatttgttttgtcacttaatagagctacagagataacttgaggaacaaactgactacccaggtctccaggtcaattttctgttattttgcatgaaatgagaaagtcattttgaccctcagaagacaaatcagtgcagattatagatcttctcttgatccccaaaggaataccccaaattcacacatttaatgtaacatatctttattgaacacctaccatgtgctgtacactatactaaactccttagggatatatatacatatatctgagatacggcatcatggtagagagaaaggggcttgggccctagcatatctagccctcacagcttcttactaaataaaacttagcttatctgagcctcagatttctgttcaatggaaattataatacctacatgtacagctattgtggacactaaataacatgaatagcattgccacattgcagatgctcagtacctgttggtttctcattctctctacatcacaagtttagagtcacattggaatgacccacatccacactccaacaagaattcaaaggactctagagcaagtgccacacatatggcataattaactgtggtggttttaggaatcgttggcttgtgggtcactagtatgaagatagttgctgtttcttggagttgaggttgccaggcaaggcttcatgaagttggcaacacttgaattgggccttaagtgtttctggattccagatgtgtacagagaacatgagatgaaaatcctggttggataaaaagtgtgagcagcatcttgggagtaggactacacatgtcactttacaagagctgagagtagactaatttgagtagaggagataatttaggtgggtaaatgggagcagatataattttaagacacatgaagttgagtggacattaaaaatatgtttagtttgtggacattaaaatataatatagttggccctgttgtgtctgcaggttctgcatgtgtggattcaactaactgcagatggaaaatacagtatttgagggatatgggctctgcacatactgagggctgactttaagtagccattggctccacaagacctactgtgggacttcagcctctgtggattttggtatctgcaggaggtcctggaaccactctcccattgatattgagggacaattgtattgtaataaaagtcacaaaagatttttgagttgaggctagtatttttaagaaatctagtccagttttacaatgcagagtgaataaaaaaagtaaataaccagagttttaataatccagaccagcatgaattaggttgatggcaggagcaatgggagaaagaggtgtaggacttaaataaagaattgattggctttggttattgattgtatatggaagtgagaaagaaagaagaaactagtatgaatccaactattcaaggcttgttaactgggaaaatgaggaaggttgaaataatttttgaagataaagtgtgtgcttttagatgtgttcaatttaaagtaattacagggcatccaagtggaaagctctaaacactagttggcatgtgaggggagaaacttaagacacgtcaggaaatcaagatgtgagttatacatcctcatggtgttactaagcacctaaaagaagatgagttttctaaggcagtatttctcaactgtatcttgtattattaaacacccttattcaacaataagtacttactgagacactgatgcgtgtgccacatgccaagctcccatctgtgtaccagggatatggtgggaaacaccaacaaagtccctcccatcatggagcagtcagcacatgatagttgatgtgcatgaaaatgttcaggtccatttgttagctcttacaccgtgtctctcaagagagcctgtctacatggatgtgaagaacagtggcattgctatgaatatagttctaaatgtattctaattcattaagaaagtaaatcattcacaaatattgagaacattgtaaataatttgcctcgacaaccattgtatgtcaacaccttagatgagaagctctgctttaaggagaggttaggaagagagcaaaggggctcaaaactgaaccttggggaatagacatatgtaatggactggaaaagtagccagtaaataaatcaatggatggatggatggatggatggatggatgatgaatggatgatggatggatgggtggatgaatggcggatggatggatgaacaaacaaaacacaggtagacagacaggtaaatatatagattaaaagagagctaaaaattaaaacaaactcatggagatagacagtagaacgatggttaccagaggctggaaaggggaatagagggatgggagagaagttagaatgggtacaaaatatagaaagagtgaataaaatctagtagtatttgatagcacagcagggtgactatagtcaataataactgtacattttaaagtaactgaaacagtataattggactgcttgtaacacaaataataaatgtttgaggtgatagatacctcatttattctgatatgattattacgcattgcatgcctgtatcaaaatattacatataccccgtaaataaatacacctactatgtaaaaaagaaagtgagacagaagtaaagattagagaatttagaggactagaaagagtcaattgaggcagtgtcacagaagctgaggaaaggaaaaattaaggaagaggacacgtttcacagaatttaatgatatagataggtctacagagtgagagttgataagtaagaaggaagcacactgataaaactttgaaagagcagttcagcaaaatagagaagagtgaaggtaatattgatggggttatggaaaataacactcatagggaaaagaaagcacaaaatgattcaaagtctttattggcttatttataagcaaatgacaggttgaatatcagaaacagaaatgaagacattgatgaagatggataaggtgtagttgggagcatacagaatcccagaagttgaggcacatccagcagaaccacctcataataggtttgtcacaggaagtggatcttggggtcaagcagagtaggtcagttcctagtactgaagtttgaaacagatgttctgtcggggaggagagctatcaaccccagtattacatgggagagacttgagaagtttaaaaatccaaccaaagttgtttatggagttgttttttacaatcattttaatagctgggtgaagggtaaattgtatgtagctaaaattttaggcagagacactggtaagatgcaaatctaatgcaaatctaggccaaaatgataatttcgagctaggataatagctatatggatggagaggaatgataagattcttgggcttgatggggccttgtgacagtgaggaatgagagattaggtgaagggaagtctctgtcaataaatatttattgggtacttaagctacagattagtcacacagaaggagtggatttgtctgtgttgattggaagcaagatgaattacgttttgatgatgttgagtcagaagtgctttcaaaacaaacactaagttaaagatgccctttcacaattgtaaataatttggagctcacatgagagataggggttcaaatctggatttggaagtcattggtttataaattcagtttctacccagagagaacacattctgtgagaagagagccagactcaggccacatttaaagggtaaggaggcatagaagagacacatgaagatgcaaaaaatgagccagcagaaaatagtcgtctcttagaggccaagagacaggaagtgtagagcaaaagatacagaagtattagataagttaggagcacacattacccttgaagttaatcttagtaaggacattttcatcccagtagtgagaatggaagctaggctacaaagagatgaagaacaaatggaagtgaatattaaaaatgtttgtatagactcctttatgaaagaaaatcagaagtctgctaagcaacaaatatagaatgaaaacagtagaaagattacatgacagagatgatagaagggtaaggaatgacataagggaaatgcaaaaacattttggaggaagttaaatacaggcttggaaatgctaagtcatccactgttctaacctgctgccttcaaggactgatgtaaagttggcataataatggcattacatttcaagaacttaggatattgtctgacacatgggaaacattcagtttctctattagtcaagatatgcaaaccactgtaaacaaattcctaattttagtagctgatcatgacaaggtttatgtctacttcaggtcacattccaatgtagattgacatgggagctctgctgcacacaatcctttggggtctcaggcgctatgaccagctgtcagacaaggaaagaaagaaaatgtggaagaatatgtgggagggttctttgagacttggaatgctatctgtgatttctgtctttgtttcattggccaaaagtcagtcacatgcctccttctaacagcagggcaggctagaaaatgcagtctaactgtgagccctggaggaaaagaaacaagttttggtaaaaacaatggcagtctttgtaacagcctagtacgatttactgttattactatctatagcagggtcttagtcaaattaattccctgcagaatgaagatgagagagaagacagatacaccttgatggacgctggggatgggaaagttagactcataaacaaatggaagcctaggaagtgaggaagaaacactgccatcctgagaagaaccacaagcactgggaagagatagggcaacattaaaatcctaaagctatacttcttgtccagacttgccctgcatttctgacctgtacagtcaactgccactctatttgccatttggggttctatagataggtcaagcttagcatacctaaaacaactcatttcactccccaacaaaatttactttacatggagcctttttttttttaatgcaatgcatggtgacacctttcttccaggtagtcaaatcacaactcttactgtcactcttgagtcctctctgaccctcatatccagtaaccagttaatcagggaatcccgttagctcaaccttcaaattgtattcataatgtgatcactcggcaccatctccactgctcgcgtgctatcctctacaacacctgtgccatctctttcctcccagtctcctttcaacccagtagtgagagtggtccttcaaaacacaatggaaatgatgtctcatctctgctcagagctctccaatggatcacacctcactcaaaataaatgtggaagaactccttgcaatggtctacaaaactctcagttatcatatcttttttttttttttttttgaggtggagtctcgctctgtcaccaggctggagtgcagtggcgcaatctcggctcactgcagcctccacctctcaggttcaagtgatttccttgcctcagcctcccaagtagctgggactacaggcacacaccaccacacccggctaatttttttttttttttgtattttagtagaaacggggtttcaccatgttgaccaggatggtgtcaatcttctgacctcgtgatctgcccacctcagcctcccaaagtgctgggattacaggcatgagccactgcgcctggcccagttatcatatattacactgcttccgactgatattgcctcacctcacacgctggcctccttgtcattcctcacacatgtcagccatattcctgctctggggcctttgttctggctgtttttacagtatggaaccctctgtcctctgatatgcacgtggctactccctcacctccttcacatctttgttcagatgacacattttaagtggaatctttggatactttcccctgggcaccatatataagaaagcaacatctcccactccaatagctccttaatcccttagtctgctttacttcttcatttctcatagcatgttgcaccctcacacacaagatatcattttcctaattattatgtctaatgtttagtctgactcactcctccccactaaaatgttaaactccagaagatcaggggtctttgcatctagtagaggttcagtaaatactttgaacatagtagaggttcaataaatactagttaaatgaatgaatgagttaataataaacaaatacgttgattgattgattgactggttgattgattttgccttgagccctcatacttcttacattgcttggcaagtagcaatgttctacattttgtgaatgattgttatagtaatggtctgggccccacaatacagacggcagctgaataatttgacactttggtaaggaataaatttctcctttcattaatgactgatttattctattttctttatagtataaatattatctgtgtttcaaattgtgtctgaaaacttacaggccagcaaatggttgggagtggggagcatgcatcacttacagctacagtgattttctgtctctgactcatcttaaaaagccttaattgagtatttattcttatgctgtgagatccaagaaatcttaactgccattaagctgtctacagaagcaaaacaaaatggagaattaaggcaattatcagcatgatatgaaccatagaaaacatgtttccctcaatctggatgtttcgagagaacttatttttgatctaaattatctgagtaatttccccttcagttttcattttattttgcactgatagacaataatttagtatagaaagggacagcccataacatagggaatcagcgtgcgaagaaattcattatccagcatgtgtatgtctgtatcttctatttttactaaactttgttgccagaggagacatttaaaaaaactgctttctaaggaattgttgaaaattaactgatttactgaagttgtgctttgatacctgcctgccttttgacctcaactaaaataactcttcagtttgaatttcttttagctccccttttgggctgtaactttagatccagctttcaaaagccaacaggtaaataaacaggatattaatcatcatacattcatttcaatgagaatgcagccacaatcagcataagcgtgggctatttctgaattacatgaaagccagctccctagggtatgtccaatataactgtgataatgaggaatttgcaggtggacctgctgttcttgtgtaccttattaagtgccttgtcaggtcaattgtatttgtctgatatcttcaatctctttcccctgagatattttccagtaagactatttattaactttaacatttcatattcaaagtagccctcaccccggcctcaaccaccaccaagttctatcacatgaagtaatgacaaagaagaacctgggtaagttgctgcaaggctgggctggctgagttattaggcctctgtagctaaccaggcctgcatcttcctgatatatgaacatttcagcgggcaaagaatagaatccccacgaggatctcagataacatcagccttacccatgtgtaccccaattactcacctcaaatgctatccctcatctatcacttggctatagattcatcagaagaattgaaaatcaaacagaaatattgtacaactttttcaggaagtgatacaagtagacatggaggttacagctagtttgacgcagcctaggaaaaaagggtactggaatgcaaaaatattccccatgtctatgtctctagcagtcaagacctcaatttttcatttttgcttttaaaatcccacttgacttcatcctaacctacctaccatcctaacccatattctctgtcactcctctccattgtgacctttctgcccaaattgactaatctgttttttgatccctgaaaaatctctgggctttcctccctccaggcctctacacatatcttttcctttgcctggagtgcccctcgctgcacttgtgtttgagccaatctaatccacacttcacagtctagctcagaaaccttctcaataaagttctctcgtttagcacagagtaattgcttccatctctgaatccactcagcacaactcactcttctttctctttctcattctttctagatttttaattcttttgattatagaatatcaacttatacaaaaaaataggcataagcttaaatttatagtttgctaggtggttcaaaaaggaatgcctgtgtaactaccccaggagaaaaactagactgttgccagcacacaagaagcaccccagcgtcctggccaattgacaacccccttcttttccaccagagctaacctctgcccttcatagttcatagttttcctatatgtgtgcatccctgaacaatacagtttagttgtatctctttttttcttttaaaaacaattatgtttattcaaaaaaggctagatgaaattaaatcaggctattttaattgattcataatgcaattttaaagattaaaaccaaatattgaaagactaaaatagccaagaaatgctgaattgattagtaaataatatgattagttcaaaatgctcttatattaataacataaaatcattttttctgctgacattgattatagctaagttgacattgtgagagttaaatgcagtttattgaaacctgaaatagttaagttgcctagtctagtaatggagttaaggtcactttatttgaaggtactaagcttactgcataagtaaagctggcagagttatacttgctgtacttgcagttaccaaatttaaatgccttccctggtgaaagagtgttggttaaatgagccctgtcaaatttttgattctggctgcctccattgaagttgaccaagcttgtgggtggtgatgccccaggcttccttgtagctgaagaaaactgaagaaatgaggatactacattataagtagaagagaatacagttgcaaagagacagaaaccaagtatacacacacacacacacacacacacacacacacacacacacacactacacacaaggtgtttttaggtgccgtttcagaagcattgtgtctgtgtatgtgtgaatccttggtttgtgtctctttgcaactttttttaaaattttttatttatttttattatactttaagttctagggtacatgtgcacagcgtgcaggtttcttacatatgtataaatgtgagttgtatctctttttgaagtgtacatttttttatgttctacaaaaaaagataaaaactaaatactaaccactctaaagcacatcaatacattatgtatttggggactttccccagtcaatattacttataacgtttaagtttatggtggtagctacagtccatttatttttattgttgtataattttccactgtgtacatatactacagtttattcattgtatggttgggagatagttagattgctttaatgtttagcaaatataaatattcttgctgtgaatattctttgacatacatttctttccacatcatcacacatttatatcggacacatacacagaactggaattgttaggtcataggtaagcattacctacttttatcagacttctacattttggcaacctggtggtcctgtatcttactgcatttatctaattactctgaagccaagcatttttctggatgactttaggcatctggatttcattcgactgaagtgctttttcaagcacttttctttaggatggtcaaccttcttttctcattgtgagaaaaattgtgaggcaagaattctctctatagcctggatactatttcagtcaatttcgtgtttgtaaaagtcttcagtgattcctatggcttgtcttttccatttcttctggatgtttttgaagaaaagctcttcgttttgaatttattaatcttttttatgtttaacacttaaaagtattttcctatataaggaaatggcaatattcccctatattgtcgtctaattattttaggtatttaatccacttagtatccacatcatagtacagtacaggtagtggtatattttattttgtacatagctattccgttttttccagcataatatattgaaaagactgacctttccccatcagcttctgtgctctttctgctgtatattaaagacctatatatgtgttagtttctgtccacttgtatgtttgtctacatctgtgtaatttctggtgtgctgattatttaaaatatatcttaatatttggcagagcaagtcttaccttttagtttttgtttttttgaaagccttttgactattcttggcctatgttattgccacataagtcttagaattagtttgtctgcttcacaaacaatcttgcctgggttttgattaggattgccttaactgtatataaatttgatgagaattttataaaaatattgggctttataattcacgaacaatgtatataattcatttaagttatttttagtgtctctcaatagagctttataattttttttgtaaaaaccttgcatatcttttgtgagaattatttccaggtgatagattatttttgatactactgtaaataatgtattttaatctaattttctaaatatctgttatttttatgtattgattttgtacaagttttgtatgcatagccttggtaaactttcttatcaatttgataagtttttctgtacattattttggaagttatatgaatataatcatactatctttgaaaaatgacaatttgattctccagttccaattctattaccatttagttttacttgccttattgcacttatttccagtgaaacagtaaagactgagtttggcatggttgtttggtttccagtaaaaaaaaaaaaaaaaaaaagaaacggtgaaactttcatcattttataattttcaaaattagggatgatatttgctctgtaagcttagtagaaaacatttatttcaggctaggttccttctcttcatagtctgctgagggtttctgacatcgtttgctgaattgtattaaatacattttctggatctattgaggttgtgtttttttctcctaatgtgctaatgaacttgtgaagagctgagccagactgagagctgagctgccaggggttcgagtggccatgaagaaaataagccaaaatgaaagtaacagtcaagattttcgtcaatagtgcaatactataagcaagatgctcaactggggaaagcactgacttccctagtgttccattgttcatttggaatggcaccatccatggtcagatagatcagcatagacatgatgaatctccttattgctaagaaagttctaaacaaaaagctccttctgttttatggaccataaacaggagaatgggaaggttagtaatggaaggtattgagtactgagtcagagtgaaaaaagagtatcctcaaagttcctccctctaccataataaggaggtctcagcacctgagaaaaatgtcttctgaagacccccaaataggaggcctctgaatgtaggtaccaggactaagaatgcagacatgagtaagaacatggccagctgatggcacctgagtccctgactgcaatactcttcaaagactgcagtgcattggctgtgcaccaaagtaggtgtggggaaggtggttttccctgctgaggcctctcaggtaaacgtttggtaatcacctatggtcaggcttgaaggatcacacataggttttcaggcagtatcgagagtccttagtgatgaatgaagatgactgtgtttaatgccaaactaaatttgaattcctggatgaacccagtagtaacatgatacaattgatgtttttaaatagtattgttatgtttattttaatgtgtcagtaatattttgtttagggctcttgtattattgcttgttgatggaaaatcaatggacttttgtatattaaatttgtatcccgcatctttgctacaattgcttattatttccagaatttttttttgtcaattctcagattttccacggagatgatcatagcatgtatgagcaaagacagctttatttcttcctttccaatttgtatacccttatttccttttcttgtcttattacattaactagtacttctagtacagtgttgaaaaagagtggtgagaggggccatctttgccttcttgacattagcagaaaagctttgagtagataatacaattttgtttcttttttctagttttctttttaaattctgctatcctgttttatagggttttgtcctctgcagatatttttaagtttttcatttattcttataaacagggtaagcatagctcttttaaaatgtgttctacaaatcccagtgtctgaagtgtgtgcagatctctttctgctgtctgccatgctagttctggccatgttatttcctttcttaatgcatctgcttatatatgactgcttcttggccattgcccttaaaaataacttgggaagattccttgaggtctaaaatatacctcctacaaagaatggggcactgtcagtctgggactacttcagtcaaatttggtgacttaaattccatcaccagtccaggctctgagttcaaatacatgaaagagccaatcaatgtccacaatcgctcaagaaattttcctctttccttccttccttccttcctcccttccttctttcctttctttctttctttctctttatttttttttctgtcctgcccactcatcaccacagaaaacttctctattatcccctcggatttggggcttgtggtggaatataggttataattagttcagccttctttcaaaatgtagcgttctgaagcttcaaaaggaagtgtttcttataagactcccaccttgggtaggccatggacattgacttctgttcctctcaccacctatagctctgaattgaaacccatgtgtgcagtattgaccagtgacttcaggacataagtatctttgttaccttaatattccacttgtgtctagttacaggcttccactcaagtgtattccaacattgttcatattttattaagaagtctgatctgaataaatttgcccaccattattctaaatcaagacccaggagaaattttctctaatgatattttgacaaacacgtatatactgtgtggggaggtggagggctatagtaagaagagcaggctttaatcttcgttccaccatttgccagccatgtaactttggacaagtcagtgaagacattcaaaccttggtttactcatctataatataaggaatatagaattagtgacaataaatacaaagcatagctttgtatacaaattatgtatacaaatacatagctcttaccattattattttcatgtctccatgacatttttatatgttcttgacttgaactttaattaacttttggattaataatttgtctgttttaacatcttgctttcttaaggacaatggaatatcttaaattgttttttataatcctctgtattagctagcatagagtaagtacttattaattttttcagtttgttcaatacatccagacacttgctggtctgttatgaaagagtatgaaactttttgagtgattatgtgcaaggattctcaatcacttgccatcacaatagccattttcactttctttatagcacttgtcactatttgaaattatatttctctattatatatttacttgtttgttccaaatagaatattaattttcctccctaaaatttcggatctatcacaaagtgggtgtttaatggatatgtattgaattaaaaaaagaataaattttacaggaatcaaggagtgggagctttttgtgacattgacttttcattggtatttgtcatctttctcagctcctatacttctggaaaatatttattcttaatttggctaattgttttatttattgagaatataaactttccctgaaggctaaagtttggcccaaagagtgaggaaaatcagctgttacctgtgacatgggttaaaaatcttcttacaaaatgagaagtgattacacatgtagggctttttcattacattaaaacaataacagtcctgggaatactgactatcgaaaggcagaagaaggagactagacacctatctctcgctacatacaaaaatcagctcaaatgattaaaggcttaaataagaggctcaaaactatgaaactaccagaagaagacacacaggaaatgctttaagacattggcctgggcaaggacttttaaaataagacctcaaaagcacaggcaacagaaacaaaagtagacaaataagactacattaaactaaaaacctttttcacagcaaaggaaaaacagagtaaagagacaacctacagaatgggaaataagatttgtaaactatacatctgacaaggagctgataccaagaatatgtaaggaacttaaacaattcaagagcaaaacaacaaatagtccaattaaaagtgggcaaaagacgttaatagacattccttaaaagaaggcattcaaatagccaataggtacatgaaaaagtgctcagcatctctaatcatcaggaaaacacaaatctaaaccaccatcagataccacctcactccagtgagaatggctataattaaaaatactttttaaaacccacaagtgttggctaaaatgtagagaaaagggaacacttacacactgttggtgggcttgtcctcgagaaaacgtagttttcataattttaatttgacaaaatttttaaaatcctggaaatagtaaatatgttacccttcaataaacaacaactgattaatagcttgggtaagagttcagtacatacttctagctacacaggaggttcctcaaaaaaaaaaatatagaaatacaatataatccagcaatcccattacttgtatactgtatattcaaaggaaatgaaatcagtatgttgaagaaatatctacattcccatgtttattgcagccctgttcacaacagccaagatatagaatcaacccaaatatctaaaaatggatgaatggataaagaaaatgtggtatatctattaatcaacaatgaaaaactatttggctattagaaaaaatgaaatcctgtcatttgggacaacatggatggatctggaggacagaacaaatacctcatctgtggaatctaaaaaaaacaaaaaacgacaacaacagaaaatattttaagaggtgtttttttgtttgtttgttttttgtttgtttgttttatcacagaagcagagagtagaacagtggttaccagagatgggaggagttggggagaagagaatgggagagattggtcaatgcatacaaaattgcaattaaaatagatgaataagatctgggattctattgcacagataaacaataagatatgatatattacaaaatagcaagaagataagcttttgaatgtcctcaacaaaaagcaatgatgaatacgtgaggtgatggtcacactgaatgtctggatttgatcatttataccacatgtatatgtatcaaagtgttaaaatttaccccaaagttatgtataattatgatgtatcaatttgaaaacaaaataaaaaattaaaacaataacatgattcaggtactaatgtttacccacagtaaaagtaacattttattactttatcataacatgtatattgatatttgaaagagaagaaaataataacactatgtagctagaagtatgcactgaactaactctttcccaagctattaatcagttgttcattgaagggtaacatatttactatttccagggttttgaaatttttgttaaattaaatctatgaaagctatgttttcttgtggacaaagacaagagatgcttcccttttatcctcttctaagaatgccctaatattgtctctaggatttaccactttggcacgttagttatattgtttgagcataaattgctaagatgtaacagaaaactgtagctttgaaggtcctacataaggcccacaatatactatggaagcctcttcttggttcagaaattctctcctgaccagaagatccaggaatgatataatgagaaagtgtcataaaagtgggggaagagtgacacaaaaaccagctgcaacccatcctatctaggttgcagctggtttttgtgttagatgcgtatgtcagaggttttttttttcagtcagtgtacatcaaatgtgctgtgaataaaagaatgaggtacatggcttccatttctattactctccactctgtaatagaaaagctgaaattatatcaaggttccataaattcccacagttctagaactcggactgacatctttaacttggagtataattatttagttcaggctttgtcacctagttgattataaatacttaatgcgtacagagatgtttaatatttgcattagagtctttagtttgcaaagatcttcacaaatatctaatcttcagagcagctcttccctagttaatctgaactcaaagctgcttaggttataggtattttagtattttcaacccagggaaaatataccagtttccttttaggaaccctttaaactacctaactgcaacctttattattattattattattattttgcaggggagaaatagttgggaagaaaaggttagtctatagtgttattcccataatcaattagagataaatcaaaacccctgctcctgtcaagacaaatatgtttctctttagttgtgatttctcttgtgtcagtggcaggaaaagaatcatacaaaccacatacacatgaatttctgttccagtatgagcagtccaattacagaacctgcccactctttgtaccagtttctctatcaaaggtcctgactttgaaggttggtgattcgctcactatgcaagattatctttttcattgcatggtttcttctttagtgaaaaatctctgtttctgagcaaatgtcatttcttgtattaaactttatagctacccctctgtgatgtgatattccatttcgctggaatcacttgtatatttttttattatgtcctctcccaggaagctcatctaaatcacagtacctcaccaagatttgtttctctcataattgttcctacttaattactgtgtgcacattggacccttccaatgtgctgagccggtcttagagatgagaggatgaactatgaaaataagatttagcatatgaagagaataaggctgaattagaatgggagagggaatgtgtttgtatatgtgtgtatatttatatatgtatgtatatgtatagattatacacatacatatatactttgtaaatgagaaatttatactcttttgcaaagcaaatgcagttgaccatgtgtagatcttaaggcaattttttctgggacgacagcatatatggtattatattaattttttaaatatattttcaacttcttattttagattcaggaggtacacgtgcagatttgttaaatgggcacattgcatgatgctgacgtctgggatacaattgatcctgtcatccaaatagtgagcatcacacctaacaggaagctccgcttccttccccacccccagtagtccccagtgtctactgttgtcatctttatgtccatgagtacccaatatttagctctcacatgtaagtgagaacatggagtattaggttttctattcctgtgttaattcacttagtataatggcctccagctgcatccatgttgctgcaaagtacaagatttcattctttttatggctgggtaatattccatggtgtatatgtaccacattttctttatccaatccactgttgatgggcatctatgttgattccatgactttgctattgtgaatagtgctgcaatgaacatacaagtacttatgtctttgtggtagaatgatttactttcttttggatacataccaagtaataggattgctggattaaatggtaattctgtttcaagttctttgagaaatctccaacctgctttccacaatggctgaactaatttaccgttccacaagcactgtataaacatccccttttctctgcagcctcaccagcatctgttgttttttgactttttagtagcagttgttctgactggtgtgagatggtagctcatcgtgcttttgatttgcatggctcacatttttaaaggaatttgtaataaataaacacttgcaagtacctaacaacttgaatttaaaatatatgaagtaaaaatggtcagaattgtagggaaaagttgacaaatctataatcatcacaagatattttagcacatctctccgaaaatctgatagatcaagcttataaaaaaatgtaaaaagagagaagatatgaatgactcatgtaatagttacttaacatacataatgaatggtataaatcaaattactgcatctatcttagtgctacaggcataacttgtaatagatatttaaatgtaaagtattacttattgaaaagtgaaatagcaaagatgttttctctacatgactcccaactaaagtttgtttctttgtgtttttatctttccttttacatgtagccaaaaatcacggtttctttaggaaaaaaataaatcagcaaaattggttcattaacattcataaagagcttagtctaggccaagcgcggtggctcacgcccgtaatctcagcactttaggaggccaaggtgggcagatcacctgaggtcaggagttcaagaccagcctggccaacatggtgaaaccccacctctactaaaaatacaaaaattagctgggtgtggtgacccatgctactcgggaggctgaggtaggagaatcatctgagcctgggaggcagaggttgcagtgatctgagatttctgtcgcccaggtttgagccactgcactcaagcctgggcaatagagcaagactctgtctctaaaaaagaaaaaaaaaaagagcctagtctaacttggttagaaagaatctattcaatcttttttttttttttttttaagtgccatctaaacagaacccatctcagtggcatgttgttgccctggccattatgtataccctaaagaattatatttcaaatgttaatctatgttagaatcacctggagggattcttcaaacaagattgttgggcccaagatggggcccaggagtttgctgggtttttttttttgcaatggaatctagctctgcctcccaggctggagtccagtggtgtaatcttggctcactgcaacctctgcctcccaggtttaagcgattctcctaccttagcctcctgggtagttgggattacaggtgtgtaccaccacagccagctaatttttgtatttttcatagagatgaggtttcgccatgttggccgggctggtcttgaactcctaacctcaggtgatccacctgcatcggcctcccaaagtgctgaaattacaggcatgagccaccgcacacagccaggaatttgcatttctaagaagttaccaggagacagtgatgtttctgggttgggagccatgctttgggaattgttctagagcacatgagcataaggctgctaagtcatcagaattccccatggtgcatttcagatgtgggttgccatgagtcctgagtgtgtagaacaaagcagtgctttaaactagaacaacctcaaatgtaagaagaagtttaaatatgtaatccaacattggagagaacagtcataatgtgaactgtaaagagaagcttgttgggtagcttccaaaaatgagtagattttacatttcagattatgttacatttccttcatcactaaagcccatatgcacgtgcactggaatatactctaccctctgattcctctacaaagggctcaaaaacctcccaggcaaagctagttctttctccatgcttgtctcattcatgaataacatcaaacaatattgtacaatgacttttgccatatgtttctctattaaactggaagacccttgaagggagagagatttgattttgattatcatgtacccaacattgtgcctgaaaacatgtgcactcaataaatgctgtggcatgaaagcccttcaagagcaaaggtattaaattgtccatcatcagtcaacatgtcttcctggcactgggtggagtgcctcatactgaattaatatttattggattaaactgaaaggaaacagcaggaaacaaactctaacctcttcctgtattaggtaccaggaaaaaataaatccccaaagcaggtatgatcttgtttcctgttgagccactccaaatgggcagataaaaccatctgctcttggtccaatgtagaatagatggtacctcaggttgcagggagccatcctggttatgccacctctgtccccttgccacattgtccacacaccatccctgctcttggtccatgcattttgtgttgctgttccttggtaacctctgccactgcctatgacagcccgccactggtactatgttatgcaaattgccagcctcaatacaaaccctgtctatgaagaggcacttggttggcagagtgaaaacacagagtaacgagatgccatctgcatttcctactacatagctcaattagttgattgatttgtaacactttaaaaaacattttctaggcaaagcacattaggagagtgttttataatgtattcagtttaattaaaactgcactaagtggagtactttgcttcttggtttgagaaaaaaaaaaatttacaaggaggtcacatatcatattgatttttaaccccctaagcaggagtaaaataacattgttaaaggttgcagcatctagagccacacaagtgtacctctttaaaaggtttgctgtaattagaatagagaagattggttagtaagagaaaacatgaggatgccgtcataaaatgggggtgggtaggtaaaggagggaagctggtaacatgctctgaatttgaataaccaacaacacctgctcctttttgcacacaaaaatgcttttatcatctgaagggggaaggaaaaacctgcaaccattccagatgaattcaaggcttaaaaacaagttagaaatgtttaatgtctatgcaagtctttactattaaggtgagtgcattaaaaaccttttggtaggacagttttccaagtttggataattttagatgttaatctggctcctccctttcacatctcagatcgttgttaccaggctgctttctcctcattcccactgcctgtcacattaccaaatgcaagcaggcttccgaattgttagtcagctgattaaaccctcaaattattggagacatttgcatgggtaattatgatttatttaaaagcactttgtttgcattgctcttgtctcagtttcttcaaagccaattactgaaaaattgattggattggtttgatttttgaaatcatttggaacttcagaacacatccctttgcataatttttttgaaagtaaaaccaaaacaaaacaaaatggaaggagttctctttgaaaatctgtatgcttcatgtctttggaacttctgtagtatgcaaataagtggttaaaattagtagtagaaacagtaatagttatttttcaatagaaggagagatcagagtaaatcagttaaattcactgtttcagctccatctcattttgcaaagttacctgtacttagtagggcaatttttttttttctaattctgttggacttctaagaactagaaggattattagccaggatgctggcaataatactgccctatatcaaaggagattatttttctgatgaatatgttgatacttcattatttaaatcctcttttggaagaatccaaaactgaccaatctaatactgaattctaccatctactgtagaaaatacctccatgagtgtcttagtttaagctactataataaaatacaatagactgggtgatctaaacaacagacatttatttctcatacttctagaggctgggaagtccaagagcagattcggttcctggtgaggaccctctttctcattttcttctcactgtgtcttcaaatagataagagatagagaagagagagagagaaagaactcttacctctcttcctcttcttataaggacacaaatcccatcatgggggccccatgctcaagacttcatctaactttaactaccttgcaaatatcccacatccaaataccatcacattggagttagaacttcaacataagaattttgggaggacacaatcatttagcctatgataatgaggttctgactttgtatctactccttcccaaaccatgcccacaaaaagtctcaaaatattgcctttggcttatccattcactttttataagcgattccaaaacagaagatacaattaccattggtttcttaggatagacagttgctttaaaaatattgtaagcaaataattgttgggtatttattacttaaaagttaataatttatgtataaattaccaacagctcatttctatatgataagggtgtctcagaaagacattttggaataatacattcctgtaattctttttttttttttttttttgaggtggagtcttgctttgttgcccaggctggagtgtagtggcgggatcttggctcactgcaacctccgccttctgggttccagccattctcctgcctcagcctcctgagtagttgggattacaggtgcccaccaccacacccagctaatttttgttttttttagtagacacggggtttcaccatgttggccaagctggacttgacctcctgaccccaagtgatccgactgcctcagcctcccaaagtgctgggattacaggcgtgagtcactgcacccagtcttttttttttttttttaagaaactgggtcttgctctgtgcctcaggctgaagtgcagtggcacaatcatagctcactgcagcctcaaactccttggctcaagcgatccttcttcctcagcctcctgagtagctgggactataggcatgctccaccacacccagctagttttttagtatttttttgtagggatggtgtctcaccatcttgcccaggatggtcttgaatgcctggccttaagtgatcctcctgtctcggcctcccaaagtgctgggattagaggcatgaggcactgttcctggcctaattcggtttattaaaggaccccaggccgggcacggtggctcatgcctataatccctgcactttgggaggccaaggcaggtgcctcacaaggtcaggagttcaagaccagcctggccaaggtggtaaaacctcgtctctactaaaaatacaaaaattagccgggcttgctggcaggggcctataatcccagctactcaggagactgaggcaaagaattgcttgaacctggaggtggaagttgtagtgagccaagattgcgccactgtactccagcctgggtgacagagcaagactccatctcaaaaaaaaaaaaaaaaaaaaacagaaatggaccccatagtcattctatccttccaaagacaaagatgttcaaagatgcctctgtgggaacccgttaattccataaggagcgttttcactaagaatataatgaatccatgccaaaaaagaaaaaagacaatatagtacttatgattttatatattactaatggaactggaagtaaaaataattactatttaattacagaaatgtgtactccaatgcacaaatgcctgatagaggataatgacgttggacaccaaaaacgttctgtggctgctggggacatttggcaataatttacatgtttaattgagttgctgtgaaaggctcattgtgcaattacatgttcacttaggtgctcagatagatactggaaatgcctaggtttcacttgtacctatttcccaaattgcgcctgcaacaaatgtgtccatttgcttatgtgggactctacatgtgattgcactctaccgggagtttaaagtgccttctgcccttaggtttgatggctcagtcttgctttgagcactattgcgacgtagactatttatgggacaatattgccctctggcagtgaggcagccagtggttttaataactgttttatgtcattttgacagtttttaaactagtcacacccagcagtttaggccagaagggaaacatcagtgaatgcctacaggagttttctattacagaactcgtacatgcatttgtaccaggaaaatgctacaattcttgctttaaagcaaagctgcctttcccaagaggagaactgaatttttgccgcgtaaagcttcagaaaagtgcaaataataatgacaatattgtgctcacaggacaaacagagaatagaaccattctccctttgagaaattcatgactggagtgccacaaagatcaaccccacgtgagccaatcacaaaacatcttcctgtaatgcatgttcagacactcgtgggatcaaaaaaggacctcagggtcatatctgatcctttggattgaatcatcgtgaggagtgtctcggcttcacgaaaatgacccagagctgctcgctgaagctggagaaaccaaaggcttgacagcagctgccaattcctggaggggtatctcagctgcttctcagccacttacgcaaagggaatgcctcaagagagccaggtgggctttaccagatggggctgaaattacagggagtagaggctctgctatgttgagaagtgcagcttcggcagacagctgagaaagacacagctcagtaggcacctgcctttccagcccagtggctgctgcaggaaacatttctgggatcacagaaggcaactctggatctcatcttggtcattgggacaggaaaaccaggcactgcacggcaaccccacgcattccttccttgcttcccactgcggaataggtcatgcatctctgggggcagagtgcagggagagagggcaggaggactccccaggagagggaggagaagataaaagtagcaatttatgcttttacttcaagcatgcacacaccgacatctagcaaaatgcctggaagtaccctgcacactgtttttcagctcatatttcctgagtgaccttatgtgaatggacacagacactgtggttcaaaagggaccaaattcgcaattctatttcaataaaacaaaaattagggattttgaagttaagatgagatatgaagaaagccaaaaaggaatattaccacagaaggagaaaaaacaaaaaggctagattcagaaaactgagtttaaatgaaacctagaaaggaatttcagactctgcatatattgaaactatcaagagtccataacatgaatgaaatatactgcgtacagtcatttagataaaagtgttttttgtttcgttttattttgttttgagacggagtctcactctactgtccaggctggagtgcagtggtgtgatcttggctcactgcaacctctgcctccctggttcaagtgatgctcctgcctcagcctcccaagtagctgggatcacaggcacgcaccaccaggtccagctaatttttatatttttagtagagatggggttttaccatgttggccaggctggtctcaaactcctgacctcaggtcatctgcctgccttggcctcccaaagtgctgggattataggcctgaacctctgtgcccggccaaaagttttgaatttttaaaacttatcctgtttaaaaataagctaaattattatcactcaaatacaacctcagtgcaaaagggaagaatttagcttagtaaataattaaggcaattgttttaattgtgcaagagataacaaaaatcgcttcaatgatctgatcaattgagggggagaaaaaggctattaaagcctattttaaccatcaagagtatgtgttacacgtatatccacattttgttataggcaaaattcaagaacattaagcatgtcactgaacatgaaactaagacatgaggagacagggttggggctatggtgtggtgactcagattttacagaagatccaatccagaaaagctagagcgcttttccccaaaatatgtaccagtctcggccaaccgctcaatcactaagccttgcaaataacctattttccaaatgatttcaaaagaaaataatgcctgccaaagcaaagcaactcattttccccagtaatgactgcaggaagacctttgatttccttctcagcttctaaagctttctttaaatttccctatttacacacagtgtttcacctcacagattctcctttcaacagctgtgtgggacaggaatgatgcccaaggacatgcagcccataggttttattttgttttctttgggtaattttttgggcagaggtgatatgatttctatctgaagcatttaaggaagaaattgagtatgccaattttgacagatgatagaataaaagccccagctatttctaggtttgaataataataataatggaaataatggcaataacaataacaatgataacaagtgccataacttcttaggagaatactacagactactgttcatacattttttcagtaatcacagaaatcctgtgaggcgaatgttactgttttcatcttactcacgtggaaagtaaggacaaggcaggtgacattgattactccagggccagagctagtaagcatttgaactcaggtctgtctgccctcaattccatgtttttagaccttgtgctactgttatttcttcagattaaaagatgcataggtgggctctggtagacaaattactaaccattctacctaaacctccctgttcctacaccctttgccatgtgaccttggagctcctcccactaaaggagcaggtctgtttccccaaccactttgagcatgagtttgaccatgtgacttgctttgaccaatagaaagaagcagagttaacagcctccttgtggctcttagtccaggctttcattggccttggtgcagctgctcatcctcttgcaccctgttatggctatgagaagaatattcctggccagtctgctagtcccaggagaggggtgagggacatgtaagataaaactgttctggtgacttgctaataaccaaagaccatccagatattcatgagcactactaaacgatcattgctatctgagttttgtcattgcttgttacaattactgtaccatctataaggtctatttgaaagaatatgtgcccaatgagtgagtgtacgggcacatgcacaacatatacacataccaaatggagtggaagtcttggtgtcttacatccagataaccatttggtgagaataaattcattaacaacaacggtaagggaatttcagtattttggttttcctttagaaagctgtaaccattctatttgctgctcagttctcttgttaaaagccaagaggatgttttcagacagtgtagctgcttagctctggttttggtctttgatgaattttacctgataactgatacttaaagggaccctctgcgcaccgccactgacatatctcagtaagagggagacatcttgacccctgaagggcagtgacagttcagtgctcctctgtcgagcccatcctgattgcgctcagtggcagaaccacccgagatggttttgactttgaacaacatcagcagtgagttgaattgggaagtaactttacaacatcaaagcctgccatcaagtggtatcatatcattttatgatgtaagacaccagacaaaggttgaatgaaggaaaaagaagtgtggtgtgcaagtatatattcaccacacacacacatacacacaaacatcacaggcatttgaaggtgttctcagattgtgactaggtgaaagtgttctttataactttggcttttgatatatttacctatctggcactagcaatgaatatttgatacagtcatagctacatgcttagactatgactaagtataatagaagaagtggagaactggcctaatatggacagaaatcagatccaaataatcttgccttaaaaaaaaaacacagatttttgtctcaatgttctatttaacatgctttctgctaactcaactgagaaaattgaatttgggtcaattgttacaaatacagaccaatgcattcaaaggctgtgtagtttcatggctaattgattctgtttaggtaatatttgcaagaaaattacttttataatgcatgaataaaaagatacatgttatgatagttggaaatctgtgaaacataccctaattttctaatatcaaagtaagacataaatatactttgatttgagctagatttttagcaagatttgcataatttcaataacatattaaagagttacatttgtaagtgggagggttgcagggtttagaaccaaactggaagaaaggctggaagtggccagccagttgaaacaaagccctgccattccatagaagagaagtgtatgatgaagagaaagctggctgtgctgtgcaccattatctgccacttttgccttgttaaacttgccactcaatttgatatgacctagtgtttatgttctattttgaagttcttctatgtcttctattttatattatttttttctgttatattgatctgattaagatgaacactgtcacatatcattagcaagttctgattacttgaccattagaaagaatatttatttgttctgttcatccatttaataccaccttgaaattcatagttttctacagggatgtctaataggcatcttaaaattaactgtctaaaaggaactcttgactccttcccttccaccaaacctgttttgcccagcctttcccgccatcataaatggcctcaccattcacccatttactcagacccaagcctagggattgttcttgatttctctccttcccttgcactccacctccaatccatgtgccagccacctaccagttttattattaaaatacgtcttcttccgatgccaccaccatagttcaaaacatcattgcctttcatctaagctgctataaaagcttcctgatgggttttcctgatttgactctttccccttatattggattctcaggcagcatccagggtgagtttttaaacacaaaatcagatcacagcaatttcttgctcagaactctccagtggtttccaagcaccctctgaataaagtctaaatttctcatctcagcctacgatgacctttatgatttagtccctgctaatctcttggttttctccttctgctctctgctcactctacccatgctggccttcctgctattctccaaatgtcccatgcttgtgtccacctcgagccttttcacttgctgttccctctgcttggaaaaccacacacaacccccggtctttgctgccttgctctctcacttcttctagtgacatttcttctcaaatggcacttcctcaaagaggtcttgtctagctaccctatcagacatagccctccatgctctataggctcttaccccttggccttcattgcagtgcaacctgctatccattgacagctgggttttcctctcgaagaaaggaattctggatgcaattgctagcttttccttattattatttttaatgcaaacaaaacggcctctgctgccagttcaaatactgagctcagagctctgttctttcctgctgaaatttataattctactcccattcttctggttctccttgccttataaacaacaaacatgtgaaccaatgtgacttctatattatactgatgattcccctatttaccaataaagtgtgatctaattttcataacagaaacattcattattgaacggtgtattgttcaggtttgtaaatgtgtagaaaatggcacaagcaaactgaaatgatacatgcaaatctattacggtgggaaagaatatttttatttttcaatctataaatactatgattatccttcatatactgtttgcatatatttatgtgttttttgtgttaaagagggaaaacataaaaagttaatgagatcctgaagtgaaataaagtgaacatatttacaacagcaacaagaaaggaatatgtcaagatagacatatcacagagatatatacacatgtgtgtagataagattggtgagatagacagataatagagcttgtacttggcctgccttcacccaatgttgcaatgacaatctatacaatgtaagtatttgtactttttatactttcaagaaaagcagatataaaattaatgcatatactttttgtttttggcatcctttcatggaagcaataaaatattctggagagagagagaaagagagagataaactaactcagggatgtgagaagaagaaaataaatatcactcttactcctccatctgaagatgatgatggaaataattgtcatatttctcttatgttttttatttgttttttctcccagccaagtatgctttttagtgtgggtctctgtgtgttccctttggtaatgtctaataacatttctaacctggagatttatttcttagaagcaaagttctgctcatcacaagccatctccatcagagccatttctccttatggtttccttctcatcatttaatgcttagtacttcttcacaatagaagcaagctgcctttctaagggatgaactgatattctagctagaggacttaatattccttttcagaaattgagaggttctctttgcttttctaggccttaattaagtgattggttatttcataaacagtcagattacatttaccactcacaattgtcaaatttttaaaactcaagtaaactttttttccttcttcaaacaagtctcttattctctcctgaagttaatggcgggcattactaccagtttcttggccagctgctaaggagattcctttcccttaaaaagttaaagtatttaagaatcaccctcaaaccccaggaagggtggtcaacaaaaaaagatgtcttcatggtcaaactttatggacacaacaagaatcccaaagaagggagatgactcaagccatcttttattacttagacgatcgatggcgatgatgtggaatttgcaacaattcttttcttgagacccagtaatagttaccttttgctacataacaaaccgcctcatagtataatggcttaaaaacagacatctattatatctcaggactcttagcttggagttctctccatgcggggtctctatcctcaactggctggcccaggcttgttttcatggtggcagaagggatccacctagccagagggcgagcccccttgcacaacacttttcatgtctctgatcgtgtaagatttgctatcgtcccactgaccaaagccaattacgtgttcaagctcagattcaaggaaggagctctcacttctcagggcagtgctgccaagagtttatgtacacttcagcaatctatcgataccacaaatatgagaggccagctttttctcttttaaaaaaataaagcttataaaataacacaagtacataatttccctacacaatgagtaactagattttatgttttctctttcggttttcctcaaaaacttgtatagatcatcttttgagatgaatagcggagcccttgtgatacaccacattctaagaatgctggggacactgtattcaacccaggacagctgcctaaggttgtatagtctgtgcaccgcatgatgcaggagatgctattcatgccatattcctaaaattttgtatatttattgcaataatttcctggcaaacaatagttacatttctagagagaaggactgctttttctgattcttacaaaaatgacttgttgatttgcaactcatgctgacaagccatcctttcttaaatgaagaaagacttgtttaaccaatggcaaagaattctccaccttgtattgattatctttagcccctcatttcttctgccttgaagtgcatgatttttcctgttttctagagtatgaagtcactttagtcttaagtcttatagattgtgttagatcacattcatgtttacaagccaaatatttcacaattttcaagtaccttgtattcattgttaattttccaagtctgaaattgtttctctctggactcatttttatttcaagttctactctaaatgatttttctttttctgtttcactacataaagttctttcttcctctcaggggatctctgctaatccctttaaccaccgattgccaaagacattcacaacccctgtgttggcttatttctttgttaagtaaaattttttcatcctttgaaattgaaaacctgaaacattttttcttaagtctatgaccaaccattatttataaagctgtatcatatcttagaattagcatattagcatcagttgcaaaaaaaaaataggcaatagagaaaataaaagatatatgtatatagcatgaaagttactgcaaaaagaaaatgaggctgtgtgtgtgtttgtgtgtatgtgtctgtgtgtgtgtgtgtgtgtgtagtcgtgcatcgcttaacaatggggaaatgttctgagaaatgtcttgttatgcagtttcatcattgcacaaacatcatagactgtgcttataccaacctaaatgttatagcctattacacccctaggccatacagtataacctattgctcctaggctacaaacctatacaacatgttactgtactgaatacagtaggcaactgtagtgcaatgatatttgtgtgtctaaacatagctcaacatagaaaagatactgtaaaaatatgatataaaaagataaaaatggtccacttgtatagggcacttaccatgaatggagcttgcaggactggaagttgctctgggtgagtcagtgagtgagtggtgagtgaatgtgaagtcctcaaacattaccgcacactgctgtagacttcagaaacactgtacacttaggctacactaaatttacaaaaaatatttttctttcttcaataataaattatttactgtaacacattttactttatgatttttaacttaattttaactttttgactattttgtaatcatacaatttaaaacacaaacacattgtacagctatacaaaaatattttatttctttatatctttattccgtaagcttttttccatttttaaattattaattttcatgtatgtatttattttcacttttcagactttttcgttaaaaactaaaacaaaaatacacacgttaccctgggcctacacagggtcaggatcatcgatgtcactatcttccacctccacatcttgtctcactggaaggtcttcaggggtgatatactcatggagctgtcagctcctgtgataatgataccttcttctggatacctgaaggaccttcctgaggctgttttacaattaacctttttaattagtacaggagtacactttaaaataatgataaaaagtttaatatagtaaatgcataaaccagtaatgcaatggtgttttgttttgttttgtgtttttttgttttttttgagacggagtctcactctctcacccaggctggagtgcagtggtgcaatctcagctcactgcaacttccgcctcccgggttcaagcgattctcctgcctcagcctctcgagtagctggaattacaggcgtgcgccaccacgcccggctaattttgtatttttagtacagacagggtttctccatgttggtcaggctggtctcgaactccgaacatcaggtgatctgcccacctcagcctcccaaagtgctgggattacaggtgtgagccaccacgccccacctaatataattatttattattaactattatgtatgtatataatcatgctagacttttatgtgactggctttgcagtaggtttatttataccagcagcaccacaaacgcatgaataattgtgcaatgataatagtgcacatgagtagttgtgctctgacattatgatggctatgacattattagacaataggaatttttcagctccattaaaatcttataggaataacactgaatatgcagtccgttattgaccaagacatcattatatggcacatgactatatatatccttaaagttattatgaaaactaacactgaatctccatatttacttctcttcgaagagtttaaaggattctaaaatttgtatttgagagtgagtgtgcaagaaataaggaaggtcagaaaagttttacatttgttaatctcatcctgagagtattttttgtaaattaaaaatacatgtattttcatcaacaactggctcacattccttaaactattaaagttcccaggtagacacacatgcatgtgtgtgagtgcgcccccccacacataatgatgtgttttagttttgcatctgaaggaaaggaatgctaggttttcttgcccataaatttatttttttaatttattttaattttcttttttttttttttttttttttagagatagggtcttgctttcttgcccaggttgctgtgcagtggcatgatcatagctcacagcagcctcgaactcctgagctcaagcaatccttctgcttcataagtcactgcatccagccttgcccacaaatttctaattttacctcttcttctttatatcttctgagaagaaagagatgtttcctctatcagtggtcatttatagcctttctaagtctaaggaagaattgtggcagacataaagatcgttgaatcaggactaagaaaagtagattctagctgatcttgaaagactgacttcacttctctggggagatgatgggtttggatgaaataattccagaagactttcccatttttactcatctctgactctattacagcttttctatttcacccttgttcccaactctcatcaggaacttaaaagaaagacacaaactcacaaacagcgagaaagagagacagagaaaacaataatgtagggtatcagtcatctattggcacaataatgctgcataacagaccatcctgaaactcagtggcttacaataaggttttgtttttttaattcacgtgtgctggagcagacctgccttaggctgtaggtcacccaaccttggctccaggctaagatcctgaaagaagggctcaaatccactccctgtgtcttaatctaagcccttagataaaggggccacctcctgggacacaccctcctcctggcaaacaatacaaacataggtcctggccaaacacccaagcacacttaaaccttcttctcgtgtccaatctgctgacattccattggccaaagcaagtctcgtgatcaaactccaaatcaatgaggaatgagagtgtgttctgtccacgggtaggagggatttggaaaagccatagatatttgcagaacaataatccaattttccacattctgctacaaatatcatacactgaaatgccttcagaaactgacaggaatgaagcaaacagcagagggaacacaccatcaaaatcaggcagcagggactcagcctcagggtcaaatgtctcttcttcttgtgtttgtttttttcttttgagacaaggtctccctctgttacccaggctggtgtacagtggcacaatcatagctcactgtagcctttacttcctgggctcaagtgatcctcccacctcagcctccaaggtagctgggactataggcacacaccaccacacctggctaattattattattattttttttttgtaaagatgggattttgccatgtagttcaggctggtctcaaattcctgggctcaagtgaacctcccaccttggccttccaaagtgctacgattatggatgtgaaccatcacgccctgccagatgtttgatttttaaagaggggagatagaaagtcacagtcttttgtctaaattttctatttaaaaaaaaaaagttagaaagcagcttactttctgtctgtctgtatacatatggaaaattacatgtatgcatatgtatgtatgtgtatgtagatgtatgtatgcatgtatgtaatatatatgtctgggtaaaacaaagcatctgcagaccagatgtaattttgagattgttatttgcaagctttgactagaaacctctcttgtttaccaatatatgaccctataattacacatctaagatagttttaaaatctttctgggccaggcacggtggctcatgcctgtaatcccagcactttgggaggccgaggtgggcggatcaaaaggtcgggagatcaagaccatccttggctaacacggtgaaaccccatctctactaaaaatacaaacaattagccgggcgtagtggcgggcacctgtagtcccagctactcaggaggctgaggcaggagaatggcatgaacccgggaggcagagcttgcagtgagccgagatcgcgccactgcactccagcctgagcgacaaagtgagactcggtctcaaaaaaaaaaaaaaaaaatatatatatatatatatatatatatatttcttttgtattcaatgaggccataatttcatcctgccccatgcagagttaacacgtggtcaagctctttggcctaaccttgtgtagatctttcctaaaaactaaggactgtgtacctatgatgttacaatgttgcattactagagaaacacaggatttactcagcactttcaagtacatacattgacttaatccacatagtaagtgattctattagcattttgtagatgagaaaactggggctcagaaaaattacatgaaattttcaaggtcgtagggctatagcagagctaggtttctaggtcatttaactctttctcaactggcaaggaagctaagtaatcacagattcacagaacaccaaaagctgttctggctactgttatgatttgattctaatattaattatgtggttagaatgattgtattagtctgttttcacactgctataaagaaatatgccagactcaggaaagaggcttaatagttcctcatggttagggaagcctcaggaaacccacaatcatggcagaagacgaaggggaagcaaggaccttcttcacatggtggcaagagagagaagaaagaaggaggagcttctaaacatttgtaaaaccatcaaatattgggtgcaccaaaatctcagaaatcgccactcaagaacttactcatataatcaaatactacctgtttcccaaaaatctattgcagtacaaaataaatttataaaaagaaattaagcattgaaaacagatatttctttcctggaaaaaaaaatcagatcttgtgagaactcactatgacgaggagagcacatcacctccctcttaacacgtggtaattacaatttgagataagatttgggtggggatacagagacagaccatatcagtggtatttcaaaatatcttccttttgagtcatttaaatcccttatttgatgcagagatagtaaaagccctaccagataatcaggaggttgctattatccttttttgtactttgtttcatctgctcttatgtctttgaacctcatttccgtcagatgattaaataatgattatcttgtctacaaataattggttttgttttgtgatttcacttgacctcaagtgacatgatacagttttaagaatgtcacagatgttaagttgtaaatcagggagtgctattttttttaatcagagaaatatgatgattcagtgtttagaacatattctttaaaatgaggggacagagattctaaacttgattctgctgcaaatcagctatgtcatttggggctctgacatctcattttactctctgaatcatctaggaaaaagtaagatgatgattacaaagcactgggagctctttcaaaaggcacagctttcatctaaaatgatattactaattaattaatcagatcaattccctgttaactcatcctaatagcccaagccctgttagccaagtatattactgtgatttattttgacacttaatggaaccgtgcagcatttcagtcacaggttgataacctaagcattataaacttcaagcagtgtttatagttttgttgttgttgtttttcctgaagacagctgataaaagatacccttttaggaggtgctagctacatccctcaaatgataaaaaatacaaagtggtgagtagatgttatgaacagcattgtccttaaaagagaagtcaccactgatctcgaagaaaagtttgcaaaataaggaagaagaagatgaggagatgcagtcttcatttcatttcttttcccaatattttgctgctgttttgtttttaatatcttccttggagcaatgaatcaaatgtcttccatcaaagaaaagcaatattgatatacatttgcacatagtaaaatctgcatgaattcacggctcctggaaaggaaaatattttctctctttctctcttcctgtgtttctttaatgtaataaaatagcttcccttggaggtcaaaggattctgccatttctcttttctgtgctctaagacagttgcaaccacttgttttgaaacttgcttttggttttggggagttttaatggaggtattaactggtgcctaaagggagcaggttatgtatatgtaaaagcagggaagttataggaaagtagctataaagactctaagcagttcaagagagttatgttaattgctgtttcaaaatgctcccctgtagtgggagccttaggcctccagaactcacttttctctcagtgactcttatttagtttattttcctttttatactgtgctttttagagttttcctggtctcttttactttgaaatctcaaaggctgtccctcggaggatccactgtttacttctgaacactttctagagattctgatgggtccaaattccccaaggagctggtaaaggtctgcttcctcccttcatgctgagtgtgaaagaagggaagagtctttcacttcaaacttcagagaggtctacctaactggagagtgaaccgaaactctgaggagcactggccagggagggggagggcagcacactgcactgtctcacctgggcattttcattgtcacccactatgaaagatctgctaggagaatcgagtttcagagaaaaaaaggaatgaacatattttgcatgacagcagtagtatttcccctctgttccccttctacagagaaaaaaaaaatgtgttaatgactttctaagaacaattactatataaatgtgacaaatttagattgaatttggatttgatcctcttctcacacccatttaaattggtttgtgctcctagctcctgtgccatatcctatgtggaaatttaagaatgacaaagttcataaatttggaaaggagaagtttgtttctcataaagggttgcagcttgcagggtggccattctgacgggctgagaagtgtagcctccagtcagaagccagaaacagacactttgagggaggggcaaagggaacaggaatttatgctgagctagtgactgaatatacatatttaataagctgtaggaggagtcatgaatatttgtgatagaagaaacatgcacagatccagcggagctttatgccccttcctgagtctcactacaaaaaaatggcagtacaagcatgatctgagggtggcgttttccatgctctaacatcaataggtgaagccaaggtcgcaaaaactcttactgcacattctccatagactggacagaaccattccatggtcagtgttctcttatcagccaaaaaaggaagggcagcctcaggcagatcagtagtgtggtcttttgaaagaactggtttctgtttagcccttagggaataaagcctaattgtgattagcaagggagggggtataacaaggcatgtctgacctcccatttcattatggccaataaagcagttttcaagcttattttggggtccctttggccaagagatgatctgttcggtcaggtgggggacttagaattttattttccgtttacatatggaatagccaaatattttatgatacactttgctagattgtgaaatgtttggcaaatgaaagaatgggacattttcggggcgaggggaaggtcagcgaattcatctcaggatatcctgaagaaatcaaataatgaggcagacaagaccacccttgaacagactgccatatttcttgagcttcaggaagtttctttggaatgccaaagtaagaataaagttggcctcccatgaatactagggcaatttggtgatgcttactcagatccaaagaaataaattataacaaaactggaaaagtacccatgaatcagggccaaatttataagcatacacctaaaagtatggaattccaggcctgatatgtgaaacgtaaagccctaaggcaaatatatttcatgtgggttggcataaggttgcttccattttcacagtattttaaaaaacaaaatgaagtttttggcaatgcttcacaattgtagttttcacttaaaaatacagatttctggcttctcttggaagactaggacacacatgcccaagaattgaatagcagctacttctttcggcagtaacatgaactcacctggtccatgtgttcatgtcttacccaccatcccctcacacacatactcccaagtatctgactcttgacacttcccttactcccttgacctgctgtacctctgttgctgttctatttatcaagcaggaccctgtcctctcccaaaatattctccagagtgatggactgtgttttctgggaggcttctctcacctgaaggacaaggttgacctgtctggctgcctttgctggctgatgctgactatttccaactcagctctctgctccatttggtgctggcttcttccagttgtggatcctagtctgtcatcttgacgacactccagaccacccaaaatgtcaacttggcagttgtttaaatcaaatcatataataaaataattaagctgttaggctgtgctgatatacattgatactcttagtacacacacctgcaagagtggtctctttgtaaactacatgacaacgagaacattcccttttaaaagttcctattttcaaatctgcctaacagcaacatatttgctccaaaactacatttctattttacaggagagagaacagaaaccaaagcaaaactaaatttcatgtcttgattactcaacaagagagtgtattgatgacacaagttgtcctgggttaggtagtgattatatttaagtgccatagaagattttcttggaagagattgcaatcactataagtacttagcattgcattgcttacatgaaaagaatgcgactgttgagaggaaaagaagcctctttagtatagattagtcttcctattgtccattaattatgaatgaaagttgaaattcggctcattgtgattcaatgctagattctataaaaacaacagtgcttgtttaaggaactgcctggaagatctgctttgctcttttgctggtgcagttacttgtggaggttataggaatttagggacatggatttttcctgttactacagcataaatatgttgtaatatacaaatatacatgtatatctgaatatgtatgctgtatatatttacacacacatacatattctaaaactcttctacttcaaccagggcagcagctactcttctgtttagttttatataatgaggttccatataagattatacttaaagagaaagtgccggtttggttaagtaaaatttagaaaaatactaatctagtccaactgtcctattttctgcatgaagagaccactgagagacatgttttttttttttcatcacactgttggttagtgacagagccaagttgattcttttttttccttccttccttctttccttccttccttccttccttccttccttccttccttccttccttccttccttccttccttccttctttccttccttccttccttccttccctccctccctctctccctccctccctccttccttcctctctctctctctctctttctttcgagacagagtctcactctgttgcccagactggagtgcagtggcacgatcttggcttactgcaacctctgcctcccaggttcaagcaattctcctgcctcagcctcccgagtagctgggattacaggcatgagccatcacacatggctaatttttgtatttttagtagagacagggcttcaccatgctggccaggctggttctggttttgaactcctggtcttgagagatctgcctgcctcggcctcccaaagtgctgggattataggcgtgagccactgcaccccaccagagccaggtttagaatacaacgctcccaactcctagtcagtgttctttgtactgtatttggccaatatgtattgattgtttgctatgcacagacactgtgccaagattgaatttcctcaggtgataatcccactaaccccatgaggtcaatcttacgtatgttagagaaaaggataaaaaccctcagggaagataagtaacttggtcaagtttgcacagctacaaagtgcagtgtcaaaaattcaagtctaatttaatctaattccaatgtcaataactgtactcttatccacttctctctactttcctcataaccatttttttcccaggttggtagaatagaccacaaaagccaactttgtgtgcatttctatatccatatataaaataatataccaaaatacatttgatcatggcatatttattaagtgttctatattactctgagctctattactctttaaaattttttaaattctattcataagcgacacataataattgtacatctttctgaacttcattcttaaaggaacaattgtagctgcatcgaagttgacatcagggcaatttctgcttcacagattttgagggcctggaagaagatttgatgagaatattttaatccctggatgaattttatttacctgtgtaggcaaaaacttagtaaaagatctttgaaccctaaatattttactttaggtacagaggttataaaatacctctgtacctttaggtacagaggttgaaatgaatgaactgttatcttagatagtatgccatttcagcatgagaagggaatctgaggatttattatctataaacacagaatattcttgcagaatatcttcaacaagcacttccagtcataattgaaggaactgaccagcaaagagagaagggaaagaaaagtgatttatagctcatatgctgtcttgataaaggatctaggttttatgaaatattatggaaactttaagtgctgagaattctatgcaatctaatcaaagattgtagtgctgtgagtaaaagaaaaaaatgtaacaacagagagggattggagaggagtggaagaaacagcaagtaggaatcacacagagactaacaatgataattcacaatgataattcaatttaagctggtcctctaactatcatatcccatggggatcccaggagttacctggagactcggcattattattcagagaacacttggaattaatgcctctcttattgttgaaattctccctagagttgtttgcatacaccttgatatcgatgttctaagaagctattatccctttatgtgcattagatcacagaacagctacattagagatgctcttgaattttgatttaatcaaacaggcatttttatgcttcagtcctaataatggttccagtggttcatccagtagttcctgatatttgggtaaagaggtaggcaatgtgagctgtccattgagatattttgctttgcttaattcagtgtgatgctgtgaaactcaaccaataacagtttgaaagtgtgcccatgtatccaaataccaagtagcagcaggaaaagagttctctgcagccagtaacaattagagatttattaagactctggaaaacttactggctggtcaaaaaaaccaatgataatctccacctcactcagggaatttaaggttgtttgtttgtttctttgtttgtgtgttttcccctccacagcctaaggattcagaaaggtcagaaaaacagaagtcacttctcttgatacttcttcccataaagacttacctttctgccagggaaagatatagatttgtataacttccattattgtagaaaacacaaccaagaacctgccgcaggagatatcctgaaaaccattgcaactgttccacgtggggcgaaaagacatctctagttgtgttggagccttattgatgttttgtattgctatgttctgctgtgccattcttgtatgaaaaacaggaaaaagataagttataaggcattttagcatatcagagcatggttagcacatttagcttagaggagttgctccattacaaaattacctctttgtaaatcatattattaaaaaaaacacacatctgtcttctcagggaattgccttctgaatataaatctttgagaactgatacttaaattccactgtaatttaagtttcactgtaattaaccaacattttatggcctagcccacttctgccttctaatatatagtttagtgggaaagacacaagttaaacaaacagaaaaataaatatttatttaagattctagaaaatcttttaactggacagagaacagccttgccacatgagagaatagactaagaatggcttacattaagtttactagtctggtatgttctctctgagcagatagttaagctgagtcctgaaggatgagacagtaaaaccattgggagaacaaaggaagaagactaggctgtgcagaaattgttgtggtttgaaaaagctgagtggggaacgggaagaggcccaccttgccaaaaaggtatttaaaaacaaggaagaagagggcaatgacatgcagtggtaggcaaggctttatcacgtaagactttaagaatattgtagctctagtgaaagtttgaatcagagaaatttaaatacctaaatgtcactttgaaagatcattctaactattgtttgatgaatggtggttgctatagggcaaggggcaaaatggaagttcattgggaggcttctgtagttgtttacaaagtaaacaatgatggcttagactagggtggtatccatagagagagaagtagacagattcaagatgcatttttgagggaaaactgagagttgtatgaattcagtgtgagggattcaggactatgtgacatctcatgaatgccctcctggtttctgctctgagtgtgtgggtagatggtgacattatttactgagatgacgagggcatcatctataccttgaatacattgaatgtatttcttaatttctccctcattcctccttctccctttccttaccatgtttctctaaatcctagctatcttttcagattcagcatgcttaataaacatattgagtaataattaaaataataagtttaaaatttttgagtggttctaaacactgtacatgcccaatttatttaatcctcccaataaaactctataggagaaattctctttacaaataaagaatgtggagacacagagagcatacataatatgcctaaggtcacacagctgtatagcaattgctaggaaaagcaagcatttacctttacagagttacagtcaaatgcaggtggcagacttacaaacagactgatgcaatgctttggcaaagctgttttaacaatggtttcagtggccttctatgtgacccatgcaggggaaactgatctggccctgggcaaatgtctgtgctgttataacaaaataccacagactgggtaatttataaagactagaaatttatttcttatagttctgaggctgggaagtccaagatcaagatgctagcaggctcagtttctgatgagggctatctctgctttcaagatggcttcttcttgctgcatctctggaggggaagaacactgtgtccccacatggtggaaggtggaagtgcccttcaaatactgtctgaagtctctttaatgggggcctcaatcccatttatgaggagaggaggcctcatgacctaatcatcttaatatgtacacattggctagtaattttcaacgtctgaattttagagaggacacagtcaaatcatagcagcagagataatgaagacaggctttctagaggggatgatacccgagctacactttgaaaagaaggtaaaaatcctggtggaattaatgggggcagggaaggctttctcaggtaaaggaacatatatgcaaaggacactatgtagtggggtaagagcagggagaaataatgagatagtattgagggacaattgatgggaaatatggctaaagagatagattacagagatgaagtctggtattcatagagatgtactttaattatttaaaatagatctcttggcactatatcgagtcgatgaattggggagggcttaagtcacaagtctagaaatacaatttgaaaacttgcatttttatttttctattggagaaaaatgatggtttgatacagagcaacggtgttagagatgaagaaaagatgaatttgaagattaaatgagacaggacatagaaagcactcagcacaaagtttggcatagattacctacataagaaatatcattgtttcagatgtctgttgctgtttaacaatccattgtaaagcttggttgcttaaaacaacaaatacttactattttcttctaattctgtgagttgagtgggctcttctgggtggttcttctagtcttcagttgcaagtaaatttgatttaattgattatgactgaggtcactcatgtagctacattcaatttcaactggactggggctggagctgcaagaatggcctttctccaaggcctcttttcagacaagctttagtcattcactggtctagcctggacaacatggcagctgggttctaagagagagacagtggaagctgctaatgctcttactgtatggtcccaaaagccctataaccattttcctttcaccttcaaattggtcaaatcagttacaaggccaacccaaatccaaggagaggggaaatagagggagacatatgcagatagagaaatggcaaaaaaaaaaaaaaaaaaaaaagttgttggtgactgtatttgtagactgcataccagttatttaaattgtctaatgccaatttaattccttaaacagcattcttcatttatatttgtattagtttctttctctagctctataagcttcctttctatctcacacagagtctttcctatcttgtactaaatctatgttttagggtttttttccccttaatgtcccggagaatacaaaacagcagttaccggaaattcaatttattttcctagctgaggtaaatatttttcaaaattatagtctttatttatcttttacattctttcttttttaaattttcttttttagttgctgaatattttcaaacatactggttatgcatatgtatgcctgtatgtggcttgtttatttttcttgactgactattgaggatgacaagtctatacagtctatccatgttttctatttgcataaaaattgtttgtctcgattctccttgagacctgggcagcttgagttctccccatttatatgggcatctttaactcttgaggattgtgtgctggaggtttctaattagcaaagtggaaaggcagctacagtcctagttgataaatactttacgtcatggtttttgtcttgtttgttttgcaaagaatgtatcagactgctgtgttcacctgaccttatttctagatacaccatgtggttctcatcactatcactctggagtttctacctatcactctggggagtctccagtcctattggaggggtatttgtctcattaattaaaaggctcctcctggtttagtcacctatattgattaaaagtcatgaaaattccactatctttctctttaatgatgccttaggtaaggatacagcttactatccaaaataggacacttttaggataaagatacattgttaataatgtataataataaataagacaaaaaatgtaactattttggaaaatgaggctatatggtcactcaagtgatgccataactggagcttttgcaaccagtgtgtctccagttgcctctctttccccgtagccagacctccatccatgtcctccagactggtggagtttaccccagtgggagcaagtttacactgatattagtagaaactgtgcttggaaaaaaatacacttaaaatagactcatgctttctcttcccacttcacacggatgctgacccacgatgaggaaagggatgcgagctggctacctatgtctcagttccctcttccttcaaaaggtgcaaatattaaatagtttgcacttcttcccctcaacatttcttgcgatattccttgaaagaaaagttagttgttagtggatattccatgtaatagtctcaaatgtcgaatctgtggtagagagcaaagcatataaaaaaattataggggattaagtgtgtgactctacagtttgaaaaaagcactgtagctagttttaacatgcagtatctctgacttccccagcgcatgtgtattgagaaccactatcctctctgatgtaacagtaaggtgtgttgtaacaagtgcctggtagctcatgctaccaggatcaagaaaaattagctctgaggaatgatttttttctacttttattttatatggtattaatcacatctaagtaaacttgctttttgtttgaagccagatgccccaacagaccaagttacacagaaaagaaatttatgcatctggtcattaatgcatatttggcccctaatagctacatgtaaaataattcacttgaaaacattactcatttttgtcaaagggctgcacaagagctttattatacatcttatttttaaactgacttctactataaatgaagttttactacttcctgatcatcttcttctgacaacttgctattcagtttttttggcaaaataaaataacaataaaacgtgattaatttattgatgaatggatggagaaatagatgagtggatagacatatgattaaaacaagaacagtaaagctttagtggtagaatctagatggtggataaatggggggccatggtagatttctttcaacttttctgaattttgaaaatttacataataaaatgttggaaaatgattacttattattttctattaaaaatcacggagtaggccgggtgcggtggctcatgcctgtaatcccagcactttgggaggccaagatgggcagatcaccaggtcaggagatcgagaccatcctggctaacacagtgaaaccacgtctctactaaaaatacaaaaaaaaaattagccgggcatggtggcgggcgcctgtagtcccagctactcgggaggctgaggcaggagaatggcgtgaacccgggaggcggagcttgcggtgagccgagttggcgccgctgcactccagcctgggtgacagagcgagactccgtctcaaaaaaaaaaaaaaaaaaaattaaaaaaaatcatggagtaaagggaagttttgtagtgctgtcctctctctaactgaacaagagccactaaaagcagttagaacacaagttccaagcaaaacaaaacaaaacaaaaaaacacagcagtggctctgaagctctccctcctgtcagagatcgtgcagtccagatggattcatgggaactgagaactgactcctgccgtcttgattctcttggagaatatagattccctctcccccaacaacaagtgtcgtgatcctgaaagacgtatctaagaattctttacatcgagttgtaaaacctcaggtcatttaagtgactcagtaggggagaaaaaacataaggcaaacagaaaaagagggtaagtttagggaggaattatgcagcagagttattttctatgttctgtaagtagatctttaaggggaggagtgttctctgaggtgaaggggtgtcaaggagtgtcagattgaagcagagagccctaactgaaaggcttttagctgagtttccctgaggcaggtcctcaggtgtccaacattcctgagcagccactgtgcatgtttcatcatacatatcccaccgtgctttctcttcatcccgatactcttctgcacaaaatagccaccctaactttaaaaatcaataatacttttggaccagttgaaaaaataagagaaattaaaagaataaaagcaaaattaagggatattaatataaagcagatggacatcatatatcacagaaataatacccaaagagacacaggaatattttataaaatacttcttcatatccgcagagttctggttaacatgttttatcaaaaacaagcgatcgaagaatagatacaagggttcaaataaaaagtaatggcataacataaaagcgttagagttaagccccgttaaaaataacaaaaggagaataagatggactaaaattaaagactaaggagatgaatttgagaaaatcttaacaatattaaaaaaaaaaaacccagcaggggcaaatcattctagattagatgacagctattatagacagtcaaaagatatccagtgtattaataatttatgttgctcagaacaagtggaagagaaaaaattatatttaagatagaatgagaaaacatgagttgagaaacatgatcctaatttgtaagaaaaaaaagtgtgtgccagaaaaaattgatgaaaattttcaatagcaaggcattataatattgaagttactgaactgcaaggataaagaaaaaaatatcacatttctatgtaagcagaaaaagtaaattaaatgtgatgcttgatgtattatagtatctgatgccagaagatagttggctattgtctacaaagttaaaaggaagaaaattataacagaataagataatactcctcctttttcttttgaatagaaagtcaaataacaaattatctcacatatgcaagaactgagggacgagagtagacttgccccatttttggtgtgaagggcaggtggacacaaggctgtgaagttcagccaaccaagagatctggactcttgaaaatgaagggataaagaaggtaaagaaacagtgtcactcaatacatatatttaaatttagaaagcagataaaacaacaatggggattatagttataaatagaatacaaacattttaaaccttgacaatacaaaataatcatataactatcaaaattaagtgattgagatggcatacaaagtgtaagtgtcccaatttttgtatcccatactgtaggaataaagaaaatttttgttttgttttgtttttgtttttgtgtttgtttttgagacagagtctcactctgtcgcccaggctggaatgcagtggtgtgatctcggctcactgcaacctctgcctcctggttcaaacgattctcctgcctcagcctctcgagtagttgtgactacaggcatgcgccaccaagcctggctcatttttgtatttttaatagagacgggatttcaccatgctggccaagctggtctcgaactcctggcctcaagtgatctgcctgcctcggcctcccaaagtgctgggattacaggccgaagaaacattttctactgttggcatacatagttttatgtatatacttatttattttttatttcaacttgtattttagattcaggggtacatgtataggtctgttacatgggcatattctgtgatgctgaggtttggggtacaatgaatcccatcactcaaatagtgaacatagtacccaatctgtagtttttcaactcttgcttctctccctccatcccccagtaggagtcccccgtggctgttgttcctatctttatgtccatgtgtacccaatgtttagctcccacttgtaagtgagaacatgcagtatttggttttctgtgttaatttgcttagggtaatggcctccagctgcatccatgttgctacaaaggaatgattttgatatttttttatggttgggcagtgaaatacatagtttgcccatattgactccaacttttaaaatgctttaaaaatcttcttttttaaaaaatttaaagaaatattttagaaaataaaatttttgtgctatggaaatgttatgtaaaatctttcaatttaacttttttatcacttgaattcaagtttaatcttctctcctgtgaataagcctactgctgtatgaaatgctgtttaccaaaggatgacaatgattatttctgaatttgggggaattgcaatgttttttattttacttttctgtattgattttttaagtctatatcactttttcaagaaatatactctttttaatgtaatcgtttccatctggtgttaacaaaggcaaagaatgactttgaggataattctttaatctttccatatccacaggcagctcatttgagcacgagtagttagttgctttgactggatagtgatctctgttagccatgaaggtggtaaagtcactggaatcatcgattccatttagattccagtagcttagacaaaaagcgaccagtttactaaaaaccttagaaaacaccttagaaaacacctggaaatgccacacttaactgccgttgctgagattattagagttttgctgctgttgttgtgggtatactttaagggtaactaaatttccagagccataagtatatgaagccttgtccttcgtaatagtggaactgaagttcttaagaggggctcaggaggctgactcattgtttcctcttaggaagtattggtatttaacatgtgatttaaaatatctataaattgagttatgacatgagttttcacatgatgaccttctcaccaatgtatttgtgtaattttgatgttagtggagttagtttatgtagtgaaggtggaaaaatgtgttactaagaggtaattactgtaaagctatttaattattgatttccccaacatagcaggattgacattttgcagatatagtgaaggaaaagatatgcattaacagaatgagaacagaataaatgtacgttttaaaaagaaacacaattcattttaataggtatgcagtcattattcaggaaatgtgactgcttctccataaatgacattagctgtttaagttaaaatgacagacctataataagtaaagatattatgagggcgttttaaaccctagcattggcgtaaggttatattaaaacttcatatttaccaacattgtttttttgtagtctctgtcttcattaccctttatgaaaagcacactttattttgaagtatttatattggcttgtgcttcattcttcacttagaaaagcattttgctttgcatatttgtctaatagctataaataaatgcagctacttcttcccttgaaatgagcaactttgcattttaggctgaatgaaaaagatcagctcaggacttctacagaagttccagccttgctgaatccttgctttttcatccctggtttatctgcctttctgatttctagccacagcgaacaagcatctgactacatggtaatgagcccttaaaatgacaaaaagaagtgcttacacattcaaaggagttttagcttctaaagaatagcctttggttgaaagcatgttttgaactgtcttttggattgcgttcagagtcagtgtatgagacccacaagaaacaatgcctcatttaattacggcggcacatgattcctaacataaaatcatatgacccagctggtcaacattcatatcaggcaagctttgtttgaaataatattcagccatttttcttatatgacagcaaaaacacaaagggaaggatttgtcaccatttaaataattcaaagaatgtaacagcgattctaaaatgagttcccaaaaatgaagtttcagaaatattctgggccataaaagactattgagtatctaagaaaaagttggaaatagaaaagcttaaaaaatgaaatctgcagaatgaaaaggaggtggcaaatataaaaataatgaattgaaaagtgaaaaaatattttcaaattgattaataactttaagtactttttggaaacactacataaagaaggaagaaaacacaagtgcataaaatttaaaatggcataaaggaaatgagagttatattagaaattaaaagaataataaaatagtgcttcataaagctctacaaaaatgcatgttaacaattctcaaaatttgaggaaccaagtgttaacaaaagtgattctacagaagagatgaaactcgttgatgaataactatgaaaattatatagaaaattattaaaaaggtatagcaaaaagaaatttccagactcaaatggttttcaaagggagaattcttctgaaattttaaagaaccaatttactaattacttaagctttccaaaacagagaagtaatgcagcctccaaattttttatacaaagacaatgtaacatctaagttgaaatttgatagagatgatgaaataggacaaacttataacagtcttatgtaatataatcgtactactgttggggccaaaacattaaatgttagccaaatgaatggtggtatattgaaataattgtgtgtcattaatcaagaatatgtatttttcaaataaatattcagcatcaagttaaatgataaaaattttgaatttttacattcttattatgaataagatagtaatgcctactatccccgccattaaaattattctagaaatagcacatgtaattcaatatgagaaatgagaattaaaggtataggtattggtaaggaagagacaaaaattattgttagttctattcctaagggactttatctcaggtatccctctctgacaacataattgagaagagaaatgagcaagagtcagattatccaggaggccgtgtctagggttcttatgtgatttatgtctctgatttatgtaaatattgacaaatatagattaatctctagatggtagaaaaaccaaaggaggagcccctgctcacagagaaaataaaagatgaattcaatgtttcttagatccagcttaatctaaaccatggggcattaaatctttttagaaaaaaaattatcattagttgctgcttatgtaattgtatacctagtaaatgcagtggaatcaactgagaaatgtgcaaaataattagttaatatagaaaagtaccaggaacaaaatcattagctttgattcttcatcttttctatttggtcagtttaattatatacagaaaatagatgtcaatgtatttggatgagttttataaagtattatgttatcattaatttcattttctctatatctgttattaccctgttatgattttaactgttgtgtacatgtctttgtgttctgcctttttcatttttattatgcttcatttttcaaaaggtctaaaactcactgatcaattctactattatttttctttgttttccatctttcctgtcaccttccttttgatttccatggaagtagttagtcattcttctcaattctttatttggatgctcaatgttctctccattggcaaggccacttctggaacttgatatttggagatttctttgaagttaacattcttttctttggaatattttaaatggtcacaaatactcttctatttattttcattgggtaatacaaaaaagtagttaagtttatctaaagaaagcttagctgatatacactggttgaccaaggtaggccatgtcaatctgtataaaaaaaaccatgtgtcactatgaagtaaatgagacattgtctcttgtgggcaattttaaaaaaaaaaggatgttcaaaatatgtttttaataaagtctgattatgtttcttttcagtagctaacattcatttagatgtgtaagcatcatttggggggatgtataatttttaagaattcattacaagtatcacaaaagataaacacacataaagaattatataaaaattagtagcattgtaaacaacccaaagcagttagaaaatacaatgggagaaataatccatttataatagcaacaagaaaagtaaaatgcctggtattaaagttaaccagaaatgtgaaggacccatatgaagaaaacttgaagctctaaagataacataaaagaattcttagtaaaattagagatacaggtattctttataggaaaccacaatattatacattgacaaactgacaaatctcagtttagtaagctgcaaattcaatgtcttaacactccatccaaatttatttttgtacttgacaaaataacacaaagttcatcatgaaaaataaaagtgaaaaatgctttgaaatgtttcgaaaaggaaaatgaatgagctggaaatagtattatctatataaaaatagccaacaaggctgtactagcttaatcagcttgacactagagaaccaatagattgtgagagaatgttcccagattctccagattcagaggtaatactggcattcaaatcattgggaaaagagctttttcactaggtggtgccgggacaaggtactaactgcatgcaaaaacaaaaattggatggtagtctcatttctcttaccaaagtaaattacagaaagtaaaaattaaactatgacagtttgaggaaaaacatgagtgaatttatttaaaattttggaattagtggaaagtctttccatgaaggacacaagacacagagcacaaaagagaaaacattaacaaatctataaagttacaaccaactaaaaaaaaatctgaactaataaaaatacagtctaaacatgtgacaggtcgagactaattttcttaatttgcaaaattttatacaaattagtaaggaaaaaatacacttaacccaagggaaaatggacaagttgctgaaaaagaaatacaaatggacaataaaaacgtaagaggaccatctttgccttcctaattaaagaaaggcgaataaacaataatgagatgtcatgttttaatcaatcagattgatagcagttaaaaaaagttagataatatccagtgtcaaatgaggatccagaaaaatagccactgttaatacattgttgcttgaggtgtaaattggctcgacctctttgtcagacatttaggtcatatgcgcagaagtctggaatatacatttcttcatgactttgtgatgcctctgatgggaatttattcaatagtatattcacacatgttttctaagatgtactagcaagaatgcttactgtaaaacatacaaactgaaaatactagaaatgatcacataacggacctggctgaaccattaaggtatatggcacaactgctgaaaggctaaataatcttaaaacatgaagcgtatctcttaatcttaaaacatgaagcgtatctctaagtgcagatatgaaaacacctacaagataaatgacgtcatttaaaaattaaagtgacgatcactgtgtataatgtggttcattttgtataaaaaaagactgtgtgtgtgtgtgcatgcgcatgtgtgtgattaaaatatatctggaaagaggtgagatattgaactccgattgcctttgtgtagaatacttgttctcagatttcagtgtgcatcacaatcaccaggaaggtttgttaaaacccaggtccccaccgtagagactctgattcagtgaatctggggtgaagcctaagaatttgtatttctaacagtttcccaggtgatactgctgcctctgttccaggcaccacactatgtagaccctctatggagaggaactaggcttttcacttgatatcttcctgttcatttaatttttagaaatagtatatgtatttcttttgtttttcctttaagatcaaaagcagcaatctgaattgtaagattctggggcattttaattttttctttatacttaatcacattttaaaaagccatactgttaaaaaaaattctaccaaataagatcaaatccactgctttttagttgctccttaaatattttgtttggtaattcatttccttaagaatagacttagtgaaatattaaatttttcttatatgtattcctcctaggtagatccttgtatcataatttgaactcagaagttagattggcttgtgtggtatgccaagaaataaaaatattttaagaatattggggatttacattattttatattatatataatatatatcataacatctatattatataaataaatatataattttattatattatattaagaatggggatttacattattttatataatatataatataaaaattagtggcaaatataaaagataataaaagatattttatatataatatatttaaaagaatgaaagaaccgtcaccattttctgtaaaataagaatgacaatatgcagcatgcaacagctatcatagagaaccacttaagatgacagacaacatggcaaatccttaaggaagactcctggcattgggatatgctgtcttatttgtatttctgttaatacagctttatgattgcattgcatttctgggtttgaactttgtaaagatttagagcaataacaacaacgacaacaaatggattgtccaattctatccactcctttttttcttttagcaagtcatattcctgtaatcttctcttgctattatttttcttttgttaagatttatattattttttatttattcagcgttcattatatagtctcccttaggagcactgaataacacatacaaacaaatatgaaatagctaaaaatttgaatccctgtcttgccaaccctcatatcttcagctggggcagaaaacctgagcaaacaggcattgcactagaccgtgtcggcagcaaagcaagctgtagtcaggttcccaagggaatgaattcttatgttttgttttccataccaagaccattttttctcctttcccctaaagatcaaatctggtggttcattagctattctggctgatctcagcttcctctgtgcatgctcttgtcttcccatccccacaactccaggggtttgatagaacaaggttaatactcggaatcacggtcaggagcaaattgattgcaagtggaggatgtaaagcttgtctgtcaccatctccttatggcctcaagttaagcaggcggtttgcatcaagtgaagctttaaaagtctcttttttaactgacatccgtaacagagaacgctatttctctcaaaccatatgccactaacgcctgattagctatgatcagatagaccgatagatacactattaaaaagaattgaaccccgtggctagttcctatgaatgttgaataagtaattaatgtcttcctctttcctaccccccacccaaccagtctgctgttatttaatttaacaagcatttgacggagcatatcttgtatgctaggtaggtactaagaaaagatctccttgtctgcacaattccaaaagttgccatttatatggattttaatgtgaatagtgcccccagggagttgtgcaattgcaaccttcctagccattcatgtcactaagctaggccaaaggagggggaattgttgtgacgagttataagacatcatttgtgccttgtcagagttcacataggagaacggttagtggggaaagaggtacagccacaggttactataagtcataaatcaagatacatttatgtttctatagatatctgactaaaggggtgtgggatcagcaatgagggtgtagtaaattctgcttgggatggggtgcaggaatcaagaaaggcatcaaagagaagacgacatttgatttgggcgtttgagaatgcgtcacactcagagccaaggggagtgggagggtaggccatggtgtagttggaaataacaagaatgccactgttgcccgccattgtctggagtgaatgccagccgggaatcatttaaacactttctcttgtaatttgaaggacacaaaccatggcttctctctcagtgaaagaccattattctctaaattgtttaatctgtagtcccgatttattaagatatgtgtggcttgtcttgggagtctgagtaatcactgacattgtataggggaatacatttgcatggcattataagaatgtcaagttgtctttcaaaactgagtatagataaaaggctcaccaatgcctgggccatctctgagtgccgactgtgggaacatccgttggtggcattcgttctactgtatgcacacatttcaatcagcccaaaaggcctcctgtccacagaaggctggacagtccttacctctcactcataatgccacattagcatttctattctcatgctctgtggtcataagaggctgggagatcttcggagagacatttctcaacctgtagacacaaaaggggtgctttgagctctttgaagggcagcatttcagtgggggtgcatctgttaaaagactgtgttgcaccccaacacctctggagactgaaagggaagcaatttgggatagcagaaatggacgcaggtattaatggaaggagattgtaataaggaatgtaaagaaatggaatacacatacactgccttatctgagccattttccatagtggtgttaactataagaagcccacgttaatactctgaaaatctatccccttcaatccctgcagctatacttcctgctaagacgcaaggcagatggacacattttgaggctcaggccaaaattcattgagctctctaattttaagaattttgaactttcctaccacacacacacaaattttagaagtcttttcctcttgatgtacacatttgtttcaagattgtgcctttcaaaacctttgcacgtaacaaatagttttgagtatgcaattaaataaagaagttatttaatattagctgtgattgaatgtgcaggctctaaaatcagattccctgggttgatatgcacagtatgccaactgaaacagtcacctctcttaatggaccttagtcttcccctctgagaaacagggattatggtcaaaagtataagaggtcatgtcagcagagtgccgggcatttggcaaatgctcaataatacttagaattattatctcctgaaaatttctttggtgtcagatgccatcaaatgtaacttctaaataacatgaaatgagtactggtaacagtgaattgacacgattctagccaaaagcaagcaaacttgacttttcacatagtttatagtatctcttcaaggccaagtttgctttgtgagattcactttttttgaaatgttgagaataacatatatatttgaatgcctgttatatatacgagctaggagtgtgtttgactgcaattaatagtgttctaaataattagcagtatattttcttacgtatcaaggtaggagtttgttgtccttgatttaggtgctcaaaaatgtccttgaggaaccagctgtttctgtcattttcttctagcaacctgaccttttagggttctttttttgtttgtttgtttgtttgttttgtttttgagatggagtctcgctctgttgcccaggctggagtgcagtggcgtgatctcggctcactgcaagctccgcctcccaggttcacgccattctcctgcctcagcctccctagtagctgggactacaggcctccgctaccacgcccggctaatttttttgtattttttagtagagacggggtttcaccgagttagccaggatggtctccatctcctgacctcgtgatccgcccgccccagcctcccaaagtgctgggattacaggcgtgagccaccgcgcccagccttggggttctatctttatgctagtgaccccatggttacaaagtagctgtgatatccaggcctcctaccagcatcacaagccaaaaagagctcaaggctcatcatcggatggtcattttttatcagcaaagtaaaagcttcttagatatatccccagcagagtcttccttatatctcatgggctaaaactgtcatgtagccacgcatagctacaagggaagctggaaaagcaagtaaagaattatcctgagtagactaatcataatctaccaactaagggttgggatgttgcagccttaaaaataatcagggttctattagcatagagcaatggttctcaaacttcagtgagcatcaaaatcacctgaagggcttactaaagcaaaattttgagtcccactgccagaatttctaattcagtaggtctggactagggctcaacaatgtgcatttctaacaagttcccaagtgatagtgatgctgttatctgggatcacactttgagatcttctgtataaagtcacagactttttctgtaaagagtcatatagtaaatatcttatttttggaagttatacattctgcaccagaaatttcagtgcaaaagctgccatagacatttcatgaatgaatgagcatagctgtgttttgctaaaactttatttacaaaaacagatgtgcactggctttggaatagaggatgatagaaattaatactgcatattgtttcagttattgtggtagtatagcaaattattccactttatgttcatgaattcagtgaattatgaaagagcacagtggggatgactcttccctgtcccacaatgtctggggctttaggtgggaagatccaaatgcctgtgattgggtgcttggggactggaatcagctggaagctccttcattcacatgtctggcacctcagctaggatggctaggatacccgctctgccctgactctggatcagaacacctacctgttgcctctctttgggactgagattctcacagcatggtgtctgagttctaagagggaaactgccaagaaaaccagggagaggtttatggtcttcatggacctgccctggaaagtcacgagcatcacttgcatctcattctattggtaaaaagtaagtcacaagcctgctcaaattcaaagggagaattaaacttcaccttgacaaggaaatgacatggtcacattatagaagggtatgtatgatgggagatattttttgtagctacctttggaaaatacattttgccataagcagacacataccaatgtctgttgcctccctcagacagattactgaggctctagatacctcattagaagcctgtgtcccagcatcagagcacagaatgtaggtctatcagagcatgatatgggaggatttctgggtatgaccactaagttttacctggccaatacaactgcttttctatggccccattgcctgtctagtcagccagacagtattgattttttatttcagcaggaccttggctaggttttcggggatagaatgaaaacaaatgaacaaagaaagaaacccggggtatgtatcatccatcatccaacatcattatttagcaaagacctttaatttcttttgtgtgtaagagtaatgccaagaactgccaagttcaaggcaccaactcttctcttcaaagagcttatgatcttttgggaaattgggcctatagttttaaaaaagataaatatcaatgaagaggcatctggtatgtcaaaagaaacactttatattgatatataataattgtacatatttatagggtacctgtgatattgggatacctgcacacaatgtgtaatatccctcacctcaagcgtttatcatttatttgtgttgggaacatttcaaatcttctagctatttttaattaggtaataatttatcattaactagagttattctaatgagctatcaaatgctagaacttattctttctatctaattctctaatatgtttgtacccattaaccaacctcccttcattcctcctcccacccacactttccagcctctgggaaccatcattctatccctcctccataagattaattttttagcttccacatatgagtgaaaacacacagtatttgtctttttgtgtctgggcgatttcacttaaaataatgcctccacctctattcctgtttcttgcaaataacagaatttcattatttttatgacagaacagtattccattgtgtatataaacatattttatttatccattcattcgttaatggacagtaaggttgattccccaccttgactatgttaacagtgcagcaataaacaggtgagtgcaggcatccctttaaaatatttgatttcctttccttttgataagtaatcagtagtgggactgctatatcatatggtagttctgcctctatattgttttgcataatggctatactaatttatatttccaccaatagtttataagagttcccttttctctgcatccttgtcaacacttttttttctttttctttttttcgtctgttcatttgataatagctacgctgattggagtgtagtggtatattattgtggttttgatttgtattgccttgatgactcatgatgttgagcaattttcatatgcctgttggccatttgtatgtcttcttttgagaaatgtccattcagattttggcctgctttttaatggaattctttgtttctttttgctgttgagttgttttgagttctttgtatattctgggtattagcagcttgttgatagtttgcagatattttcttccattctgtaagttatctcttcactttgttgatagtttcctttgctgtgcagaagctttttaatttaatatggtcccatttgcctatttttttgttttttgcctgtgcctatgaagtctgagccacaaagtctttgcctagaccaatgtcctgaagcatttcccctatgttttcttctagtagtttttatagtttcaggttttatatctatatctttaattcattttgagttaatttttgtataagagataaaggtctagttttattcctctgcatagggatattcagttttcccaacaccatatattaaagaggatgtcctttccccaatgtatgttcttaatgcctttgttgaaaatcagttggctgagccaccccgtccgggaggtgaggggcgcctctgcccggccgcccctactgggaagcgaggagcccctctgcccggccaccaccccgtctgggaggtgtactcaacagctcattgagaacaggccatgatgacaatggcggttttgtggaatagaaaggggggaaaggaggggaaaagattgagaaatcggatggttgctgtgtctgtgtagaaagaggtagacatgggagacttttcattttgttctgtactaagaaaaattcttctgccttgggaacctgttgatctgtgaccttacccccaaccctgtgctctctgaaacatgtgctgtgtccactcagggttgaatggattaagggtggtgcaagatgtgctttgttaaacagatgcttgaaggcagcatgctccttaagagtcatcgccactccctaatctcaagtacccagggacacaaacactgcggaagtccgcagggtcctctgcctaggaaaaccagagacctttgttcacttgtttatctgctgaccttccctccactattgtcctgtgaccctgccaaatccccctctgcgagaaacacccaagaatgatcaattaaaaaaaaaaaaaaaaaacgaaaaacaaaacaaacaaacaaaaactggacagtggatggtatcccaggttgaagaaacagcagaaacaaagactgggagggagtaatgtacaagttgtggtctggatagttgggctggagcagaggatgctggaggaggctcagcagggcaggtatgaccgtcacagccactggctggcactagccaatgcagggttcttctgggaactctggggtcctgaaactaaggcagctgaggaacttccagaatgctttaataaattaatatcaaacatgaaaaaaaaaaaagaaaatcagttggctgaaatacatggacttacttctggagtctctattatcttccattaatctacgcatctgtttttataccagtaccatggtgtttgggttactataggtttgtagtatattttgaagtgagattgtatgatgcctccagctttgttctttttgctcagaattgctctggctattcagggtcttttgtggtcctatataaatttaaggcttttggtctatttctgtgaaaaatatcattggcattttgataagcattgcattgaatctctagatagctttgtgtagtgtggacatttttattatatcagttcttctgattcatgaacaggggatgtctttccctttgattgtgcccctttcattttctttcattagtgttttctagtttttattgcagaagtctttaacattcttggttaaatttattcctacatatttccttttattttattggctattataaattgaattgctttcttgatttctttttagctaattcattgttggtgtttagaaatgctactaatttttatattaattttgtatcctgcaactttactgaatttgattgtcggatctcagagtttttcagtgaaatttttaggttagtctgtatataagatcatatcatctgtgggaagggacaaattgacttcctctgttttcaatttggatgacttccatttatttcccttgactgattgctctggctagaaattccaatactatgttgaatcagagtggtgaaagtcatcttcctattgttctagttatttcagctttcagcttttcccccttcagtatgatgccagctgtgggtttgtcatatatagcttttattatgttgagctaccttgctactatgtataacttgttaagagtttttataatgaagggatgttggattttattgaatgctttttctgcatctattgagatgatcatatggtttctgtccttcattctgttgatgtgctgtatcacatttatttgtgtatgttgaactgtccttgcatccctgggataaatatcacttgatcattgtatataaagttttcaaataaacaccctaatgatgtaccttatgtttaatcccttaagatattaaaaaagcaagaacaaaccgaatccaaaattaacagaaaaagaaatagtaaaggtccgagcacaactaactgaaatcatgactgaaaagcaatacattggatcaatgaagtgaaaagtcgtttttttgaaaagataaacaaaataaataaactgctagcaagactaatcaagaaaaaagataatatatccaaataaatcacataagaaatgaaaaatgagacgttacaactgatacaacaaaaatacaaagaatcattagaaattattatgaacaactatacgctaacaaactggaaaacccagaggaaatggatactttcctgaacacctacagtctaccaagattaaagcaggaagaaatagaaaacctgaacaataatgagtaatgagattaaattggtaataaaaggtttcccaataaagaaaagcccaggaccagatggcttattgctgaattctaccaaagttataaagaaaactagcaccaatttttctcaaactattccaaagacttaaagaggagggaattcttcctaactcaccctatgaggctagcatcactctgataccaaaaccaggcaaggacacaataaacaaagaaaaatacaggccaatatccctgacgaaagatgcaaaactccttaataaaacatcagcagagtgaatccaacacatcaaaaagagatacttttgatggctttaaaatgaagctgagattcttctcagctggacagtggaaaaagctaccctagtgtaggattttattaatttgaaccttgaaaggtaaaaagggatggatgaaaagaaagagaaaatatatttcaaataaaaagtgcctgatgatgaaagggtgggacactattggtctcattggagttgaggaggagatcattatgtcagaagaaaaaatgtgtattgagaatgggaaataacattaaaaataatggtggtcactctgttgaaggggctcctacataacatttaataatttagtgatttcccacagtgcaaggcctgggatgctattgtctctactgttctatcttccttctccactagctatttcttacagggacattctgtcatggtgagctcagggcctgcttgtccttctgattacaccagtcataacaaagagtagaccaggcttttccatccaacacactcatcaaagtccattacactgaactttgacatagcaatgcaaatagagacgaaaaacaacaataaaaacaataaaattctagtaaaaagccaaagataaattgctcttaagcacctactctggttattctaaaatgcttcccaatgtttctttaaactataagttcttagaattagggaaaaagcagtttttggtttaaaagattttagactcccaaagaaatgtgtaagcctcattttagaagtttcgagtagatgtttgcacctaatttaatgtgctaacccagtctaatgaattgagtatttccccaactcagtgcttggcttttggatgatgaagtggcttaaaatcatgaccttgagaagttctattccatcagatcaggccctacttataaacttcttaaagttggcatttgatacatggagctattgtgagctgtgctgtgacaacatctttggatggttttttaaattgtagagtcctaaaaactggcttggtcaccaaagcaatacaaatgctgtccttatgtgtatacgaaatccttatgcttgcctcactttgttttaaaggcacctaatagtattctgcttaatacttaacagtttgacagaaaagttcatttcaatcctataaatcaatgacctttctaattacaaatattcactgattctgtaaacaatgacaaactttcatttgaataacattttatagtacatttttctatgaaatgtgaagtgctttcaaaaggttgccttatgccatggtaataaaaacgttttagagcatgtgcgttgtcaaaagtcactaaggtatgttctttgtagaaaagcacacagctgagagtttacagtggataggactctgccctatcccacccacacatctaggtttcaggctgtgtctgtctggagaaatgtgtcagtgcttacctatatctctttggcactccaatctcatggaagccagtctgctggcttccaactgcaaatacctgtgactctttgcccaagggtcatctttccctgttacagcccatttagcccaggcaagaaaagccaggaatttaatatctcccaccttcccatgagtggctttcaacccatgatcaatagggatgattcctgcatgcctcagctcccctgaccagcagtgagataacgccaagatattttctacactgtctcccagagcttcccagtaagattgcactcgcgttgcccacagtggttacgtgctgaacaatgcatccttattgactcccttctctatctcacttttcaatgtccctactggtaattcccaggatcacttcccaaataaaccatttatacttaaatctgtgtctttggggtctgtctctggggaaatccaactcaggacatactgagactgattcccacaaaggcacagtgtgggttagctgcagatgttgggatctgagaagctgaagaactggatagaatgggcaatgatgtagaaccactgtaggcttctgaacaagagaagggcgtgttgttaaaggaaaatgatcctcgcttttgtctacagttcactttgcatcaaggggaggggtgtggctgggaagagcctggagcctagggaatcgagttttatcactattgttatggttatctaggggcaggtaaagagaggttggattagtggagaggaggttaaaatgaaaataaggaatatttcttttttttttttttgagatggagtttcactctttttgcccaggctggagtgcaatggcacgatctcggctcaccacaacctccgcctcctgggttcaagtgattctcctgcctcagcctcctgagtagctgggattacaggcatgtgccaccacgcccagctaattttgtatatttagtagagacggggtttctccatgttggtaaggctggtctcaaactcctgacctcaggtgatctgcccacctcggcctcccagagtgctgggattacaggtgtgagccaccgcatctggccaaaaatacggaatgtttctaaggtacatgatggagaatcagtgaggattgatgttgactgagttggtaatggaggagcaaagaggagggaggaagcaaaaataacagtcttggagaactgggagtatggcagtgcccttagcggttttgatctatgtctaatttgtagcctctgcttacagggtaatatttattggtcttgagaatttcctgaagcaaccttacagttcatcagaatagggctcatttctccaaaagaacagaccctgtgaaacctctggagatatagtcagtatttcatatgagtttatggatttttcttcagccttccaatacatataaaattacttatctctcttttctctgcactgaaatcctccaacatgccttttccctgagtgaataaaaaacacgagcttttcttaacaatagaccttctaatgagtgagcagagccacatttttagtatgtccaagtcagaatctgtttaacaattggtggccgtctctcaacattgcagctagtgacagcctcatttacactggttcaatgaagatactgaaatgttctcggccagacagtggaagtgaacttacactttcaccagtcctcacttagcacagattttcaagccacttaacacctttcaagtgtctgaaagctaatagaatgctcaacacaaggctcccctgacttttacagctgcccagaatttttatttattatatgtctgtgattatttatttatttttgctaagaagaaaacagagtgatcttacacactgataactgaggaagcatttcacagctggaccttatgtttttttttcaaagaacagagttctctgagctctaaacaaaacttcttatcagacaattaccaatatattttactattttaattttgcttttcagcttattgattaaatattcagtgtggaggaatgggcattcagccttaaaatgatgtaattttgttacatatgaaaacagcaaaggacaatatgtcactatttgaatgagccaggtgaaaagaaactctatgaccttaattcggccatgtggataaggggttctaaaaaattgaaaggagacgtttaggaaaatttgctgaaagaccaaaagaacaataatttcctagggtgataggtttgagctattttctctccaccctagaaatgagccaaagatgtatttacccactgaccccaagaaaatggctgatctccagttggaggagacgaggatctttgcttggccttgttttatggatggaatttttaatattccgtccatacaaacctatgcatgtatttccagaacatttgtgatgaaaaggaaaaattatgttcaccttgataaggtttcttaatattatctcttccactggagaatccagctgattacactgacttccaccaataaccaagctccaactacgacataggtcccaggagtcttaggtagagcaggcaggtggatgaagttggcttgagaattttagtgaccaaaacatggccttcgttaggctatgattttggtgactgaaaaaataataaggctgtggatcattatgtgggccatcagggaagtttcaaagaaagaaccatcttctgaattcattgtgggtcgtattttgtcaccttcttcctactttagtacatacacacacacttctccaagttagaagattcgagttgaagatataagcctgcactatctaattcagttcccacaagccacgtttgtccattgagcaatgggaatgtggtgagtgcagactgaggggtgttgtaaaagacactgtgaatttcaaaaacgtaatggcaagaaaagaaggtaaattagctcattaataattttttatattgattgtaagttgaaatgataatgtttggatatattgagttaaataaatataaaattaatttcaaatttctttttatttcttaatgtggctatcagaagattttaattacatatgttgccaacataatatttctatcagaaagttctggaaataagggacctaagtgcatgtaagggaggagaccaccccttatattgtcttatgcccaatttctgcctccaaagaaagaagaagtaaaaactaaaaggcagaagtgaaatccacaagcagacagcctggcgccacaccctgggccttgtagttaaagatcgacccctgacctaatcagttatttgcataaaaaagcactgtgaggatccctgtcctgttctgttctgttctaattaccggtgtgtgcatcccccagtcacgtaccccctccttgctcaattgatcacaaccctgtcacgcggacccccttagagttgtgagcccttaaaagggacaggaattgcttactcggggagctcggctcttgagacaggagtcttgccgatgctcccggccgaataaaccccttccttctttaactcggtgtctgaggggttttggctgtggctcttcctgctacacatggactgattttcctcttcttcattactttggaaaataaagaaactgaacttcttacttgtaattcatctgttcacccctttaattcacctaacaacattgtacctatgaatctgatataaaatgatgcccataaacccatataattaataaggccagctacttagaaatgttagttcataaattaaatagctttacatatgtttttgaattctacatgcatacacaaaatgattaagaaggtatttattttcttataaattatgaaaattcatatatttcaacttactattttacttataaaagtatgttctattattttattatttgtgtctgttttttccactaaatttgtttcattaataagctaggtttttaaaaacacaattatcatttgacagatgctaaatatctgatttaaatgatacataataagaaataaaggatctagtctcaaagtaaataatactaatttgtaaaagcatctttgtgacatttcagtaatatataataaaactgtattttttaatcaattaggaggctcatattccaatatccctaccctaacacattggcttgggtagaagaattagttggtgagaacagagtcgttgaacaaacagtgactagccatttcccatttaagttgggaactcttaaaatatataaaccattatcctaactatggaaatataaggacatatgcacaaagcatatgtcctctacttccaagaaagcataatatagtagagtggagaaacagagatcactaagccgacaagaactatcactcttatccagatcaatgtactctttttctacatagcagccattttctatgtagcagtcatcatgattttgttaaaataatcatattttatccctcccacttctaccttttaaaatcccaaagtagattttcagtgcacttataataaaatcttaccataacctgcaagacactgcatgatgtgacctctgttgccttttccatttcactccctgtcccctctacccttcacactcaactctccagctgactgatgcctccaggtctttgcctctggtatccctcatcttagtctatttgtgttgctataaagtaatacctgagtgtgagtaatttacaaagaaaagaaatttattagctcacggttctgcaggctgtacaagaagcacggcttcagcatctgcttctaggaggacctcaggctgcttctactcactgcagaaggcaaaagagagccaatgtgtgcaaagattacatgacaaaaggagaagctagagctagtatgtggggaggtgccaggctcttttaaaacaaccaactctcacaggaactaatggagtgagaacccagttgttacaatgagaatgacaccaagccatccatgaagggtctgcccctctgacccaaacacctcccgttaggccccacctctaacattggagaccaaatttcaacatgaaatttggaaaggtcaagcatcaacctattgcatcccctttgcctggaactctctcttaaagcttaagaataatggaaaatacagggagagtcagtcttgtgggcacatctgagttgccttctctggccaccctatctttttttttttttttattatactttaagttttagggtacatgtgcacaacgtgcaggtttgttacatatgtatacatgtgccatgttggtgtactgcacccattaactcgtcatttagcattaggtatatctcctaatgctgtccctcccccctccccccaccccacaacagtgccgggagtgtgatgttccccttcctgtgtccatgtgttctcattgttcaattcccacctatgagtgagaacatgtggtgtttggttttttgtccttgcgatagtttgctgagaatgatggtttccagtttcatccatgtccctacaaaggatatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcaaggtaatttatagattcaatgccatccccatcaagctaccaatgactgtcttcacagaattggaaaaaactactttaaagttcatatggcaccaaaaaagagcccgcattgccaagtcaatcctaagccaaaagaacgaagctggaggcatcacgctacctgacttcaaactgtactacaaggctacagtaaccaaaacagcatggtactggtaccaaaacagtgatatagaccaatggaacagaacagtgccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctacacagcaaaagaaactgccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggccaccctatcttaagtagctcccctgtattcctgacagtgaccttgtatctcactttcctatttaattttctttatattgctaacaactaccccaaattatcttttactttaaatttacctagttatttgttgtctatcccttttcatagaattaagaacacaagcctgatctcttttatttgatcttttttttttccccagacatatcaaaggccctcaataattaaatgctggctgactggatgggtgaatggataagatagtttcataagtgtaaaggcagagagaattcagagtaggggaggaaatagagatggtatctaatccagattagaagttttctgaaggatatagtacgtcagctggtacatatgaataagcgggaagtggccaggcaatcagcaaagggtttaaacttctgggcaaaagagcaagagtctggtggctaaaaagaggctgtcatgctcagagaactactaaaagttgagtcaagctgcagtaagaagtgggagtaatgctgagacctgaggacaggtagccaggaaggagcccaccagttcataagaggcaactgcatgagaagcctgatttggatggtattgtaaccccaaatgtctgaacgttctgcaatatgaagcatgctttgcatgtcagcttgcttactccagctcagtgtttaagctgcttatgagattgtaaactgaacaaaatcagggccgtcccccaccccttggattcttctttacttataacacaatgccttatacaaggtgggcttccagcaaatgcctattgagttgaattgagtcctttctcttattatttttcacactgttatctgaactgatatttggggctgtctagactattctgagatatcacacaaagtgcaagaataactcatgctccattgatcctccataatagttactttgaataaatatggaggacggacatgcacaataaactgacatgctccacagcttttgactatggaagaataccatactgacaataaagaaggcccggaagggagctttcagagatgtggataagatatttctcccccttgagttgaaacaggaaaagggaatccagttcttggtatattggatttaaaaaaaaaaaaaatacactcgtctcaaaagtctgcatccttgcaagaattatcaattctgaaatgcctgttcattttccacagattagtcttcattagacacaattttagctaggtattcaattgcatttgtttgagtaggtaagtagaaaccaagtctcagtgatcagaattttagtacagagctaacttaagttgtttgcttttgtctcttcaacgttagaaggacaaatggtgccttgattttacaccacttcataaataattttctagagccacattttttacaacagactgaaacaaacaggcctagatctggttctgattattatgacagagaaatgtgaatacaatagagaaatgacatattaatcatagtgatgtttgatatgctcacttggaatgtgaactaacaggttcaggtaccccagaaatatctcaaagacttcttttatagggctgattccccccttattatggaaagctatatttttcctatatattttattaattccctatgtctttatttcagtgtagaacatattcctttaatcattagcatgcaccaacccctccccaaaaaaagcacaagctaaagcaaatttatagaaacccaacttgaattctaactcagcaactcaaaaccattggacatttctaaattttttatgtaaccatgacttcatctgaaattctgttgcttacacgtcttgctacttcttaagctcacttttctaaaatgatgaatgctcatataaaaggcaaaacaaggcagccctgtagagacatgttaagtctacaagtcaattgatttcctatgagaaacttttgagctagggaagcagggactcaggaaagttttgtttcttgttagatgccagctgaatagaattaaatatattgtcacaccttgaatattaaaatatcctggctggatgcagtggctcacacttataatcatagcattttgggagcctgaggcaagaggatcacttgagctcatgagttcaagaccagcatgggaaacatagtgagatcttgtctctataaaaaatattaaaaattagccaggcatggtggcacatgcttgtgatcccagctacccaggaggctgaggtaggaggatcacttgagcccaggagttcaaggcttcagtgagcagtgactgggccactgcacttcagcctgggagacagagggagagatccccgtctcaaaacaacaacaacacaatatcttgaacttcagatgttttaatagagacagtgtgatacatgtgtacatagggaagaaactagcccacggagttcactattacataaaacagcatggtttacctaccattgcttttattaaaagtttttgtttttccatgttcatgttgtttttggaaatatattgtaaagtaatattgtcaagtaaataattttctcaagggaaaaataacaattagaaaagaggtaagacccctttgctctgatacccttaaccaagttaattgaggagagaagtagaaataggaagagaagaagagaggaaggacagaaaaaaagaaaatatatgagggtaaaataacatcactgcaggagatgttgcccgtgccctgttcacattggaccttaacactttactatgctccacacaatttttagcttccagtatctgcaactctgttgcaggggttcttttccattatagtggaaaccttcctggtcagcagaagactactctgcacatggcaggctgccagtgacaagaaattaacatcccttaaaacctttccctcaatcagtgattctctagtgtatcaataccccagctcccctcctcttggctgccataattctaagctttctcttatacaccacatctcagagcttctctgtagcagtaagctccagtgacccattgtagtagctggcttaataattcacccattattgattgctttgcctctctgtgttacttcaccactctttccatgctccctgggatcacctcctaaataaaccatttgaacttatatcctagtcttaacactatgcccctggtggaacacaaataagataactactatttctgttcataacagtttgtccttggactccattcattagaattgtaatggcttctattattaagacctgtacaaactttttcatgatactgcacttacctgggttatgcattctccctgctttcttcaatatccatcacaggtgtttcataaatattttctgagtgtagactaattccaccagtgcaaagcttttgctacagcacagttctggcacacagtctgtgcttactaaatgttttatcagatgaagtgtgatgattatgcctttggcagtggaaaggtctttattcaacttttaattatgtccagaagaatggcagaatatgtagtgtttgcaaccatctggttgaaatccacctgcttacacaggtatttcagggcagagggggtactttatccatcttagcatctgggaataatttatcatagaggccaacttgcaaaatcagtcactctggatgcctcatccctttcaaatgaaaaggatttggcttcaagtgctggacatggaaactgagaatgcagtgactcatttctttaaaaatgtgaatatgagagaggaagatttttatcactcaaagtgcagcacggtgagagctcgcctgagttaggtaaaatgcacataacttattttatggacacctctctaaagtgccttaaagcttaaaggataaagaacccagtgggttttcgttttgttatatgccccaaggctgaaactctgtggcatattttaacagagtttttaaatggcaaaacaatagttctttttttttttaatgtagtctaaaataaaatggaactccagacctgtgtgcgacagctggtgttcatatgacactgttagatgcctccttttatcccaatctcagtctcccttgggtagacaagaaatgggagagaatagtcaaaagtaagaaacacttctacttgagtgacatcttcctgatcgtagcagaatgaaatattatgacagttgtccaggtagttctaagttttgaaattttttactaaaatattcagatataatggaagcaaggacttcctggaaaaattatctcctcaattatcttttttaagttgaagttatatgagtctgacttttagacttctagtcaaattatgcaacttttcttcttctgccagtcagcttgttgccactgataagtaaaatgggattctagaagttaacagggtttgagtttttttccatgatgttgattattagatttcaaaacttttaaatcttaagtttatttacataattagtcaattgtaacctgaatatctgaggagttattaatgtgtcaagctgacattatttaatcatcagaaaagctatctttccttccccagtccatctctccgtctccctctgcgtgtgtgtgtttgtgtgtgtgtatctctttctgtctctgtctctctctacatatattcattatatgtatataatacatatacatcacatatatgatcctatttggcctgacatactatacccataggactaacttaagtaatatgagaagagtgagaagagttcatggtaggaaggtcaatgaattgatatattgcaaattatctggtagataatgcagctgcttcttccacttagcaaataatgttttctgtaagtgttctgtgatcaagacatagcctgcaatgacttttgtatgctaggtcaactccatcgaacccccaaattgtactggaatcagactttttcattaattcatgcaaaccagcctgaattctactggcaaccatgaaacacttacctatccatacatggcatagtcttcgaattctcatttgtttctgattttaaccaaaaaaaaaatagattttcatcatttacaagccatagcaatacacgttgcagtcactaagctaaactcattacatgcaagtagattaatcattcatagaccttatagcttatcaaaagaccttgataactcccacggcttcttccttctgctccttcgatatttgacaagcaaacttatatctgatactgatagatgatcaaccctcttgttagtttgaccccaggcagcaggacttcattagctccagtctgtactaggcattacgatggtaagtccagatgcaaagaaaggatatagcaggatccctgtctcccatgtacttatggccttgctggagaaagaggactttaacctgtaaaagaccaagacaattttgtgaaaacagatagaaactctggtagtgataaattgataaaccctgatggtagagactttgtctaatggcttaaatgaggtgccatgttcgtgccagcgagaattcaatacctacttgtccacgcacaaaaaaaaacgatgctcgttacctgatctcatggagttcaatgagagcggaggctaagcctttgtaagttctcaagattcttctcacaagttgtgggctcaattaacatgtcttgttatagaacttttattggttggtgtttgatctggttatccatactgtacacaaaagtcgctgtcagctgaagagggaatgcttcaagtactcagttttctcttaaatcaaagcaaagataaacttcttataattatttttctgcaaaccaatttataaagcgcactcatcccaataataagtgacaagaaagaaagagataggctgtgtttatttgaaatatcctactattcctctgatacagcactgttgttagattcctttaggaaatattagaatctttctcacaattgatcagcctccctgaatgtgcccaccaaaaaattagttcttcagagcagattttgtattggcagtttgctaaacacgatactttcttctgaaactcacttatgcaagcttgaatggtatctaatgagttcataccaaactatgcccaaaatgaaatccaagcctcatttctgacataccattgttcaccatgcccgatatcttactaagttctgttaatttttctttcctaatgcctctcacaactgtttcttctcttaatccctggtgccagtatcttaggttagaccaccaccatatctctcctggatcaccaccacacccttctaatctctctgtctatatttttgccaccatcctcctctccatctcaccctttaaagtccagatgaaggttttaaattgcaattttaattgggttctttcctccctaattagtttcagaataaagcgtaggtgcatcctcagtgtggcctggcctggccctgcccttccttcagccttacttcttgtcattttattatttgaatgccagttacctactggaccacttcttgttcccccaaaagctatgctttctttttcctcgaggattttcatagcagggtctcttctctgctcttccttcatgccttggggaacccttgctcattgttcaggactcagcttacatgttttgtcccaccctgtggtggcttttcctggtccctcaaggctgttgctggaaaggggtcccaacctagaccccaagagagggttcttggaccttcctcaaggaagaattcagggagagtccaaagagtaaagtgaaagccagtttattaagaaagtaaaggaataaaaaaatggctactccatcagcagagcagtggcatgggctgctcgactgagtatacttatagttcttttttgattgtatgctaaacaaattgtgaattattcgtgagtttcctgggaaaagggtgggcaattcccagaaccgagggttcctcccccttttagaccatctagggtaacttccagaagttgccatggcatttgtaaactgtcatggcactgatgaaagtgtcttttaggatgctaatgtattcgaattagtgtataatgagcaatgaggacaaccaggggtcactttcactgccaccttggttttggctggtttgggccagtttctttaccacaacctgttttatcagcaagatctttatgacccctatcttgtgctgacctcttatctcatcctgtgatttagaatgccttaacctcctggggatgcagcccagcaggtctcagcctcattttacccagtctctattcaggatgaagtcactctggttgaaactcctctgaaaagactggctttagtatcctgctgatatgctcctggagccagtgccctgtgctaatagattctatcacagcactgaccacgctctaatgatagcaattgttaacttgtttgtttctctcaccaagaagtcacgaactgtggctttttttggttatgcattccctgcagctggtactatgtgccagttcagcaaatatttgcttgacaaatgaagtcaaagccgtgaagttattacacaactagtaattggagaagcagggattcaaaagcaagctctttgataccatgtgacgcaacaatctctctgccaggtatatgcccaaagtagatgaaatcactaccttgtaaagatatctgcattttcatgttcattgcagcattatttgcaatagctgggttctgaaaacaacctgtaaattgatggatgaatgcacaaagaaaatgtggtgtaaatctgtatctatatatttatatatataaaaatatatatatttatatatacaaacatatataaatatttacatagtatagagagatatcaatatatattttatatataagtatataaatatatatacttatatataaatataaatatataagtatataattatataaatgtatataaataaataaatataaatatagataacatatataaaatatttatatatatttatataaatataaataagtatataattatataaatatatataaatatataagtatataaatatatagttatattgatatataaatatatatctatatcgatatatttatatgtcaatataggtacataaacatatatataaaatatacacacacaatggaatattatttagccttaaaatggaaggagatcctgccatttaccacaaaatagatgggcatgaaggacatttatgttaagcaaaataggccagatgcagaagataaattattgcataatctcacttatatgtgcaatctaaaaaaaagttcagatattcagagagagataataaagctatccaggggttgggaagagggggaggaaatggagagatataggtcaacagatacaaagtggcagatatatagaatgaacaactccagagactgaatatacagcatgaaggctacagctaataaaattgaattttggatttttgttaaataagtagatttttgttattctcaccccaataaaaaagaactgtgtgagatgatagatatgttaaatggcttcactgtagtacctattttactatctatatgtatcccataatatcatgttgcaaatcttaaatatacacaatagattttttttttaagcagctctttaaacctcaactataccatgctctatatcctaggagaagcgacactgtgtgctgaagcatgaatgggtacagttaaagtctttccattagccatcctccacccctctgcccgtcttttttctttttggcaggagtagggggtgggggcgaggacagggtcttgctctgttacccaggctgaagtgtagtggcacagtctcactgcagcctcaacctcccaggctcgagtggtcctcccgcctcagccccttgagtatttgggactacaggagcacaccaccacacccagctaatttttattatttttggtagagacagggtctcaccatgttgcctaggctggtctcgaactcctgggctcaagcgatccttcctccttggcctctcaaagtgctgggattacagtcatgaaccactgtgcctgggcccttctgccagtttttagtacagtagtttgaatatttttagaagatgggctgtgtgtctaactaaaacctaatcgagtgatttatgctaaaattgtacctattctcaatggcctgtcagaactgggaataagccctttaaaataaaatcagctttgatatatattttcttaaatgtgttcactgctatcttttctctgcctgagaattctgctaagaaaacctcccagcaaggatagcttgttttaagttttttatagtttctcccattgtcttttcattgtctctgtcactccttaagatgtcatctgagctttattaatatgtatttggtaatttgtattcatgctatatcaacatgagaaataaaagagtctctcagttttagacttcagagccccaagtcgcctgaatatatagccacctaaatatgttgtactcagcattgggactaagcccctgctgttcacattacacaatggagcacctttctgagaggctagcatttacctctccagacatgtgtgccatcaaatagatccacagacacagatccttggtcatactgcaaatatcttctctgtggtttgcctttttattctcttagtagtgtcttaatgaccataaattcttaattttaataaaattcagttcttctcctttatagttacttcgtgtatatatttccttaaagcattgcttgtcttcatattaagttgtacaatattttgtgtaaattattttaaaacatttcttcattttactattttatttaaaatgtagtttctaaatatccagcaattttcctcctttgttttataagtccctcactccgcaggacatattacaaattacttggttgtaatttgtatttctatttaatatttattataaattattagatattttaaaatttagttttgaagacaagaaagtatattgggtgctaataatacatttctgaccctgacatcaccatgatagctttgcattaaatacagtctgggccggatttggaaatgctaacttttagttttcttattgaaataaattgtatatacttgcatgtacagtcaaccctctgaatctgtgggctccatgtctgtagattcaactaaccttggattgaaaatgttcaaaaaatggatagtgtgtccgtattgaccatgtacacgcatctttcttgtcattattctctgaacaatacagtataacaactatttacattgtattaggtactataagtactctagggatgatttaaagtaacaggaggatgtgcatagattatatgcaaatagtatgccatttttaataagaggatggagcattgtggcttttgggatccaagggggtcttagtcttagaaccagtcccctgtggataccgagggacgactgtataccatatgaagagtgtgaaaactgcattattttataggactgcatctttcaatgtaatgtcaggacttgaactgtgcaacagttaggacactcaatctagagccctggaaagtacatgaactacattgaaattctgtcaaataattattatgcgattgctgtttcacttttagtcaagaagcattgaaaaaacaagtagcctcattaatcattgaaaacatcagaatgaactttgaggatcaggaatttagggacatgcagatctggtcaattggccattataatgatacaaattaaagcaaagtccagcagggaaaataatccagcttgaatcctgggatctattcttgtacctttgtggcgtacacttaccagacaacagatctaaaatgtggtgtgtatgttttacaatactatattaatataaactatattaatagtctctaagccaaatgatatgtgatacatcctaaacttttgtttgaatagttgaatttttctttattgttttcatggatagttaatgaaatagttatgataaaatataccatgtttgaagtcataacttaattacatttattaacaagaaatagtaatgtacaggaatgaaactgaaagttattgtgcaatttactattatcttttatggatagaactggttacaagtaacaaatgtaaatttttacatttgcatgtaagaagataagtcctaacagcattattgaatgataacattattgaaataactttaatttcactaaattgatccacatttgctatttatatagagagaagaccaactgtgatttttatatacatatttgaaattatccatcaatatcacatggaatattcaatctggccttttgcgggaggaagaaaggaagagattttagagactaggaaaggacagcaaattaggaaagaaaaccgcagatacagcagataagggaggaagaggtggattatctacctcagtgacaatttacatgctgaattatactaatttccctgtgttctgtgatgctcagtaaatgagactctgctgatgttcctataggccatgaaccagccggcacgttggtttccactacaacacctacaaataaactgctgagttaaaatctattatagcagagaatggcttatgacccacagacaatcattcctcttctaaatatattcacaaatgcctcataaatgtttgcttgggcattttatttagaagcaacatggataaatatttgaaagagtattgctaatgacaaagcaaaagtgaactataaaatagctttaacgatgactttaaaatctgcacttttcaaatcaagcactcactaaggaaagacaggaaaatataagatagcagcaggtgagctcttcgtgtgtgtgtgtgtgtgtgtgtgtgtgtgtgtgtgtgtgtgtgtgtctatagctgtctatgcgaagcaaatcatatttgcaaaataagaccaatatctgctgaatagaaaagagctgcattgaacagacatatctgccagaaaaatctggggttgtaatttaggttttatagtccaagaatgactagattgcttttaaaagcactacttcttcaatgcttttattccattctttgatcaaacatgtcagccaaggaagaaatggtcatttatttcttttgaaagcaggaaaaaaagagatttacattaaatagcggtcatcacggcgttcgtaagtttccaactatttatcaacatgcttggttcgcaactgcaattcacttaattggacttgcatcttcagtaacactgcagcttccatactggaggtggtagagttattctaagccatgggcaggctggtcaaatgtacatatggctgtgtaattgtcagaaaatgtcctcgtgtcagacggggccatggcttatagtgaaaacaatcctgttagtgcttctgcagcatatgaggagacagctccactttattagtgaaattacactggccatggatgactggctgtcttgatcatttacaggccaattgtgaagccactgatgaaatcactgggcagcccaatccaattcagtcattaagacaactggagtaaccagactgtaaaatggttggtctggttatttcttaatgatgtaattggatagaccagagggagatccaattaattgctgagcaattggtggctatggtggtctcactgataagctcagctgtcagtgatggacttgaattgactgtacagcttcctgatcaattgtacaagttactcttaccaagctgggggttggggagaattgatttaattttggtgatttcattgagcccactgataaatcacatatcttaagtgtctctctctctctctctctgtgtgcgtgtgtgtgtttgtgtatgtgaatgtgtgtgttattttctcaattgcaatatatttgtgagatatcagtgatatataatgctattttaagatatggttattttaccttgccagtgtatatttcattggaaaagtctataggctcttgtagagatctgtagggcaatttgttactttctagaataggaggggaaatgcaagcttgaatgaaaattatgtgtttagaaggcgggaaagcaaagtattttttcttcaccctttatgcccagtctgtgaagttcactgcatggttactgcagcctattcatgacatagtgatgctagatattcttctgctttgctgagtggcctgtgaaaagagcttaacaccagtgtagcctggcatgaggaagtaaatgattggtataatattttggggaacaaatatgcagccgatgagtatttcagctctcccccacccattaagagacactgtccatggaaatatcccttcaaagaaaagacttagttactcatgcaagctcttcttggccagggcctgtgtgaggacttaattcactatatccaccactcaaccatgcctggaatagacgctcattaatgtttgttgatttagtgaaggaatatgttcttaagataaatttctttctgagagttgatgccaaataagtataaaaaggtacataactgtggagtttttacttattctaagaaaataaataaatttatgagttggaagtgtgacttgttgaggtgatttaggccacctgtgatttttctaatgatggtccattgacaagtgccaatctttgacaatgttctcaccaggccaaagcacaatgagaaaaacataagaataatggttttgagagattaaaaatgtctgcaaattttttgtcatgccccccactgaaaggtggcatctctttccttttctcttaaatctgggcagcccttgtgactactgaaccaggttaagcctaaactttagggggactagaagcttctgcctcctatgttgaatgcttgctcttgagacactcccttccaggacacaggcatcatactatgaaaagctcaagccacatggcaaagccacacatagatgctctggtccaaggctgaagctgatctcccagccaatgccagctgacttacattgagacccattgagacccaagctgaactcagtccacccatccaattgtagacatgataaaatggtttttttttgttgttggtttttttttttcgagacagagcctcgctctgttgcccaggttggagtacagtggcccaatcttggctcactgcaagctccgcctcctgggttcaagccagataaaatggttttttaaagccactacatttcaggtcaagttgttcccagcaatagatagatactaatgatatgtattgaatatatactacaacaatgatgcatattctcctttgtaagaattgtcacctctgattttctgaggattagctattcagagacgctgtagttcttgctttcttggtgttggaatatcctttctttttggcatgatggctagagaagatatcagtgatgtatgtagatgtatgtttttaactggaataagaaaaagttgagattcatgaagagcagtcaatgttttcagcacccttcatttatctataaaattcaaattctctgcccaaatccaacttcacaccctctgcaggaattccccctcatccagggccatcctgaagattaccaaacttctgctcaacctattccagtggaaacaactgattcatcagaaggcagtgctgtctgcctttaaacatctgtgattataaagaaatacagtaatataaaactttgatcataaagagaagttttgcacagatatttgtaattcttaatttaaagaaatattccgatattgttaattacacacaccaacacatttgcaaggaatctctggacttcagatacctcacttcaaattgtattatttcacattattgttgttgtctctgataagggaatacgcatgggggatgggaagtggcagtgggaggtgttggggagggaaaggtgaaaaaacaccacatttactgaaaacatactatgtgctaagttctactgcatatgccagactctcaagaacttggaggttttagaagttctttaatgcagacatttccataaagatgtatgttttccctacaaatcaaacattttatgaataaacattatttaactcaaagctttttttaagcttttgaatggagaagaagtctcatctaccttgaaacattattgctatgaaattattttattccaaagtcaatggatttgttttttacaaaaagcttaagtaaaggcactcctgaacacaaattcttttatcaaactacttttgtcacaaaggtgtttagtataatgcgttataaattatatgagtgcaaaatatgaagaggaaaatgtgtctgtacaatggacattaggaaaaatataagtaacaaaataatgtgacgtgaagcttatctttgaaatgatacggcatttacttctaccatatgtgtttgctacggtccttctaaagttctcagcatttttaataacaaaaaatgtggctgacatatgaactttagctcttacagcattaacatattccagtactagtgaacagttaaaggaataataagtgaaataaggtgtgtttgtcattattagtgagaatatggagccctgaattatggtaaatagtgaactaattgccttaaaaatggtagaacttttcttttgggtagctgtttcttgaaagccattttcttccttagaaactgttttcaaaaactgccatcttcctcacagatataaccttcattccagcagtcattggtctataacaaagcttttcaaagataagaagaaaaactatggtagtacttcagtgaatgtcacttgactgcagactcatttttctaatttttcagaataaagatatccatgatttatacccaattcaagaggagactttggatcatttcaataaatattaagggagattatgtatataagatattatttagataaaaggattattaaatacctcagataccttttcctatgacacacctgttaaagaaacaaaatattctgtacaagtctactcttcataggaaataagatgaaaattgcaagaagtttcttcaaaacccacctgatgttctttgaaataagatgaaaattgcaagaagtttcttcaaaacctacctgacattctttgaaatggaagaaaaaaatgctatgtttacgtacatacctttagaagaagaataaatattattctccttgtccgttgcctttccctcttttgtttatagggatggggttgaggggggactttgggagaggtctccagaattaatgaatggaatcaatcatctagaaagttatcagcatgaactaaactcttaacagcagactgtggaggtgctgactacctttcatgctaattgactgccaaggcaccctaactagccatttgcatagggcattgtggtagatgtggctctgaaatgtgcatctccacagcaatggagcaagttcacctgcctgaagaattgacagagttgctagcccagaatgcatggcttctggagacttctcaggaatttcagctggatggtccagctcacttatcatactaataccaggttagaacagttaccttagaatctttgtacattaccagagaaaatctagaagtacaatgcttcagttagacaggaggaataagttctggaggtctattgtacagaatgatggctgtaattaataatgtgttgtgtatttggaaattgctaagagagtagattgaaatattcttatcacaaaaatgataaggatatgaggtgatgaatattagttagcttgattcaatcattccacaatgtatacatatatcaaaacatcacattgtataccataaatgtatctttctcatttatcagtttaataaaatatggataaaacttagtttggggacaagtagggtcatttcacattgccttggtttctttttggtgataagtgtttacaacatatatgaaagtagaaaaaagtttgatggccaaatttaaacttacctctcatatgttccagaaacaccactgcctcccctcaaaatgatcagattctactctacttccgttcaaaggtacaaggtaacaaatatactgacatttgctcttgaagggaagaaaatcagatttctgccaatttaaagccatgaacaaatgtcagaattaagatcagtttgttggatgagtttgtaattccacatgcaaaagctaaaatattttcacggtggattttactgtcctatgtggcaatgcacccatgagtagattgggttcactgggtacattccaaagggccatctaaaatgtgttttctggttttcgtcattacatgttaagtttttgaacactagtggtcatatattacctgtgttcagcaacacgctgcttatactgttgttgaaaaactggttaacatttagtaggcacttaaatatctattgaataaatagtggggatgcatgactgcattacatgctttaatctcaggacatcctttaagttcagaaataatcctatgagctgtgattgttcaatggtttgtaaataccataattttttagagaagattgttattttaaaatgttggtgtttcacctgcctgttatttacaaacaattcttttcaatgatgttcaataattattcaattaaaaattaccttttgccccagtcagtatttaggtggagtagattgttctggtatttatctgattattatcggaaaaaaaaaactgaagttgaactggtgtcagagtggatatatatttacaggaaaaggatattactgttcctcaaaaagcattcctagaactttgcctatgctgcttgaagctattgcttaacagtttcttcccatcttatactcagattttaccatgtcccttagctgtaaggttttctccttctctcctatcccaggaaatccattgcagcaacttatcagtagaacacatcgtattccgtgttgtctcaccagttgatggtttaattagcacctagttacaaactaagtagaatcattcatggaaaacatggatctaaaaacaaaacacaaatcattcatccaggccgtagatactataaactacgtgtaatgacaactgtgatctcctggtcccaccccttgaccagcaagctgtcctgaagatgctgtttgaagattctcaagtaggctccagttggttccttcattcaaaggcccaaattatggggagctcatctttgatcctctttaagttctacattcaataaacttattcattcattcattatttgttttactcattcaaaaagcatatgaagtgccagagacacagagaaagcattctccacagtcacactcttaagttcctttgggtgagggtggcaagcagtggacataacaggtgaatgaaaaattgcaaaacaatatgataagtgttacagctgagctatacaagggcaatgtgagcatacagaagggatttaactaactcagcctagaggagcatggttaaagcaggagttgaatctggaaggaagaaattttgaaggaaggatgaagaaaaagactttgcagactcaaggaataggatgcacacagctgcaaggcaaaatgatggcatgttccagagtctgcaggcaggtgtgtatgaacagaacggaggacgggtttgaggggatggaggaaaggtgccagacaattaaggacattgtattctcatgaaagtgcaagtggtgggcagccatatatgtgttgtgggacccattgccacagtggacaacataggtggagatcatgtcaacgctaagtgtttctgctttgtatatccatacttcaataaaacgttcccaaatcaagggtaacccagttggaaatagagcaagaagaggcatccacagcatacaaagtcacaaggtggggctgctttcataggataagtaagtgaaaaccttttaaatctctctgaatcaatacatgccagtataactccgatcttccataaagctttctaaatatctaggctggtgtcaatatctaaaattccatagccagggttttatctttgtctcaatactgttcattcatttaatatggatccctgaggagttggaatgcactaaatcccataggtcaagtcgtttggcaaagagagtaagtaagcattaaacgacacagaatgaggagcggaagtacccaaaactatgaatgaagactcccaaaggggagtatttgcacattgacctgggagaatccctcttttgtgtgtgagcttgtagaataaaagaaatcagtcactctgagaccaaaataccttgtcctgtgttgtttgttactggatatcaaattctctaaacttctgttttttcaacttaagtcatattatgaaaaggaaattaaatgtatccatcaaatgagataatatacatcaagctatttgcaaacaaaaaacaccatacaaatttaaatgactatcatttatgtgttatagatatgtaggcgtatataacacattagaagttgatgttttttcttagaatatttgcagtgtgatagtcatatagcattcttttctgttcagggaaaggcctttgttgggccatgtggtctaatcaggctgtttgactagatttaaagactcaaagtatttatattatttaggactaacacaaattcaaaatgggaattttgaaatatgaagacattggatgctactaagccagtcatgaatgcccttttaaaacataataataacaccctggatttcaatgacagtgatcctagagctcctttatgggtgatgttctctcatgtttcttaattaccacaggtcatatagaccccatttgcaaaaagagttcatgaggctgagctgtgttatgtaccttgaccaaagtaatatcaaggaaggtcagtcctgagtctattagattgttgtgatttgctcttctgccaggtgcagctaaaggcatttttcctaccttagtcagagatgtgctggcttgaagaactaactcatgaaacctgaatacctgaagagttagtgcaatgtctggagggaggagcctaatgcttgcatgtgtctccctggcttgacccatccataaaaaaagatgtatgcagaatgtctttgctgagccaagggtgacctgcaccagctcttcctccaccttcattcattttgtgcctattcctttcatggtccatcctcctgactgcttcagcccctgcccagcttggaggttctgcttgcctgttctgtctctgacagtccatgctcacaacttgagcttctcttctcccttgacattgcttgaattgtgcccaggattttgtcttcttcctcctggcctcaggaccttgtgaacacacctgactgttgtgacctagtcactcctcagactctgcctctgaactatcaggtgctggatagcaaagccagtccagtgtccctggcatttatttgggaagcaatcatgttaaagaaaaataaaatccatcttcaggtgacctattcccaactcctgatttcatgtgctgatatgtttgtgttgtttagcaaactctcacagaaaatgttatctaaatgtcacaccgctatctcaagggtttgttggacttaatatctaagccttacactgagactagagctgagaatccagattagttttacctacgtatgttctttgtcggacctgcatgatttgattttatccaaatggaaaaaatggttcaaaatggaaaaaagttccaatactgagaatatggatgtcagtggccaaataatatgttgcattttaattttttttgcagtcctcagtgaatttttatgtgtctctctgcgtgtgtggcatgtgaaggaacacaaagttagaaataagagagggagacaacctgtggggtggccacattccagggtctgatcctctttggggatactgtgatatgctgcccagatcctcccatcagtgctaaagaagacagccaagtgggagacagtgaggcaacctaaatgttctcaatggcaggaaaccattaccagccctggaatggaaaaaatacagggggtggtgctgtcacctgcccagaagccaaggtcattagacaggagctgagaccatgaagggatgaactgtcccatgtagactggaacttcagaaaaagtacagccattgccacaggtgcccctgaaacagaaagagagaggaaaaaacacccatacatattcccgtttataaattgccaggcttctgtcagttattcatgttgtaacaggaagctacggggccatgtcaccagggacatgtgcatccctggcacacaaagccgaacagggcatggagccgagggtgaagagacaagtgacaggcaaatggcacctgctcagtcaaatctctgagagtgcagcctggaacccgcatgttcaacaagttgtccagaccattcttatgtgcaccaacatttgataacctttccgtaacatggaaaatcccttaaattgccaggctcttataattgcaaaacaattatagtcatcaattctgatggaaggaagatgttgaattttgtgagcctttccccttctctgattgttttaaccaaatatgataaataacctgtggaatatacgacaaaatgtcccttaataacaaatttctccctttcagtgtaaaattatctggaaaaaagtctcctttttgcacagccccttgggagccattaacatggcattctacagtaatccaaaatgtgcagaagaaagtgaggtacatttacttaaaattagctccacagtgtagtacaactatttccagcattcatcattgttaatgactataattgatggctgaaaatagaaccctcaaatgagaataatgtccaaattcacacacgcacactaattgggaattgttcagcctgtgagcatggcagccagatgcaccccacacttcgacttctttcttcaattcagttctacactgtacttcattaatgcttaaggctttaaaccgctgcccttgtttaacacatgacagtttttatgtgtggaaatgttctatgcatgtaggggtgtgggaagcagacacaaacattctgatttaatccactggaattctgtggcaaatcagctcaaaatgccttagggaaagatcctgtattggctttaattgttcctaatatgaaggattgagaaacgtgctttgagtgcttttgggtttatatgtaaactaggaagggaaaataagaaaatggaatgaacatagcaaagaaagatattcttaaaacagggctgttgctctttatagaaaataaaggtttaaagcagccaagtacttgatttaccaagcaggactgactcatcttcatcagtggagatccccaatacctaaggtacatttttaatataagaaattaacatcattataaatagatttctgtgttgctgttctccaaattcatctcattaaaaacgtgaccattaattgatgatcatccttgagtcactcactcttatcgtcactggtttcttggtctgatactaagaggaggccaggatgtgcagtaaactgtatttatttccagtgcttcccctttccaggtgactttgggtaactcctgcaaagtctgatcttcaggcccctcaattaaaatgataggattggaattagattatctacccagctctttgaatactgcaattcagtgagtctataacacagaaacttacctgtgtcctgtaaagttaaattagattttgccttcaccgcttactataaagcatacagaattactcgttgttatttaaacacgctgcaaaaattagctgggtgtggtggtgggcacctgtaatcccagctactcgggaggctgaggcacgagaatccctcgaacccaggaggcagaggttgcagtgagctgagattgcaccactgcactcccgtctgggcgacagagctagactctgtctcaaataaaacaaaacaaaataaaataaaataacacaccgcgtattttccagcatttgtagtttttctcaagcctaaatcccattcccaactaccaagtacctctttatttcttaaggccaagatcaaatcctatggttttcattgccttatccgttgccccggttagattcacccctctccctttgtgctgccatagcttccccatatacattgcttgcatctcatcatatacaagtctgtccagtttcaattaatttttgtttattatcgactgactcctctacttaacgaggatttcttcaatggttattattctatctaaccatctttgcaaccctgaaggttggcacatattagacactctgatgatttaaacagtttcatagatttttttgcttaaacattttgtagtaaaacattttgttttgttttgtaaaaaatgtttatttttgttagttaaacattttgtggtagccagccttaaccatggccccatgactctcccccactgacattcatggctcatgaatatcgcactcccctcccatttcaatcatggctaacgatgaggccaagagaatatggtagaagcgatgatgtttcctttttgaggctaagttataaaaggcttttgcagcttctggctggtcttgtgtacctctccctctggaggaagccaaccttcatgccattaggatactcaagcaaccctgcagacaatctcaattggagaggatccagggcctcctgccaatagccagcatcaaattctcagccatgtgaataccactttgtaaacaaacctttcaatctttgtcagtcctacagatagctgtagcctcaatatttgactaaaacctgttagccaagccatttccaaattcctatagaaactgaaagataataaataataattattaattcagtaattacttattgaaattatttattatttggcaatacataattaatacaaatttcttcctccccccttttccatgggaaccaatattatggagtcaaaaaaaatgggtttgccattgaaatcttgcctgatacttaatatcaatatgaataatgtattatgaatagtaacagctattggcattattattaatgtattagcaccattaactattatattattcattctaattaacatagccagatgattggtatgcaattaatgtagtaaattagtaataatatcattggtatgttgttaaaacactaatgtttggatgacaatactaacaataattattaatatcaattattatatctatttgtaagtgatagaataattataatattatatctacatgtatgtgaaatattatgatccctatttgaataatgaggaaactgaagcttagagcagttaatttgtccaaagtcaatcaactcgtataataatgagttatgactccaggctagattcatcttaagcatcaaaaactagcactagagctttgagtttcctcatctacacaattggtacagcaatacttaatatgcactgtgcttgtggggattaaatgagatgaaacctgtaaagttgcttgcagaatgcctagaaaagccacatgcatcaaatgccagtttatctcccttccctccacaatctgctctgtttctaagaagcccctgggaacacaggccattaggcagagctgtcagaagcagaagcctcagatcaagtccatttccacatgggaccccaggtcctgaaattgtgcaatgagggtgactcttatatttcctgtggaagaagtaaggttacaactcagtcttttgcctttctcaaactcaggctgagtatctaataatagtgacgttttaccttttgatagtactctggagattacagaactgtttccattttctacttaggagagggtaaatggatttgatgcagatgtgaatcagattggccatggaatgaaagttggaaagtatttgtggcaacaaaccccttatgactgacacacacactccttccttaaaacctttatcttctgcagaagcaatctcattacaaccaattggtggtcagttacacagaatggagtcataagagtcattatctatgggatgttttttcctttattcacaatgaaggcataatctttttagagagaaatacaattctctccagatatataacaaaatatatctactgatgttggtttagtttcatgtggttgacaagaaaaagcattcatttacctgaatacgcagctcaattttaaaataatttctgtaattttattataattcacagagctgcttttattcattttacaaattgctttcaaagcataaatgatgtattgaaagggattgactatccgtaatagctctgatgtgtgagtggctggtggacttaccactttaacatgatctggcatcaacctccatgagctgcgcagtaagaatagcaataccaaattgtggtaaacctcaagagttttcaaggaagcaatatgggtctaattgggcagaagcttagcaagtagaccacagctatttctttgtagaaagtccagttgtgtattacaaagattgtgcctataaggtttgccttgctaaatggaaaccacaaggaatgggcctttggatgtcttcttgaatcagagcattaaagggacttagctggagttcaataaggataacatttttttctttgcaaaaatatgagctgtgtgcaccagcacacatatgtacttggtctgcaggcttctctctaggttgccaagaaaataggttttgatggacagggctgtaccatgaaggatagtagacgaaaaaaaagatattaaaggaagccccctttttaacctttaaacaaagttaaacatgcagtgtttcttaatattgtttaaccataaatgccttttcaaaagtataatatgcactaagatttgctctgtggaacttgcttgggtaatcggatcttttaaaagagagagaaattctgtggagtgagacacagaaaatcttattgaatgggaccccttttctccgtgtgggaatgaactggtctctcaactttctccttagctaactgtctgcaacactacagactcgtatctacctccaacatgagcctctcttgtcctcacaagaacccctcgagggctctactgtgtcctcagtagcagacactgtatcatgttcaggtgcttgtctgtttttttgatcactagccccatcaatctgtttttttccaacttgccgcattctacacattttcctcctcaggtcaccaaagtgcagcctttcatttctacctccagaaactcaagagtttctggaaacttgatttgccccatattattaacaaaacaattttattaacatatatattggcctctgagctgcttctgaccacagacaccttaggttcctcttggttacaaaagctgtggtctatctctgatgatgtacgaaagaagctgatgcttatcctgtggttgttggtcctaacctcctgtttagtctttttgtaatttgaatctcatgcaacttttgtgatactcttagcccatcatcaactgcttagcccatcatcaattgaaaataatcagatatcctaaaatcatcagccagcgaacttttcagattgttggcacttgagtttttgtagcactaagtaggaactatcaccttaccccagtgtcataaatctatgggactaaaaattttgagaaaaactcatataccgtattatattcaatactccagagatctactcaggttaattttcttgtcaagattgggcagcttttgacctagaatatcaagctttttttttactatggggctgtggtacattccattctttccttttaatttagtaacacttggatttcctctctaataaggaacaaagtaaacaataaactcagaagctcccaatgctcttcagtgtaggagaaattatttcacattaccagggaagagaaggaagttgcttttatcctaatagtgatattctcatttcttatctttctatgcaaaatgtttaatgtttccatcttgtggagcccttaattacatccttaccagatgtgatgcaaaaattaagcatcaattagctttttctggattgcacacatccttaaattctgttttcagatcactgcaacttaactttgtgatttatattggaaagatagctttgggggttcatttcacttcattattcttcagcaattgtatttcatccccttagctatttctatggcaattgtgctctgttgagaagagattgaccagtgttgctacatcacaatgactgtgagataaaatccggtagagcacagctagattttgatgagtttttggatcccacacgcacaaaagcagcataggaaaataaaagtgataagcatcattttttgcattcaaagttgttctgatataagacagactgaaccttttaaataaatacatcaataaaatggactaatgcaactgtaagcttgtagtctggtttcatttgataaaagcatttataaaaataagaatgatttcccagaagtcagttagtataagaggtacaatggaaagcccagacagtttggaggacggctttgggtactcaactcatacatgtgtatgcatatgtaaactgtgtgcttatatatggatatgactatagatatagacatatgcactgtcttttgcccaaattatttcctgttatgtttattggtaatatttgcctcattctacatgtagaattcctatttcagcttaaatctcaaatgttagtgaaagcctaattttttatccatcatttctcaaaaaaggctccttacaatatatctcttcatgaagagaagaaacagaagcatcccttgagaggaaatatagcattacacttgtgagcaaggactatggacaagattgcccaagttcgtctctttcatcacatgatgaaccgaaccattggcccccgttctcagtggctctgtatgcctatatccttgccatggtctcattgtgagaaaagagtacatcccgattccttgactttttccttggctctgtgacttctgtcggcttactgaaaggtgacggaagtgaggctaagttagttccaaggctgggcctcgtaagaccttgtgcattttcactttctgctcttggcactgccatgagactattgacttgataactcattagtccagaggggataagaaacatgtgaaacagaattgccccagcccacctatggtacaaagcccagctgccccaactgtcatagcctaaatcagaagctcccatccattctcagtctagatttggtgaacctcagctgaccacatatcatctataagaagtataatgaaaatcccagatatttgaggggctgctttggataataacaacacaaacatatatatgaatgtgtgtagttcatatgtctatatatcatcattgtgagaatcattctgtattattatattacattgtaattttgtgattatttattatgttgcaatagctgaaaatgtgaccacctgttatctgtgtaacttcaggcaacttacttaaactttttctgcctcagttccctcatctatgaaatagaaacaagaattatctactggctcctagaattgtagcacatattaataagttaatttataattaaatttattagactaatgcctgaaaaatagaaactgataaatgaatattacctatgattattttatcattcttctatattcactcctaaaattttctgtgggaccactgtgaagtcaaactgctagagaaagtctggcactgtggccatgacagtggctcaagccaccacagaatgtctgaccagcccatgaggatttgacaagcagcagttacagcatctatccagcgaggacaataagaactactttacctgttggcagaaaacaaagaggaatattttatttcccaccacatcttcacttcccatgttatggtgagctggtcagaaattagtgccataattcttcagctttgcaacttgccggggacaacatgtgtggttggttgactccaaatttttctcagcttcccctgccctcttaaggagtggcaaaaaccaaaaagcatcctcctttaactcaaaaattgttatcaattcacaaaaaaagatcttttagatctcgacttatatttgctaataaactatggcttcaaaaaatgtcataaattatgccatgctcacctatatctacttccacagagttgaacctggatgtaaaggacaaaatattattataagcccaaaggcattgtgacatcttaaaattttattgactgtgaaataaaagaattccatgactgaagaaatggctactgactgtataaatttcttaaactagtatcaagtaaaatataaacacattgactaactctactggaaaaaaatggaagctataaaaaaattcatccataaactcttccaaggcaagctgtgaaagactccagagcatgccaaatgttacccacattagttaaattatagtaagaatccccgcgcactaagtctgagagggattgtttttgtccttatgaagaaaaataaatatgtttttcaacaagaaaaccttctgaaggctgttgaaattttaatcttttaaaaaatggttttaccacatagcaaaacctcaaagttgtatttcacttttaagactctcaaagcattccatccttgcaatttcattttatcctcatctcacatctggatatcctggtgagatggaatgtctttctctgtgtttcacatgctggccttgatcatgggtggcccacactaagttgtgagaaacagaatgagctaagcaaagggaaaacagaagggatgttaaggcagagaatgatcaagggccgtggccaaggaaatacaagcgtattttattacattttcaggcatcagcatctaatcatgatgttggggtggtccaggatgggggggtgtattagtccattctcacatcgccataaagaaatacctgagactgggtaatttaaaagaaaagaggtttacttggctcaaaattctgtaagctgtgcaggaagcatcatgctggaatctgcctgggttctggggaggccttaggaagcttacagtcatgtcagaagccaaaggggaagtaggcacgtcttacatggtggaagcaagagagcaagtgagggggagttgctgcacacttttaaataaccagagctcgtaagaactcacattgtgagaacagtatttacgggatggtgctaagacattcatgagaaatccacccccatgattcactcacctcccaccaggccctacctccaacactggagattacaatgcaatgtaagatgtaggtagggacacagagccaaaccatgtcaagggaggagacttagaatgatggtgggaggtctaggctgtggtgcttgactagaagattctggtgacagtttattaagggagaggtagtttgtgatgggttcagctagatatccacccctggaaaatagagatgcaaaaaattaaacaagagggttcagttctaccccatttcctcttatatagtaatgggacttggactgaattcaaggggtagaaaataggaagcaaagaccagggaagagatgaacaggaattgggtaggtgtgttgggcttggttggaagaggaggttgaaaagacactagacactatggtcccaagagaagagtccatgaggtgaggagtctgatgcaagactctattcctggggccatagcagcacaatccagcaagagagtgacacaaggcaacatttaactctttcttgaccctatttcttagtattaaggaccacctactgtcagggtaggctttgtgacttcccaatgccggtggagctggacctacaggtgcatgccacgtctttggggtccctaggatatacactgatggagctgttgggaaagggacagcatccagaatgtgagaataataggccacagaaacttcatattacgcccatttatttcaaagatgagaaaacagaggttcttagtggctctatgatgtatttgcagtcaggacccagaaccaatgagccaaaaatcccgagacctttcatcctttttttcatcttttttttttttttgcctctgtaagacaccaaagaaattggctaatgttaatttgcttcttctccagttcccttgcttatcacattaatgggaatatcagaaaccacaaaaagcatcatgttggttgcattgctatttgaacatcacaaataatttgttttaaattctactgttactcatttttgatgcttggattagaaagatggatgtacggatagatggttggatggggggtgggtggatggatagatagatagatagatagatagatagatagagaaatagacagacaaatctgaattgtaagtggtttggacacagtgcatataccacagctataaggcacgtaacactttacctcctttgccctggggggttgtgtcgtctctcaagaagtcaacatctggctttagttgataagctaggtgattaactttttatatcaagatccactgcccaaaataatttgactagtgataaactaaatttttatgcagaattatttagtagagtaggcacctagaaaagagacaggaaacagtagactagatttcagtcacgacccttttcctcaccacttggtggcactgagctcaccacttaaccttgctgtaccacactcacctccactctggacactatgagtgtaatagtgacttaaatgaggtaatcaacatgaaaaacactttgacaatgaaacagagttgcatgctgatgccaagtggccttgttattatatgcatttatcatcaccatttccctattcttattaactgactgggttagaacaagttcaaagaaggcaggagctcattcctggaagttgactctactttgttatttaggtaaagtgtgactaccgctttttgtaaatgtgcactgtgagcagagtgacatttttcatgtggatggtttataccagttcatgttcgtgtgttgacagttatgttaattctatgtgatattttccctccagtgcttttgcttttgaaacagcataataaagtgacttctgctaaataaataggcctgttcacaataactgatacttaagtgaatttatgcaggaggtattttggtcttgtggaccaaactaactagctgcaaatcgattaacttcaaggatccagcagagtatttaggataatttctgaagtgcaaatgtaaaagtcatggtagaattttttttggcatatgtgtagaatttctaccatgggcccatttaaaaaatcaatatcataataattacatcaaagcaaaagtaacagagcattatgtgcatgatcagaaagctgcaactgagaggaaagtccaaccactccaggaaaatgagaaacgtgtaattaacatctgcaatttgcattgctccctgacactcctgaatttttatgacaaatcatgctgtaacctttgtaagttggacatcagtaatggttgttttttcatggttttaaagtcaggaatatgaagcatcctctttcacaatcactcatccctactattgccttatatggataatctcaatcctaccccttacaacccacctcactgtagtattctctcttgccaaacatctagcatgcctgcacatatatgagtagcaaaaatgtacatttcttaaagagaaaactgtgaataggagcagaaacctagaacatgtaaatgttttgctgctgttgccaataaagggactgacagaatcactcaatgaatcaactgactaggactgcatttggtgacattatacaaattccctaggaggagcaggtctgccaagagttatgagagatgctatggtaatataattatgaactccctgcagtcaggaagcttataatccaggtgggaaatgacgaacacataaaatgtcatcatcaacctatcaaacatcctttcttcccctgggtcccggtaactgctatcatttagtgagcatttgctgtgtgctcaacacaatgcagacattaattcatttactcccccagatagcctagtgaggtaattgaacatgtaagccccatttttacggacatgaaaactgagctttagtgaggttaagcaacttgcccaagattatgcaactagtaagtggtgacagtgggatttgtaagtaagctcccagacttcaccgtacacctagtgttgtactatttatgaagggtcttatcttttctgtccaggaaagtctcctggaaaacaagacaatttctgtcgtacacatcctgtgtccttctcaacccccaccattgtttgcagaatgaatgtatacattcaacttaatatttattgagtgtcggctctatatttgatacacaatggcacataaaaggataaggaaaactacaaggcagtacaaaaatgcctcattaaagaccaggatgcatgccagctgcatatttttttttatcagaaatatcatgatgaagaatagcctttttatagaaagcataaaaatatgttgcaagaaggttattttatgaaaataacattaaactgtaattgacaattacctagaagattcataagtggcatcacacttcatggcagtctttcacatcatactctagtcagctagtgaaacaactgctgttaaagtcaaggttttggaggtatactgagttgaagagtgtgttccccctaaattcatgtctactgaaatctcagaatgtgaccctgtttggaatagaacctttgcagatataattagtaaagttgaggtcacgctggattaaggtagatcctaattccaatgactgctgttcttataagaagatcacctgaagaatctctgatcacctccataaaaatgtccaggactgaggaatactccctaaaaattctgattctcagcaccacttcaaacgcacaactcataatatctatgaagacggtcagtaactaggatgtttactaagcacactagaagttttttgctcattacagtttgaaaactatggctttgggcaggatgaagatgtagaagacgtagtgcctttctctactgggttcaccttgatcaaggaaatgagtcgtggaaagcagcatagcaaggaataatcttacttgtggcagtaaccccctgtcgaagtacaaaagaaagagaccaccatgaatgggagcaaactagataagtgtactaagaattcacaaaattttatcttggccttcaatttcagtaagcacagcaatctaaacatgtccaataatagttttgcatgcagaccaaattaagccttgataagagtgatagctaccatattttcaacagttgctatgtgataattacttcacacacatcatttctttgaatattctggacaaccctaccctacagtattggtctattattagccctatttaactaatgaaaacagagtttagagaagttaagtgattcactggaagtggccaatcccacacacaaaactgtgaccaatgaaatttaagcctattctcttgatccgaacctcctctcccacaaaacagaacacctctttttaagccatgtggcctgtctaaaacaggttttccacgtggactggatagacttgaagtcagagagtaaaaatgttatttcttctaggagcttcaattttatataaacatttagggtaagaaacactttttatcctaacataggcataaacatataaataattgggtagaattgtaaaatatggaatgcagttttaaaataaaagatgtatgttgaaggaaactttgcaattgaccagaacttctcaggctatcctccatgaactggagtgtggaagggtccccatttagaatattcagccttcgaggatacttcatggtaaacattgtgaaataatctcataggttccctcactggttttgtcccacactagactgcttgggatgtcacagactttcattagttgctttaattagttcttttcaattgattcctgtgttagtttgccccacccctccaacatagtctacaaagtgaaggcagcacacacttttattgacttgagacagcagcgattttctctcatctagttatcctgacctttctttctactgcattttcactgtgggtggcaatgatgatatggctttagtccatttttggcagaacaaaggaatttcctggttggacaccaaaaggaaaaaacggtttttccacgactaagcagtatcaagaatatgccataacaagccttacgtaagccatggctcatgcagtctagagccgtcctgttaaccaactcacacccactggctagagagaaaacatggcgaaatgtcagagctgctaactgagatagaaaacatacaggctgccacatgactagaacatatggtgacccaacatggcagcagcgagaccctcggcatcaagaaaaaacaacaaaataactccttaaaaacaagggctttttctaaagtggaccttgacatagtcaaaaaaaaaattatatatatatatatatatatatatatatatatatatatatggcttcttcacatccaggttcccaaagatgtaacttaggaactaggtacattttaaataatttgttgtccagaatgtatctgtttcacaactcagaaattaaattacatagaaaaaatagaatccttcttaaagtttttcaatgaatacatcatcagtggatctttccaaatattttttacagctgttcacagaattaaattttagctttcttctcctcaacatttccaaaagtataacgtagaggattggtttgtttttaatgaataaatcattcggctaagcccatggaacaaattcatacttaaggtagatggtttagagtggactttcggcagcattattttaggaatgtatctctctaagcaattgagtggtgactctaaattgtgccaatatgccaattccatttgcatatctttgtaatttggactcttcctctcctgctgaaagatggttggataaaacattattggatacagcacaaacgcaaataaagcatcgttttcctgctgaaatgcaaaccaaggctttattttgactggccttaaattttgacctgtaactggcattggaaacatcagtgaaaaccgagaaacagccactgcagcatttagcgtcacagatgctggagcagaatcgagtttagaaaataaacttttaagggattacagcagcagacgttatataacaagattagtataatgggtgggacatctgttggctgttttcagaaagccatcattctattaccctctactaaaataatcttagtggatacctgactgttattgttctttttttccatatacccccagtgagaaaggttgacatttagttgacatttctatgccgtagtcttctcttctttctttttatgtttttgtttttatttggttagttattcttttgtcattgttttaattgttcattttgcttaaaagggaaaaaaagactgtcttactacaaaattagtatcataattgttttttctcagttagtgttcagggtggctttaccttacacataggaaccaacatacctcagagtatagcagagaagtgttcaatagctattaattgttttctttccctttccattcccttgagaagattttgatattcataataaatgttgttttaaaacataaagcttataacactgaattttaccttaagactataatagctgaaggagaaattcttttggaagttaaaatatgttgaaacatctgtatcaatcactctctctctctctttctctctctctcccatgcaaatgtaccaatacaccatgcattctggctccatgccactaagtcatgattttccacctgtaatggattcccagcccccgtgcaggatctggtgcagtgtgccgaagagaggccaaagtcactgtacaagccagggggaggggggggtcatcttcctcaaggattagtaacgattaggaagaaaagcattgtctttatatacagccaagcatgaatattatagatactacattactaaaagaccatgtgacaaaacccaaatttaaataaaattttgtagggggcattttgggcatcatcccaagttcccgagggagacttaatagccctcaggaatatttgcatataaacatttgaaaagcacttaattaattgataagaccactggaagttgtgagttcaattttcaaaatatgaagcagacaatgttgtggaggatggacaacctacagagggtaagagggaggagaggaaaagctatttcttccgcagagagaaagccagggggcccatgtttctacctttttcctcaagtggtctttccttttggggtccctaagtcagttagtagtcataattaggtcactcagagcccactgatacagtggagagatatgacagaccttttctcatatcctccagttggctacactgattacaagctggaaagatgactaaaaaggggtgtctcctccagggatctaccgtctagctgaggggcatgttcctctatctggcatttaaagagagagatgatatgaaatagctacaagttcataaagatataaagcgacaatcaaaggtttggaacagctcatgcgtgttgggggaggtagaggctagggtggctaataggagaggcacagatgtaactcaccattttccttcctttcttttatgttcacacatgcacacacacactcacacacacagcactgttgccaccagaatgcttttggtttgtgctttcacattgtagaggacatgaacctatggaaaattactcaagggagattgttctgttgaggtttgccttttgaacgaaaagattctttcttgcaggagtgggagggacatcagcttgagaaaaacagcttttgtcctcacaaaaatgctcttttggaagatatgttaatgagcttcctttgaactgtaaatggcatctgcatgcacgtcagatgctaatggaaatgtcgagaaaacgataaggcacaggacgattgcacggttatgcagtgggccccgttccttcgagcatcgtgaccaggctgcggagccaccttgtgacttggcatagcattctcattttgagtggagatttttgtttctcccactgatggcatcttttgaaagtcaagatgtgttggctttataaagcactatcctccctgggcaacctcataagcagcaatgaatgacaattcttccttgaaatttttaattacttcaacaaagaaagtaattattaacttttgtctctgaaccacctctgcagatattcttaatcaaataaaagaaagaggaagcagagctttctgagaagcaggaggatgaaatagacaataggggtctgcagctggattgcggggtgacatgagcgctgcatgtgtgctggataaacaatggctccatggttggaagggtaatttcatgtcatagactagatggcgaggaagaagtttgagtcaagagacctattcttggcactgtcttcttcgtgtaagggtaccaagggcaccatgggagtgatggcaaagtataggcagcagcccgtaccttatcggagtgagaagatgaattacattgaattaacacttgataggctgaatgttgagagatgaagtggatatctgaccaattttctcctcacctcttgatttggattctcccaaaagcagaccctaagacaagaattagagtgcaggtagattatctgtggatcatgcagaggtgaggagagttgacacagagcatgccaccaagagcatcaccctgggaaaccaggcatttatccctctggagaactctgggatctctcccccaagggtgatcgaacagggggatttaaacatcaactcccgtcagtctttggttgaggctgccagggtgacaggcattaattttccaaactccagctcactagatatttgctcagagcctgccagcactatgaaagccctcaggcaaagaagtgcaggtgcttggccattgtctggctcacacttactacttagacccacgggaacatgaacagggcacctcagtgctgccacacctccagactgtgtgggcccgcttatcttttatggatttgctaacaaaccatcaagtaatccatttctcacatagaaggagatctgtaactcttatctagaaggatctacctagcattaggcaagatagacatctgcagagatgtgtcttggctctgggtggctttggccatgtgagatttaccctcacagctgatggcagtcactgcacggttgccctcggagccagtttcctgtcctttgaacagagtccacagagaactttgagagacacgtttcccaatggtcagtgtcggatggggccccaatctcaacaaatctgttgctgtcactttgttagggttacatgtatagcgtatattgacttcaagtgctcttttacaaaacaagtcctgacttcttaccactggtcagccaaatgctaaatatggtcactcctgaaattactagtaagcaaggagcgggtagcagtcactgttggacagagctcaggtggccggcttcatgtgtgattggctgctgccactcagaacgttggaaatgatggaaaaaatgggcatgggaagaaaagaattcagattgtcaaaaatagagcgttattgtcctaggtcaagtgtccatggaagtagactgagaggggaattgcaagtaggaagtttatcggattatgttcctgaatcatacctgggtggagaggaaacatgtgagaagcagggttgggagaagttgaactgtgatccggtcacagcaaaggcttcggctgatcccaacaggggctcaggagtggggaaagtgtcttagtctactcaggctgccatcataaagtaccacagactgggtggcttaaataacagaaatttattttctcatagctctggaggctagaaggcaaatatgaaggtgtcagcagggggcatttcttctgaggtttctctccttggctggcagatggccatcttccccctgtgtctttacatggtcttccctctgtgcatgtccgtgtccaaacctcctcttctgatgagaaaacttgttatatgggattagggcctatccccgtgacctcattttactgcattacttctttcaaaactctgtcttcaaatatagtcacattctgagatactgggggttaggacttttatgactgaatatggaggagacacactttggcccagaatagatggcccttccgagctgcatcaaattgagggaagggggtctgggccttgaggctactccgtgagtcagtcattggatgcaggctgacttcaggaagagagaagcagcgtgggtgaggtgcctgcttcagcagaacacagtcctctgagagccactccttggagctgtcagtcaccagcacctccagcaagggaaggatgatgtgcattgtcctgaagggaggggcagccaccacgagcacacggcagcttcctctttaatcgtgaaaagaaagcccattttttatctttgactggcatttcccctcagtctctcccaggatcatctctttggatacaagggcagaacaggtcatgcttgctgtgctagaatatagaacggcaggccctaagcctgtgtgtgtgtgcacgtgtctgttccacactaaacatatggagcagcttcaaggaccacgacagatgtgtcgtttgtgaaattttgatcaatatgaggcaggctcggaaattaacttgtgtgaatgagcctccagctcaagccaaaataactcttggctcctcagatgcatggccatttttcttattgagttgaagaaaagtcaagaagagcaatttatcaaaacaaaacaggaagattctgaattctgctgccacagagtaatgacagatatactggctttgcaaaaaagccccccaaaataaaggatcctttttatgcccatagaagcaattttaaaatgcaaaaatgtactttgagagtttgtggattataaatgttttccaattcacccaaacatctctgggaacatggggagaaaaattttcccattctgtaatttggagattgaagtagcaggttctgtggtgttgtgcacaagtgcgaacatggctaatactttcacgaagaagaacaatgatattcggtgacatttgacaaagatattaaaatctcagaatacggactcctatggggtcttgtgaaatctttatccgttacaccatctccactatcagcttacctgtttcccgtttatctcattggctgatatgaccagacaaaaacagagctgcttatatataccatggcctattttcatgaatgtttcttttaagatagaatttctcataaccagcctgggcaacatagcaagactctgtctgtacaaatattttttaaaaaattagccaggcatggtgtggcacacacctgtagacccagctactcaagaggttgaggagggaggactccttgatttcaggagttctaggctgcagtgagctatgtttgcaccactgcactccagccggaaggacagcatgagattctatctctaaaataataataataatagtaataataacatgattttcactataacagataaaaaaggtgcccctgatattctcatctggctatacctcgtcttaacctggcttacaaggtcagggtagaaataaaggactcagcaagtgaacactgattttatttccatgccagcaccagggtaggtgttttaggtaccttatgaataataactatgcaaacaagcaactgatgtttatggagcatttactctatgtcaggccctttgctgaggactttatgtagaatttctatgtggtcattataatcaacggtggcaggcaggattctaagatgatctttcagattcctaagtcatggtgtacacagacctcccaattttccaaaccataatactgtaaagggattttgaagacgtaattaaggtctcaaatcttaaaatagggagattatctaggtgggcctaacttcatcacatgagttctttaaatttggaacagatgtggaggaagtcagagaatcaacactgagaaggagttgacatgcctttgctggcttgaggatggaggcagaaatatggcaaggaatgcaggaggcctccaggagctgagctgtcctccagctgtcaaccagcaaggaaatgaagacccccatcctgcaactgcaaggaactgaattctaccaccaatgaaaaggagtttagaagtggatttctctcctgagcctccagacaagggctcaattcagctgacaccttgattttagcctgtaacaccctgaatagacagaacccagtcatgcaatgtcagactttagacttacagaactgtgagctaattagtaggtgtgttttaaggcactaacccccagaggtcaatgtctccattttagagatgagcagactgaggcttacaaaacttaagtaacttgttcaaggtcacaggtaaatggtaaagtcaagtagggacacaggcagctgcttccatggagggaactgcgtgggaggctgaagttcaaaacagcctccaagatgccaatatgatcgcccctaggtgtgcacatcttgttcagttttctccccttcagggtgcgtagaaccttcaaatatgatggggtagtcactctgttgattaggaaaagagatttccacagagggaataaaggtattgaatcagtctggctaattacaaacaggtggacttgactaattaggtgggcttttagaaggaacgtagaggtgggaggtagagaaagtgatagaggcacactcttgctggcgtggaagaaaaagagcgctcgtgtcctgaactgctttggggaccatatggcaaggaaatgcaggtggcctctagaagataaaagccatccctggtcaacacctagcaggaaaatggtgacctcagtcctgcaactgcaagggatcaaattctgccaaaagctctaatgggcttggaagaggattccaagcctgaggtgaggactctagtgcaactaacactttgattgcagcttttgagactcaaagcagaggacccaactaggttgggcctggactttcagccaactgtgaaactgtgagataataaagtgttgttgttttaagccattaattctgcggtgatttgtcatgtggcagcagaaaactgacatgctgggagaagagcagattgctctcttttgcctcacttggtgggagaggagggactaggacccaggcaccccaatttcttgttcttaattaatctgtagtgattgcttccctttgctgctctgtttatccctgagttactctgagtactggggaaacttcacttatcctggtcctccaacctctcaaaacctgtctttgtacaaatttgatacttaagctttgaaatttaattcacttattaagcagcagccactgttttatgaaatcatcccatccaaccctgcactggtgagactgttgatttctctttcatgaaggctgggacttaagcccagctgtccatcaggctatatttacccaggatagccctccatcagtcctcagttaaagcagcatttgcatcacaccagatctctaaatgttggttgttggggaagcaaattacattcatcagaatccattcattctcctcgtatcactgaacacaggataatcttggctgtgtcagctgccctatgactggtggctctgaaaaatggaggttggctgcagatactccaaacctgcttcgctgtgtcaccctcttcagggccagtggatatgatgctggaaaagattaatggaacatatgtcatcacatttatggggtaggaaacccccaactgtggattaatagatatcttggtgaaagacatacatctttactcctttatgcctcgatgggtgagctacagttggctgcagtgaaaatacacagagagattacctttaggaggtcagcttgtaaaggacttttttcaaccctgaggtcaacaaaaatagatttttgattgttgaccaagagagctgtaacataggacttttaacctttaaaaaaattcttattgaagtataacatacagaaaagaacacagttcctgagtgcacagcttgatgaattttcacaaactgaacacatccagggagccagcatccagatcaaaaaaccaggatcccaggcatttccctaggtctctttgcaccaaccctccaccccagggtaattgttacattaacttctaactccatcgatgattttgcctctttctataaggtttttgaactttataaaaatgaaatcatccagtgtgtcctcttttttttctgggttctgttatacaacattatgcttgtgagatttgcccgtattattttgtatggttataaattttttgttctcattggtttttaatattccattatatgagtacatcgtaatttatccattctatcatttatggacatttaagtagcttccaatttggagatattgcaaatagtgctgctatgaacattctagtgtgtgtcttttggtgaatatatttgtaggttctactaggtatctatgtaggagtgaaattgctaggttataagacatgtacatattcagctaatttactatgtactgccaaataattttccaaagaggtttccaatttttattctcaaaagcagtctatgaaagttcctgtcagtctatatctttgtcttatatcaagtataagacaatacttgatattgtcttttcattttaaaaagctgttagtttttaatacatcctagtttagagggcatcattgttgctactgtgaaacgattaagcactctatatgaaaactgggctgaagagccattgtactcaacatagtatcattggataagatgtcagttggtgacaataatgcctcatgccctttatatagtgcttttgtttttcttttttatagagtgctttgcaaaaccatctaggtttctctgtatttctgttctcagctcttctggcaaacttaaaggaaagtcctccgaaatatcttatgtttttggttctagaactaagtacccttgaaaactatctgccacatacctacattttagtcaaatctgtttgtctaaacatatactctgtggatatttacagagctcctattatgtgtcaggacctatgctatgcactggtgatgcaaagatgagtgccacctgattcttcatgaggttccagtttaagacataaagtgaactgtcagattgttagttctaaaaatattaatgttgttttttgtattattttctattacattttagactagggaatcatctgagtttattgacagcttgttcataaaagagcaaattattttaaatatacaaagttgctttaattacaagcggggatggaaactttaggaagttaaccaagaagatgggccgggaccaacaaaagttcatcgaaaaagaagtaattggaatttgagaagccttgacagattgcacacctgtaacaaagaacattgttattctttgtacttcattgctcttctctacataatattcactgaaatgatattgaagattacatcagctggagttaagtcagataagcagaatccttgaatgatatgggttaatggatttattgcagggattagatcttatacaattgtgggagaaactgggaaagtaacattccacaaggggatgattgactgaatagaaaagcttctaaccggggcccatggaatggagctggtgaagatgtctatggaagtcccttgcctgtccatctggacagggccagaagtatgtcagcagggcagatgataaaagaggaagtaggaaagctgcatgcaaagcgggagagaacaaagacaaatgaaagtcacaagggaaaactggaatccacagagatccacaggcccatatatctgtctctcactgattggaaccccaaagctgtgatgtcctgccgaaggatccagtgctcttgctgcagaacttcatgtgggcccagcccagctccaagaacatgtggcagaagaaccatcaagaactggagaagctgtggggccagctgctactccacacccatgtgataagcaacagcatgcatgatcgcccaagccctgcacccaccttcctggcacaaagtctctgactgcacttctgccctacaaatctcatggaaatttctctgtggccagccctaacccagaaccattcagagaaatgcaacttcagcttaactaacttttgacatagactgtaacagaggcatagaaagaaagaaagaaaaaaactatagagatgagataattccatcttttcttgagaaagatgtaaaaactagggtgaggagagatgatggcttgtccgatgtcacagaactagtgacaggcctagaaactcaattctgtgtgtgtgtctctaggtgatatcacagaaaaaacaaacaaacaatctctggatgtgaggttcatgcactgtctttgtatagtccaagccactcaagaggtttgcttgaccctagaaatttgagtccatcctggcaacatagcaagactccatctctaatgtatttaaaacattaaaaataaattctaaaaaagaagacacctgagtttttgccttaattgattgcttgggccttgggaaaaaaaaaatcactcgattcctggactcatgttttctataagtgaatggcatataggctaggcccaacaaattggaaatgatcactttatatctgatgaataaatgaatgaatacaatctctcaagaaccactatttcacaaaattattttactgcctaacatttaaaaaaaaatgaaacaatgctcctgggcctcaatagcgaggcattcttataggttctcatgaaatttatctggggctagtatggggcatatgggccctttttcctttgtacaagtcagatttccaatctctcagccatataacaattagactttctcctcacccactgtgacttcttttttacttattcagtctgggcttttcagtaggagtcaagtactacatagctggaaaaacaagagactctggaaaaacagttacagggagaagctggaagaatatcagatttctagttatgtattttgatggttagctcatgaatttgaaatcagcatttagcaggattgacctgtttcccgctggtgtgacattagctgggatggctcaaaggcctggagttgaaataatctaaagtctacctactttcagtgagggtagttggatccatattgtctctctgcttcctcatggcatggtggttgggtacaagagcgaggctcccaagaagaccaggcagaaactgtatcacctcatggattacaaagttatacagcatcatttctatcatagtcataggcttcccagattcaagaggtggaattacagttgacccttgaacaatgtgagggtgagtggtgactatccccagtgcagtcaaaaatccatgtataacttttgactccccaggtacttaactactaatagcctactattgactagaagccttacagataacataaagattgattaacacatattttgtatgttatatgtattatatagctgtattcttacaataaagtaagttagagaaagaaaatgttattaagaaaatcataaggaagagaaaatatatttactgttcatgagatggaagtggatcatcataaaggtcttcatccttattgtcttcacattgagtgggctgaggaggaagaggaaggggggtaggtatactttctcaggggtggtagaggtggaggaagtggaagaggaagcagaagaggcaggcatgatctgcttaacttttactgaaaaaaatccacatataagtagacctgtgcagctcaaacctgtgttgctcaaggaataactgtagatcccatttcccaatgaggggagtatcattattacactgtaagaagagctgtgggatggaaagcgcatcgcatgccatcttggaagacacagtctgccacaagcactgatcagtacccatggtgcattcataaacacggagcttgtcaactatatgagctcttgttcaacaataaccccagagaatatgtttgtgcacgcttataataaatacatacacatatacatacataataagtacttagtgaataagactaattcttggattcaccttgcttccaagacattttccgtgttatgcctaagggtaagggcagggaattgggccactcaattaatttaaactaaaaagtgtttcactgtcaccatccccgcgcttttttttttttttctgggaaaataagttgggctgctgagttttggacttaaatcatttccatggcaacagagcctaaatgataaaaggcagattatagttccttccaatatttgaaatgtctgtatatggtctgcatggctgaggcaggcagatcacgaggtcaggagatcgagaccatcctggctaacacggtgaaaccctgtctctactaaaaatacaaaaaattagccgggcatggtggcatgtgcctgtagtcccaactactcaggagactgaggcaagagaatcacttgaacctgggaggcggaggtggcagtgagctgagatcgcgccactgccctccaacctgggcagcagagcaagactccatctcaaaaaaacaaacacacacaaaaaagtacacttagcagagaataacattgccattaaccccccatacacaaacacacactcatacacactcatgcacatatttatacacactcacacaagaaacatgagtgttaaatttcataatttatattaaatgattttaagtatgggggaaatgtgtaggaatgacactgttcagccttgtcttctcagatctgcattaagccaaattttcttgttttgattttttgatcggttggttgactttagaaatattctgatcacgtaaagcctgggggaaaaaagtcaacaatcgtagatacagaagtgagaataattacgatctttggaaattccaagtagttcaatgtggcttgagagtcgtttatgtctgagggaggataatgaggctgcacagtcttatttttaattttaggatttttgattatgaagtgtttcaaatatatataaaagtatagaaaatataataatatgagagccatgtacctatccccatagttagcagctattagccatttgccatgtttttctcaaatcccctttctttctaaaggaataaagtattaggtcttcagtcaattccctacttacctcctcctttacctccccaccctccccagaactcatcattctcaaaaagttatgtgcgatattcctgaggcactttaaatttttggaatgtttttgagcagacagcgattcatgaattgggcagctccaaattgcaggtgattctgggctccactgaaggggcatgaagggcttttgtagagttgacatgaaaacaagtcaaagaaaatatatgatcactccaagtggagcaatagccttatttgtatcattccagtggaaagaccctagttagagattagttggcagtgtatgactggctaagcttaaattccttttactgtttacactttggtttgattatgtaagaatccaggatgcttaagccacctcagtctaacagcctcccaattaattatttaaacagtacttatgaatagatccctacactcttgtatctttacgttttgaaagtgtgcagaaatggtatcagagagtatgtatccttttgcaacttgttgctgtcactcaacattatgattttgtgctttagccacaggacataaacatgccatacagagagtggagatgagcattcactattgcacagtttacatttattcaactaaatttagagttcacctggggaatgagttgacaatgacaggtttagcatttatagaaaatgctaatgataggcagataggactggacaccagacacgaaagtgaacacaagaaaaaagaaatgtggttgtttgtactctagttgttccatttcccgtttcccttataatccatcctttgaaggcagttataagggctgcatggtctttgatgattacaggttagaaactgagtgattttccaagaggcagtctaccctaagtgaggtctaggcttgggcagagactaaggagccaaatctctggtcttccgtcagaaaatgtgattgtttataacccagcccctacttcttgcccctgtagatctccttttctactgggaactgtcttactagtgagatctgcatcacacaggtttggagagcagggaggttaggtgggtgacttccatgggggttctttcttgtcctgccatgtgtacacccacttccatttcctactgccacgagaaacacctcatttgatgttctatgcaacttgccagtgagtgcttttcaatttttttatgttgttaaaacaaaataactaaagggttatttatttccaggacacaaaattaagtcactgatttaatcagatatatgtgagctattatgtatactccgtgtctcttctccatttactatattactctctgaatgtttccaagaaactctttacatacagaagttccctcaaaacaaaaaagggactatgcacacattttacttttgaggtggcatttacttattcaataatatctacaaaattaaatgttatatcgaccttgcgtcactgtcagctagttactttttatttctgttgcatttccaagtgtgttaaattaaagcaagtggcttcatgccaactaaactgcatggaagctttttaggccttgttcaaatactaacaggtttgataaatatatttgtctagcaagagtaggacaatgagctctttgtttactgacatactttattgtcattctgctgtatacctctcgtgtggctgttttataggacataaagtctagctatcctgtcggaatctcagatcttatttatagcttgctgcaaagtggcttattgtcatttattatttcttatttgatttatatagcatctttccaccaaagagcccataggtttatttatatacagagtacacacacgcacacacacacacacacattcttacacacatccttgaacttcactcaatgctatgatgtagatagcagtatagaaccaaaaatctgtatgaggcctttccatttgtttttgttctacggctatgtcctggcagggcaattgccatattttttttcactttgagtgttttatcttttgcctctaggtggatcggatcattttctgtgtcttcttagaagttgacttcaaaatctacaaaaagaaaatgaatgagtttttctccgtaggtgagtaaagcaacttcttgttttctttcaaattgaggatggaagaagtggagccgtcacttctattcctattgtttttcatcttcaggactgttacacatggtgatcctgccaacttgtatcatagtttctaagaactgaacaaggtaacagaaaatctaggctgtggaactcttgccccaagaggtcactgtgttgtcttggggaagtcagttcatctcttggttctcggtgcctcacatcaaaactgaggggctaattattaataaaagatttctaaagatgcttcccctggccttaaattgcatgatgtgtgattccttctccaacttgtaagtttaccaggccccatgcctgcatctaccatgttaaataccattgttggaaattgtaagcccatttatattcatagtcagaattcaaacttttcctgcattccatccctattccttcccaagtttctcactccaaatttcaatgcctatagtagcacttctagtgcagtctgagaatggcagtcattcacacttctttttagaaaataggagaaacctcagggttattagagaaccttgagtaatgtatttacatcgattgaatgtgccgttagttggatttgggtaatttggatgtttttctccactctccctcttccagcctattaaggctgaggcttgtttaatgccttgttatttttatggtgccattaaagtcacagtgtccaaagtgctttccttagccatggcaagaatcgcttccaggaaatttcaagctactgtgagcattgttggtacttgcctttcagagagctttcttttgaggtttctgtctccgtctgaagtagtttgtcatatcacaggtgactctggcaggtgggatggagtgaatgaagggtgctgatgcatattcatcctcttaagcagtctatcagagccaaacaataaagaggatgccttgcctgtagatcagagtaggatgtgttctatccagaacagctgtagaaaaccaaaaaaccaatggagatggtcagctctctgctaatgccctaaatggactaagttcttctaagtaatttcaagttcttctccctaattttataattgaaagctggctctgctaagtgcatttaatttaaggcttcaactaaagtattcctctaactgaaacataatgtaaattcctcagattcccatgtgataaagaagaggactgtggttataatctttttctcctcttctttctctttctcctctgcctccttctccttctttcacctttcttcatttttttcaagcatctcagtgttttacagagtggaagcacataacagctatttaataattagttgttgagacgagttgaattaaataaatttttcttgccttaatctgatgacttttattgtttcaatgtccttgctccatttttccttttgacttgctttatgacaatattgagctgattggtacctgtattttgaagtattgttaaaagaaaatgctaattatatttttaaatgtgacttgccatgatgtgtgaagcaaatattctcatgtcttgtcagtatcacatcataattgataagattttataaactttagactccttgagatgtttggaaataatgacatcatattcattttcatgtattctaaaataaagtctgcaggaagccatactaacataaggtaaaaaataattgcataattatgatctaattgatattgaaacaaatatttctatcagcaggtatttccaatgatgcacagtcaaaaagcatactgcaaattttttttaaaatgagacagttttaggagggtaaaatatattaatacttatgcaaacaaattattgtttgaaaaattgctactttaaatacattttaaaatgcattgcagtacatgagcaagtgaaataataaaatcatcctcaatctcacatcaatgctttgaagcacacagtgctcatgaaattattttcagtccatatttacaataggaagtacattttaaactaaatgtcaaaatcctcaaaaattgtgatttctgcaatgttgaagcattaggtatttgaaaattctaaatatgcaatatgaaataagcgtgatgtatgatggaatgtgactactaatatacataatataccttacctgtcattaattttaacttgtgtttaattcataactataccatctttaaattaggatacgtttcttcctacttgccatgtatttccctatagtgcattattattcatgatatctctaactagtgttcataatctttcccaatgcaataatgataatagtttagaaaagaagtcatttttataatcaaacaaaatatttgtgttttggggtactttaatcccatgtctgtaaattttataattgggaatctgagacacaatgcatgataaaacaataaaagactcaaagagatcatactaaaggtatgccacatgcataactactacagttcaataataatggttcaatgataattgctattacagttcaataataatgattaataataatcataattaatatatttaataacataacaataatggttactaataattcaaacctttttgaattgctttctattagccagccacagcattcatttctttacatgggtaaatcactaatcttcatgataactctaagaaaggaggcaccgtattaaccctgtgctgtggttccattgttagggttttttctaatttggtcttaaggtttctctctcttgagaatggccatcagccaggatagtcactctccaggaaagctttgaaaagggttgggggaaaattgggttcagatatgtatgtcaggggagacacagcgaggaagtaaaaccaaaatgcacaaaacagaaggcatttattactcacaagtcccagacaggtgagggatgcccacaggagaccaacaggaagcctggaggtggcagggagcccagccagcaagtgggcagcaagagagagcaagcacctgggggctgtctttattagttctgtatgcaccaccccttaggctttcccatgggggttgtggattggctagtttaaagaaaacactcaggaagcaggaacttacttcgatgattctgacactattagatttttaccatgatcagcagttgtggagtatattgggtttggggtcagctggatgaggaacaagtggaacatatcacaactgatcacacagggagggaagtttaagtaggccaaaggtgacaggatacaactgggtttcaaacaacttatgtcaggcctaagaatggaggctggccaggcacagtggctcatgcctgtagaaggaggattgcttgaatccaggagtttcaggctagcctgggcaacatagcaagaacttggctctacaaaaaataaataaataaaaattagctgagagtggtggtgcatacatacctacagtcccagctactcaggaggctgaagtgggagaatcacttgagctcggggatttgaggctgcagttggctatgattgcaccactgaactccagcctgggtgacgaagcaagaccccatctctaaaaaatataaataaataaataaataaatattgtagagattttaaaaccaaaaggaaaaaaagaaaaaaaaatggatgccaaggcagcaactatatgaaacaaatttatgataccctatgttttaggcatgaaaaacgaggattcagctaggaagcaacagagctgtattttaaaattgagattggcatctgtcattgcccaagtgataataggttcgttttctcagagcatctttagagaaggctgagatcaacttccaggctgcatttggagtattggggaaagtcccatttcatctgctgcccatcatttttcagagatgccatgcttctcttcttctagtacctataaataccttcatggaaacttctaatatgagttgaattagtacttttatcattcatctcaaaattgaattccattcacattatagaggtattgtggtgctattacctgcagatgagcaggtaagtggtaaacgagaagcccaaaggcctttatagcatctacaggacaagatggaaaatggcttatattagtttgtcaggcctctaaaaacaaagtaccacagagcaggcggcttaaaccacagaaatacattttctgattattctggaggctagaagcccaaggccaagtggaggcaagattaatttcttcagaggcctcgctccttggcttgtagttggctgtcttctccctgtactttcaaatgaccttccctctgagtcatttgtgctgtatctttctctttgtataaggataccagtcaaatgggatttggacccactctaattaccttattttaatttaattagctcttaaagatcctatctccaaatacagtcatattctaagatatgagggttaggccttcaacataaaaattcacagggcacaattaagcccataaaattgccccttgtagaaatgctttaagaaactccagggaaagaaaccagcatcgaattttttttcaacagttttatatcttgctgtggggtaaagcacatttgactttttccttccacaagtattatttgaaagtagagtgtggcagctttatggaattatcatacactttggttgcaaataatttatagttacagtgcaccattacatggcctacagcaaataatatttgtatgattcaactcagaaatctctttgttctttacataaaagtgcttgtattttttcagtgtgtagaatttattgtgtgcagttttcactagacgtaaaaaattaaaaaaagaaaagaaaagacaattcccgatctggaatgtggaagtcattttttcttttttttctactagagtcttagtcctgctagagaactgaaggatattaattttccccgtaataacaataaagaacatacggtttataacggtattaaagaatcttgacgttggaagcttaagacttgtcatggtaaaccctccttcactcctccctttaggaaaaaccaacctttgtttactgcaatggttctcaactacgagcgattttgccctcctggggacattctgaggcatttttgtttttcacagctgagggatgggagaggttactgtgctctagtgattagaggccaggggtgctgctaagcattctacagtgcacagtacagcaccctccacaaccctccagcagataattattcagccttaaatggcaatagtgcagaggttgagaggctccatctgctggtactgtctcttaccactcaggccattgccgcagtctttgcctttggattggggttattttacagtgtttcgactgctgatgctttacccataagtaactatctagctggatttggaacatgtaccctcagcctggtctctggcttcctggattcatgaccctcctagtccagacttctggttttgcaccctctctgttcactctgtacccacagatttctatatcttgacctttgttaaccacatacacctgccacccaacccctactctccaggtcctcctgccaccaccccactcctggtatcatttatctattactgcccatgaatctagagtaataatctcagaaaatatgatcattacataggttttatatatctaataaaagtgtggaactaaaggctagtatacagagcaatgaagaacaaattcactaattattttctttatataccttaagcaagtttcattgcttcttgggctaatacttttctttttttttttttttcattagtttggtgaccattggttgataaacttaccttgtgagctcacaaaatatgttttaattttagataccttcaaccccttatcattatctgcatagtaactgattcattcacaatgaaatcacctatgactgaaaaaactaccaactactattttttaaatttgtttttcagagtcagggtcgtactctgtcatctagactggagcgcagtaacgcaatcatactgatcataactcactgcagcctcgaacttctggggctcaagggatcctcctgtttcaacttcctgggtggctgagactacaggcacactccaccatgcccagctaattttatttgtttgtttgttctttagaaacatggtctcaccatgttgcccaggtttgtcttgaactcctgggctcaagtaattctcctgcctcagtttcccaagtctttgggattataggtgtaaaccactatgcccagctctaatctctttaattttttaaccataaaaacaattaaatttgtcaattttgtttccagctttgaaatttatataacgtatacacaatacgcatgtcaactttacttaaatgtgattaacatatatatatatatatatatatatatatagagagagagagagagagagagagagagagcaatgctgggaaaactaataagataggaaaattaattgcaggatatccatgtgctcatcccaaacctgacacctgtttataagaggaagattttatttaagatgaaaaactctatttatgtctatgaaaataattttaaaactatatttaaaaaattaatagaaaaaaagctaaaatattcccaatgttcttgacataaatagtaaaataatgagctatttgacctattaatatttgggacatctatctggtacaacataaaatgataaaccttataaaattgcaagaagtttgtatgccttaaaaatgagcttgcaaaatagtagacataaaacatgtataacaagtgttttgtagttagaactaggtaaacttaatccataggagttataagtttataaattataaactttactggaaatgttttgtggtcttaaatacagattttctttttgtattatatataacataaaagcatatagatgataaagtaaaaccctaagtcaagtttgagaattatatctcgggaacttcttgaatatttaacatatctcaatgtctagctaaaatgcatacattttatttctcaaatattgacagacatgttattaattcactttacttgagtacgtgaacatatttaggttacatgtattttaccttcttagatacagatagcactgagaaagtgtagctttgcataatcatgataaagaaaattctaaattcatattttgataataatttttaatatcttaaatgcatgccaaaatttttaaaacgaaacaaatcaagaaacttctcaaccacgtttcacttattttgacctccttatagtcttccaaacatgtaataaatattattgatatgaatatatctttcgtttattttcccaatcatgaatttctgccatttatttctgtctaaactatacacactcctgcaaggcagctttagttgggttttatattattattattattattattattattatttgacctttttatcttgatctcatcaatgaaaaaataagtttctggagaacagaaattattcctaatattccattgccctttcagaatctggaaaattctaaatatatagtaggtgtttattaatgtaaataaaaacgtaccacgaacctagactgaaactgctacagttggaatgtgtatctcctccaaaactcatgttgaaatttaattgccgttgtaacagtattaagaggtaagacctttaagagtgataggccatgacggctctagcctcatgggagggattggtgtcattataaaagggtgagttcagcctcttgccctttgccttccactttgtgatgtcttccaccatgtgatgatgtagcaggaagaccctcaccagatgccagcactttgatattgggctcctctgtctccaaaactgtgagccaatacatttctgttcattacgtattacctagtctggggtagtctgtagcagcacaaaacagattaagacagagagaatatttaaccaaagtttcaggtaaaaagtcagtttttcctagaaactcttaagtattgttaacacagctagacaagggtatagcactgctttttacgtatttatcaaaattttcaaaaattggctggtcacagtggctcacgcctgcaatcccagcactttgggatgctgaggtgggtggatcacaaggtcaggagtttgagaccagcctggcaatatggtgaaaccccgtctctactaaaaatacaaaaattggccaggcgtggtgataggcgcctgtagtcccagctactcgggatgttgaggcaggagaattgcttgaacccgagaggtggaggttgcagtgagccgagatcacaccattgcactccagtctgggtgacagagcgagactccatctcaaaaaaaaaaaaaaaaaattataaaattaacatttaaagttctcaaaaattaaaaattacttctctgacaaatgggcacaaaactttaaaattttacccaggcagtatttaaattttttcctggatttcacttttaaaaatcttagctctttaaaagcaaacaaaagaaagtactcacattatgtcttctgcatcctccctttacactgattttataagtttatctcatccattatcattcattatctttctatcagttgtcaaatatttgttatgtgcctactatgttcccaaggctgctacattgaaggtactgttcttgtaatagtcctgaagggcacatatcatataaaacagttggaaaacaatattagcaaataatcaagtataacattgatacagtcatagcacccaggaattcagaggcaaatgtgtatgaggaccagattgattgggacagttttcatgaagaatgtggcactttcagtgatctttaaagaatgaacaagggtagagaagttcacgtctggtgttgggtaagcaacatagagggagaatggcagttcagattggaaaaattgtaaaataaagtatgatgcttatatccagtttgtgaagccctgactgagaaattttgacactcttgtcaatgtattatgcaattgagcctaagagtaagtccttggttgagaaataggatagattctatatttaagaaggattaactcaattcacgacttgagagactggcctttcaacaacacccatgccatggattcatcatctgcttttattgagatagtagtgaacaaaggctaaagaaaagtcagtaaattgaccaaagtcacatagttgggtatgtctgagctcaaatcctttccactccgtaatgcttcttcccttagcaatcctgaaaacatggacagttgtttgaagctacttgtctgctaaaaaagccacatattatccatttgcattagtagggctagagctcctgaaaagctagagctcctccaatcatatggtatatccacatgtcctctttccttcttcttcttatctcctctctggtcatcagttttccaagaataataatgaagcacacagtgtcatgagctgctaaggttttctttcctcttgctatgtccgaataatgattggaagatagaagcttgaagaaggggtggtgaattcctgagaaaggtagcaattgtctaataatgaggtcaacagagacaaaagcatctatggtaaaggggaagaaatgctaggcttgttattataagaaatggtctcatcttgtcacagccaccttaacactgtgtggctttgcgcatgttgtttaacctttttctgcttcagttttgtcatgtgcaaacatactaatggaccaattccaaatataaggaatagtaatataaatgaaagttcactagatatgtacaccaagcatcataaatgtttaaatatccatgtttatttcttattacaattttaaaagtaagtagttcaacttttgtaatcatctttgaaaaatatataaaacttcttatcacagaagtaagataggtttatagtgaaaaacagataagcaaaaagaaaaaaatacaaactattttctgtcctataatctggagatgaattacattttgttgcttatccttctgatctttagaaatggaaaatgcaaacagccagaaattagtcttataacttgctatatgtcatttaacataaatcatgaacatttttcacatcattatgaattcttccataacttaattttaatagacccaaagtttactcaaaaccatactattgaacttaggaattatttctgtaaattatttctctatttgcttataaataataatttttaaaaatcatctttgtagttaaatattggcatcatcctcattttaaaaaatacttttctaaaagtggaatcactttttcaaaatatatgcaaaaccaagacacttttgctagtaattgtcaaattgtgcactgtgtttgcagcactgcagttgaatgtcatgtactatacaacttacagggattaccatccacagggacagaaatataaatgcccgagcctagcagtaagcaacctgagtttacattcccatgagtggtacatgagagtttatttttttcctacctttctcagtgggttacatcctactgttttgatgttagcacttttatacatgaaaaaaaggtaattaatgggtaacaacattcatttattttattactaatgtggtttaacatttttccagttatttatctaaatttcttacacaaaattgctgatcataacccttgtacatttttatttcatctttttcttattgatttataagaactctttgtatattaaggttattaatctttcaaatatatgttgcaagtggtttcccagtttgtcatttgcctttgtgatattcttttataaccaaaacagtgagaaaaggtagaaagataagattttaaaatatataaaaaagaaagaaggaaggaaggaaggaaggagaaaagggaagatgaaaggacgaaaagtccgaaggtttaaaaatagaaagaaaagaagaaaccctttttaatgaaagagtgaggttaaaccaaaaactcaaaaatgaccttgattttaagcctatggacttcgcctcacagaaaaccattttatttctaattagattgtttctagttctcctcttcagacattttattattattattttttatttgttattatactttaagttctagggtacagtgcacaatgtgcaggtttgttacataggtatacatgtgccatgttggtttgctgtacccgtcaacttgtcatttaccttaggtatttctcctaacgctatccctcccccagcccccccaccccccaacaggccccagtgtgtgatgttcccctccctgtgtccatgtattctcattgttcaactcccatttatgagtgagaacatgcagcatttggttttctgtccttgtgatgttttgctgagaatgatggttttcagcttcatccatgtccctgcaaaggacatgaactcatcctttttttggctgcatagtattccatggtgtatatgtgccatattttctttatccagtctattattgatggacatttgggttggttccaagtctttgctatggtgaatagtgctgcaataaacatacgtgtgcatgtgtcttcatagtagcatgatttataatcctttgggtatatacccagtagtggggtggctgggtcaaatggtatttctagttctagatccttgaggaatcgccacactgccttccacaatggttgaactaatttacactcccaccaacagtgtaaaagcgttcctatttctccacatcctctccagcgtctgttgtttcctgactttttaatgatcaccattctaactggcatgagatggtatctcattgtggtttcaatttgcatttctctgatgaccagcaatgatgagcatttttaaatatgtttcagacgctttgtatacaaagcaatctgcttcctgatttaccaaatgtggtaggcggaaaaatgtcccccacaaagatgtctacaatctaaaccccagaccctgtgaatatgttaggtggcattgcaaagggggaaataagattggtggtggagttagggttgcagttagctgaccacaagataggaatgttatttgggattgattctagaggtggggtcaatgtcatcaagagagttcttaaaattgaaagaggaaagcagaagagggaaggcagaaggagctgtgactgtggaagaatgttcagagaactgcaccattgctggctttgaagatggaggaagagggccttgagctaaggaacatgggcatctctagaagctggaaaagcgaggaaacagattctttcctggagcctccagaaaggaaagcagcctagctgatatgttgattttagtctagttcaacccatttgggacttccaatgtacagaattgtaagataataagtttgtgttgttagtagaaatatgttacaacagtaatagaaaactaatacgccagtcatctatgaataagtgaaagaaacacaagagaaacttcttactcagtctgaattgtacattttccccccaaatgatacattcaatgtagagaaaaactagagtaaaagaattcagtattttctttaattatgaatgtttacaagtacatggcacatttatgtacttttaatgtgcagatcacattgatgtttagaattctgcaagacaagctctctataatgtaacataaatgagttaactgccttcttaggaaataggtgctaaccatttccacttgatgggcctcaaaagctgcaaacacattttgccttcaatgaaaatccagtgaagtgttgctgtaaccaagcaacctgaatgcaggaacaagcagccggcatagacagaaagcaatctgtcccttccaacggaggggagtgtgcagtgagtgtagcaaatgctgataaccagcagaactcatgaagacctgggaacatgagccttggctaagcagagtttgatctcattaggaagttctggtaaaacagacacaactaaatgctagttggagaagggagggaggatgttgtagtcatctttatagagaccgctgcagggtgcttttgaaaggcctttcaaacattctgggtagactggttttggttctttagttgaaaacattgaggcaaatgcaggggaaaaaaaagtctttttaggaataatatatcaataaaataattcttaagaaggcacagaagtaagagtaaagacaaaaataaacaatagggaaactaaaatttctgcaaactatattccactttatgtatgaacctgacttttattgtcagctacatgtcttttatatatatatatatatatatgtgtgtattttttttattacactgtaagttctagggtacatgtgcacaaagtgcaggtttgttacatatgtatacatgtgccatgtcggtgtgctgcacccattaactcgtcatttacattaagtatatctcctaatgctatccttccccctgcctcccacccaatagcaggccccagtgtgtgatgttcccttcctgtgtccaagtgttctcattgttcaattcccacctatgagtgagaatatgcagtgtttgtttttttgtccttgcgatagtttgctgagaatgatggtttccagcttcatccatgtccctacaaaggacataaactcatccttttttatggctgcatagtattccatggtgtatatgtaccacattttcttaatccagtctatcattgttggacatttgggttggttccaagtctttgctattgtgagtagtgccgcaataaacatatgtgtgcgtgtgtctttatagcagcatgatttatattcctttgggtatatacccagtaatgggatggctggatcaaatggtctttctagttctagatccctgaggagtcgccacactgtcttccacaatggttgaactagtttacagtcccaccaacagtgtaaaagcgttcctatttctccacgtcgtctccagcacctgttgtttcctgactttttaatgatcaccatactaactggggtgagatgatatctcattgtggttttgatttgcatttctctgatggccattgatgatgatcattttttcatgtgtctgttggtcagccacatgtctttgaagtgttgtctgtctccctcacttgctggtcactccataatccactgcaataacgtgactgtctctgccttcctactgcaaccatccttgttgaggttattagaacatttttgatggcttgagcatgggaactgaaaccattgcgtatttgatcacatgaccctttagagctcttctcactttggactgggcactctttatcctggcgactgctctgccatcttttctttctgaccgtcatctgtgtccatcccagccctctctggtgtacttgcttgcacacgtccatctccagctgggagtctctcaggcgtcttcaactgaacatatccaaaattaaattcaaaatctgtttctccactcctcaatcctcctcttcctaaatcccatatctctgtaactgatgctataatgtgcccagttgggcaagccagaagcagcagcatcaggcggtgccttttatttattgcttgatttataaagtaattagatttgagtgctcattttggccaaggatcagttgaaggaaaaaaaaaagttcccttttttttaaaagaacaacaaaatttctcctggctttatcaatcaccttcaaaaagtagatttagcaatttgttagatgcagtgagtccaggtattcaacttaatggcaggagtcctactcagggaggactctcccttatcggacattctttgcctgaagtttctgctttgtcaagtcctacaagaagtcatgaggataacgacctcttccctactacgtagaagccctaaacaaagctttatttttgctaataatatttcttttttctgcaaatccaaattgttcctagaagcttttggtaatgaaatattaaaaagatgaggagtgcacaagaagcctgtggtaagaaattaagctctaaggaagagaacttggaagcatgtgaaataaaaccacagcaggattatcgtaattgttctccttgacagacctgcccatatgtacggatgttcctgaaaatttgacaagggaattttatgatctatttcaggtgtctgtccatttttttcccttgggagtggagaggatgccgtaatagctcataagggtaacattccccttcataacaccctccttttctcatgccacccacagacctccttgaggctagtctccattcatgctcatgtctcctagccaatctaggaatcctggccatggaccatgataatcttgccactcagctgcatggtagctgagtgacttcaagcacataagaaagcatacagtatcttatgaaaagcataactgttcctcaaacccagcaaccatgtggcttgggcacctcttaccacattagtgttagtgagacatcacaagttagttcagttgaaatattggacatctactcttttgaaaggttcttcttcaacaggccaatattggtgctttggaccagtggctctcaaacttcagtgtgcatgagtgtcacctggagggtcctttccccagagctttggatgcaatagatcttgagtgggacctgagaatttgcatttctaacaagcgttcagatgatagtggtgctgctggtccagagagtacactttgataattaccttaaataaagttctacggggttttctttgcttgtttttgtttatttcacttccccaaaagactgtattaattatggtggctctaggtaatggagtaagacaaatctgaagtcattccaaaacccatagcatacttccttttccaaagaagtgtggactatttgctgttgggaaatgacaggtacctgctcagaagacaagtataataattaaaacaaaaatcattcacattaactctgtctccaataaaagaaggtgaaatcaatgttatagagctcaaagtaggttagacatttccttatgaaggggattctgaagtatataaagctagcttttacccaaaacttgttattcatgagaaactagttggttttcacatatattttgtgatcaaaataagaacttcggtcatattcatgtgtttgtgtagaatgcaacagggtaatctaacacaggagatacagtgaacaaaaacagcgtctattatgaaattaacatcaaagaggtcccgtaagattaaatggagctttagcctctgtatggtctgtgcctgggaaggaaaggggatttttctggaattggcatttctgaacacacagaacaatgccgtctgattgattgctctctatttagaaatagtatttctatcactttggtagaaaccttttatttcatttttgtcctctaacaaagaagtatgatgcttggagaactgtttaaaagggctgcaactctgtgcccatgcttcatcagtctcctaactactttcaaactttgagtggcatgactccctacttccatagactatcacctttttttaatatttttttgttcctagttttgttagaaaaattcttgctagcaatttgttgcacaaatatgactcaagcaagcacattacatagaataatgttgaactaaagtagatttcattaatatgtaatggcacattaggtgctttgtagagcaaaaggactctgtgcttgattttaatacaaataattgcaaaatattaaggcatgtgctttataattttcagtaaatttgtctcataaaaagttatctttcaaaagatggtatgtcactcctctgctcaaagttgtttaatcactctacaatttttcaaaaaaagtttgaatgcttcaaccttgtatattagtcaggtttttgcagagaaaatgaacatatattaaaatacatggaaagaggtttatcatagcaaatggcccatatgattatgaaggctgttaagtcccaagatctgcagttggcaagtgtgagacccaggagagctcatggcatagtttcagtctgagttcaaaggcctgagaaccaatggaaccaaccgtgtagttgtagtctgaatgctggcaggcttcagacccaagaagaattaatgtttcagtttgaatctgaaggcaggaaaaaaaccccaatggccaactagtagaaaggcaatgaggccggaggagttccctcttactctccaggggtcagcctttgtgttcttgttagaccttcaactgattggatgaggctcactcacatcagggagggcagtctgctccgtacccattcaaattttaatctcattcagaaacactcacagacacacccagaataatgtttgaccaaatgtttgagcactctggaccagtcaccttgacacataaaattaaccatcactcctggcatggaaggtctgtattatctagccagaacagatcgggttagttgcaatttctcagataactcttcctttggccattcatagctagttttatttccttaaaaacatcttgatgattcacgtccacatgtttttacagatgtttttccctctgcttgagtgtgattacccttgtctttgtttgagttccccaataagcagatcctgaaacaaggactgaagtagaagtatgttggggcggcgggggtgtggcagggagatgatcccaggaaacaccagtagggaagtggggaagtgagacaagcaagagcagtaggcagtgaggttaagctctaagccagttaccactggacaactggggctcaatcccagtaggagtgaggagactcagggagatagtacagaacatgctttgaattaggccacttgggaagcaagggatctggggtacttatatgcaaattgtccatcatttgagaaaggctcaaccctaaagggtgttaattctctagtattacttgaatgggattcagcaagcagagagagccctcaggcaaagagacccaggagctggtggctcaaaggcaggctggcatgcactgaattgtcaaggaacaaggagttataggcaggacatccacatctaggcatctactgtagcctttctttttccctacataactttaactcactctttaagactcagctgaagtcttgcctcttctggaatgccttcatagaccttctctctgactgagctggctcttgtatatttcccaatacaacttctgtttacctccatcagataatctgttaccttcttctctgttgttttgcttttctatatcgtccactttgtgacctccttgagggaaaagattgctaacctgtatcttcgtaatgggtacacaaggtagagctcaagaaatggttatttgactagcaaaaatagttataaaaatgacattataatgtaatcactcaatgggttattcttgcccactgcacagataaaactaattcagtgagacagcagtattgcagtagagaaagagtttaatgcagggctagccaagcagaggacagaagtttattactcaaatcagtctcccaaaaagcttggaggctacgagttttatggacaacaggcaggggtctagggatagggtgctgctgattggttggggatgaaatcacaggagtgtggaaaactgtcctcatgcactaagtcagcctctggatacgggccacaggaccagttgagtaatgaggcaaaggtcccagtggagtcagtcagttgccagaatgcaaaagtctgaaaaacatctcagaagtccaaccttaggttctagaatagtgaagttatctattagagcaattgtagaggttacatgtcttgggacctctagaacaatggctggttattgtttaaatgtgcctacgtcttagtagaatccaggcttctctcataatcatgaccttggggcctttcgttagttttacaaaggcagcttcagtcctcaaacaaggaagggatagttttgagaagggctattatcattcttgcttttaggttaaactataaactaaattccttccaaagttggcttgggctatacccagaaatgaacaagaacatcttgtgaggttagaagcaagatggagtctgctgtgtcaaatttctttcattgttatactttttctatgtcagatttctctcattgtcacaatttttgcaaaggtagtctcagtaatagcaataatcagtatttattgaatgctcattctgtgtaagcacttgacatataatcctaaccctaagaagttgataattttattatccctatttttcagatgaagaaactgacatataggttatatgttacttggaggccaaaagataacttcccctttgccctctgaaagttcactaaaagtaagctgacaaaaggcaggttaatagcagaaaaatcatacaaaattattttaacatgcataagcatgggagaatcgcatgagaatgattatccactagctaaattgggcacagaagcttatctcttcttcttcataggggagtggacagatggggaaagtagacaattttttgaggagcaataaataattattagggagaatgaatggacccaggagacagaaattaacttgtaaattattctctttggaatttgaatgagcccaagaggcaggcattatcttgtgaaaaacatctgtccaggtgtggttacattctcagctttcttttctgcaatagataatgagatttcaggcagaggatggaagacaattgtgttccttttttggggctactgtttctagatagataagggaactgcagagaaaatcttcaccctgtgctttgggagagacaagggattgagagacggtagtgaggggaaggtccctcatatttcagggtgaaatattctggtattcttcttacccaagatttgcatagttatatgtggtttgtcctggaagtaaaccgaaccagtctgagtccagactctggacagactcttaaccactgtatgactaaatcagtgcgtgaatgaagtgaatgaatgaataataaccccaagcctgatccttccacacatgggagtcattctggggatgacgttatcaggacagtctatgtagttcaaatatcagcttcagtgttatgttctacatacaagaagacttccaagtagcttaactagaagtatcaatccttcctctgacactttttaatagcattgactaccatatgttggaatgtatttgcatgtcttggtttctttactactgacaagattcttaaaaaaaaaaacaaacaaacaaaacaaaaaaaactgcttaagtttctatccatcttggtgttttctacagccccaaacataaagccttgtacacaataggctaaccaatgagtgtttgccaggtgaataacggaaatataagtgacaagcaaagggatctttgactcttcctttatttttccccagaaactgtagagactcttttttatctctctctctgagattccagagagtctgttgtcatacagattttagatggctctgtaaaataaaattatatttaaagatgttaagttcagggaagaatctatgaagtttactttgtaacattttggtaatcatttggttagaaaattatatttctaagaaattggtattcttccttccaaaactgcattcatagaatgaattttaaaaattatgtagaaaatcatcagtgtttctaaaatatttccatggtaaaaaaattacttctttaaaagttaaccatagttatcaagaattgcctttctaaaacctcaaatgaaaggcattttctctttcctctgactaataaatctctaatcatcattaataattaataatcaattcttagaagaggggcagactgagtaaatttggctgggatgactaaattacaaagcacatatataggagaaagttgtaaatcttcactgacttcccattatttacaaagtatcatatagctaatatgtataaaacacatagaaaataatataaatttaattcagtggacatttattgattctagtatataaaatgaatggcattaagtgccaaggaatatacaggaacagaagacctggtctccatctttacagaatttatgatctggagaccgatgtttgaaagagagataaaataacaagtagactgtgtgattttattataataacagctaatatttagcacttaacaatgtttcagtagctgtcctagtgctttacgtggcattatctcatttaaaccttaggaaagctctatgtagtaggcattattattatcccactatacagctgatgaacctgaagctcaggaagatcaaggtaacttctccaagatcacatgcccaggggatggatggatggaggagccaggatgcaaacctaagcccatgtgtatttaaagtccataccaagcaggcagcaaaaataaggtacatcaaagagcacatgattcattcaaacctggggaaatcagaagctatggcacctaagcttgcacttgaaggatgaaggtgaatagagagggagaagggcattgctagcaggaccaaggcaggtagacgaggctgagggagaccttgagagatcagagaagagttaagtgttgccatccatgtgggtggtagcatgcatgtaacagaggaggtgaaactgagaaaagtgtttggaaccaggtatcattggccttgagtgttatcgggaagagtctagacttttctcattaggcagagggcagtcactgaactgttgtgaaccagatcagagctgtattttaagactgatttggcagtcacgtgtaaaaggagtgagatacaggagagagaaaaagagaggagcagttaggaaactgctaaaatagctaaggcaaatggcactgggagtctgaatttgtactgcaataatgtgaggagagaggaccaaacatagaaacaggagaagatttggcgctagctgatattttagtccatttgggctgctgtaacaaaatatcatagactcagtggcttacaaacaaaagaaatttatttctgacagttctggaggctggaagtccaagatcaaggtgctggcagattcggtgtctggtgaggtccctcttcctgtagagagccatcttcttcctgtgtccatgcatggaggaaggggtgagaggtctctcttaggtctcttttataaagacactaatcccatccacagggctcctttcttatgatctaatcaacttccaaaggcctcaccttctaatcaccatcaccttggaggttaagattaagcatatgaattttggggggatacagatattcagaacatagcactggttgtggggagcataaggagagagacgacaatgtgtcagaagttcaaaagagcaagcgtgtcatctatagtgcagaggaatcacatgtccttgtccagttaaaagggattatactgggagatgatgggagctaaatgggagtggtgcaattggtgggacacttgaaagcacatgagtgaaggctgggatttccaaatgcagcaaagcagcactttccatggtgtggtgcggggatttgacatgtgtcggtctatgaccaaataatgatgtccatacttctcagatacttgaagtgagcatgcagacctttaacaaagttagaacatgtggcatttaaagtctgtgatttttaattttgagcaattgaaatgactgaagtgaccatatataatttctataagtaaaacaaacgattgcatatacagttataaatataacaatttttaaaaggaaatgtaaactctaggctttaaattgtgcattaatgtgtatactttcttcttaacttagcatgataataataagacaacagaaatgcatgttttaacagtctgttttctactgatctgttatccctttctttgattttttttaataatccatctggaacattcttgtgtttcccactttcatataagtatttctttatgttttcctattttttaacagacgataataatgaagaagaagaggatgttgaaatgaaagaagattcaggtattaaattcatacttttattattagggggtaggtaggggtcattttgttgtttatgtacacttcatattttttcaacgaaagacaaaataagattaataaaatagaaatatatgctcagtgttataaaattaaaaagtagttgttctaacacttaaggctattgcagttgctgtatttaaggaataaatttgaccttgagtttcctgacagcgaaggtaaaaatggaacatgatgttgtggttaatacagttatataacgaatcacccccaaaacttagagtaagctgaaaacaaccacttcttacgctcatgagcatagcagagataacttaatcatcctgttcacaaggtttggagctcagcaggaagattcaacagctggaagctgggaccatctgaagattcactcacttgtctgtctagtgattgatctcaactgtcagctaaaatcttagctgggacaacttcctaaaacacttgttcatggccacctttatgtggcctgggcttcctcaaagcatggcggccagcttccaaaatgagcttctcctggaaaaagggagacactgtattctcaggcttagacattccattgcatcactccatgtaattcattctttggaatagtcacaagcctgccaaaattcaagaggaaatgaaaatgaactcaatctgttttggggagtggttctatagagcgtgtaagacctaaaatattgctgtggccatctttggaaaatacactttccacatactatattttgctctcattatcagaattgagatgcatgccaactcctcaacaaagcccacttgttatgaggaaaatctagtagttaaatgcacaggttatggcctaaggtagccattcagtgtgtctttgataataaaggcataaatcagtagacctgaattcacttgtagctctatcaattattgaccttaggcaaatgtcattttctataagctgagtttacaattctgggggcaataattcttaccatatagttttctttggaggattaaatcagataacatacctaaagtttcatacagtgcttggaccatagtaaagattcagtaaattattgcttttttctttctcattctaacagatattagaaggatatagagcttaagtctatgattaaaagctccttcttcctcattttggcagtcacagtgttctgaccatgaaagaggtatctcagaggccctgattttgtgttgcttctcatttgatgccagaattccctacaaatcactgacaggctcagtctgggcagctccatcagcagggagctctttaaattctgatgcatttgatctcaatacataaggtttgatcggtgtggtccttctctatgttaagttatatctctctccctccccggactgcccactatcttcaaggggaaataacaccagtttattttcttcataaaagttcattggaacaaggattatagcttctatctactcttctccagtccaaacatgtctgattcctaaggtttccttggacttccaaatgcaatggattcagagggcatgagaagcagaagcagaatctaaaagtcaggagcaggaataaaggaggtagaagaggaactgtagcagtggctgttggtgccctacttatgtctccttggtgcttgctgttattttatagcaccaacagctttccaaagaaagtccttatgactctctgctgagcgctttacttgtcctggcagcaaactcaaagcaccagagaattaatttctctggagcagacctcaaccaataacagacaggaattggttggttaatacccacatctgactcatgttctattctaatgctgtctagtagaaacataatgtgagcctcaaatgtgagcctaatgtataattttagattttctagtagccacattgaacaaagtgaaaggaagaacgtaagactaactttaacaatattttgtataacacaataatccaaaacattatcatttcaatgtataatcaatataaaaatagtcggatattttacattcttcttttttcatactaagactttgaaattggtgtgtgttttacatacacgttccagttcaaactagccacatttcaactacttgttggccatacgtggctagtggctacagtattggacaacactgtttggaggtccccgatagaactgagtcttggttgcccacagtggaatgtgctcatgaacacacccagtattggctgctttccttttcctgtctttcttccctactcctcttgtgatacttactaaaatcatctctcaaattaactgcttaaaactcaaacccttctatgtttacttctgagagaataagacctaagacaaggactttgcttgccttttataaaacatagagctcaaggtaaaatttaaattaaaatttccattcctatacccatgtagaatgtcttattgttaaaaagaaccatatgtttaaaaaagacttgaaattgtcactctgtcttgaattaactttcatgaagttaatcttaatgcttgccattctcatttatcctgctcacatgaaatgtccttggagtatcttttagctatgaggggtactgccctttcaagcacccggtataagggccttatctcgccatggatcatttgcctaagtgctgtaagtacacatttctaagcaaagagagttggcttctcaatgagatttagatagctatccaaaccactgaatgattttaaggaaatcattattaatgctaatgcagagtccccaagtttggagtcagcatttgaggttcagcggcattaattggatcaccatttctgattttagttccaccaggtttcctgggagttttgtcaccagcagctgcatgcagctgttcaagtcatattcaatggcccaaggatgctaagccacttgggcagaatgggcttgggagctactcccaatttcctatacctgagtgctgaaatcatggaggatttttgtgctgaatggttccagctggcctcaccagacattggtgtgcatgctggcttcattcagatctcacacttaagcatgtcagtctcgaagatgagtctaaaccagcctcccaaggcctttaactgctgcctttcccccgccctgcatcaattcttctcattcaaatagaaaagctggagggatttttacaaatgcaaccgacactaatgaagggctacttgagtgaatcaactggccaagacatgctagtgaatgatagtaaataacaacttgaatacctaaacccactggggtgcttgtaaattaactctctgggtaagaagagccccagtgtgaagagtttgcagatttctatggtataaacacaaataccatggtctttttcaagcttccaaagcatgaggtcaatgaataggagagctagggagagatggtacaattagctcgtgtgagctggctcaagtcagccgcagcacagctctgctgagccagactttaattgggcatgtactttgtgccaataacgtgacatgcatgaactcatttaataaacacagcaattctacaaggcaggaactgttattattgaggcttaaaagggattagttccttgcttaaatagcagagccagaatttgaacctgagtttgcctgaccccaaaattcatgtcctttacttttttgctcctgtctccagacttttatagtaagtagaggcaggagcatttcagatggtatcagacatggtcatctgcaaggggaggctctactcccatgggaggtagaagaagcagactggcctaaatgcctagaattccttgtaagtcctttaatcatcttccttaatccttaattccttaatggcaaatgttttcccatgtcctttcatttccatgactatgcactgttgaaattagccccagtctgagccagcagggacagaaaattatcaaccacctatggaaactcaaccacatcacagctggatgcacagttgagtccctcaggggacaaagccatgctcctggcaaatctccaggtttccaccctctgccagacacagggcaagctagaaaacatgatacattgtcaaggagaagcatgggggtgcttttgaagagaagcagaagcaactctcttcttcactccctcaggccaagagggaaagttgttcctcccaagccacaagtagaaacttgggcacagaggccatatgtatctgtgactttcatttgcatgccccaaaacacttcacctgtggtatcatgaaatgatacaatactgtttcacagaacatgtttcatgttcatattcaacatgtaagcatgcccactgacccaaggagtgctctacaactttttcaaaaataaaatattagtactttagggggtgcttagatatttcaaaatgtggcacatggaagtctttttaaatagtacccactccccaggaattcccattctggtggaaaatgaagacctagaaatgtaactcacaaaaatgcaaaaagtgatttggagaaatgctggtttggagttgaattttcagcattggaaactctcttcttgatcccagttgcagacgacacattgcagtgacatagaagggttagatttttctcccagtgaggttgcaaatgtccctttgcccattgtatgaatccctttgagcccagtatttgcactcggtgagctgctccaagcatctcatttctgtttttgctgaacccattccaagggtcaacatccatcttgcacctggtgacagaagtttgggggagttgctaatgtagtcattggcaaaatttttcaccctggctgtggtaataaccttagatgtgactgacttgcaaccacagaaaacctagcctagtgcccaaagctttgcagtttataatgccaaagtttttaatagcacatctatcaaatgtggggtttttttttgttctgttccttttttaataaatgggaaatgagaaatgagtcgccatagctctgtaatgtaattttagaatcctggcacgaaggcgacagctgctaagagagaattaggcagggtccccattatatcttggccttaaagaaagggctggggaagtgaaaataaaatagaatttgaaatgaaattctcaaggcactgctaggcaccagggatacaagagggattaggaaagacaagtgcccttttctcatggaatttatgttcttggggatgaggtgaggaaggagacatacaataaagggatacaccagagagtgagataatttcacatacaagtgatgtgtttgagagagatttcctttctggtgagcctttagattaggcagtcagggaagatcttctagggagttgaatttgatctgagattcaaagggtgagaagggagcagacatatgaatatgtgtgttggaggagtgggggtgagaacagcaggtgcaaaggttctgaggcaggaaccagcctagcagtgattgaggaacacaaagggaaaggaaactgacaaagctagagccaaacacaagagggaggtgaggctagtgtggtaagcggggccccaatgacatgctgtgctaggcctggaattggatttggatcttattctaagcaatggtttttaaacaggtgagcaatgtgatctggtttatgtttcaaaagctcacactggctgctgtgttgaggatagagtgtagagagtaaagagtagaagcagggagattagaaggctagagggttatgagatgctggtctgggctactgtggtgattccaaaggttgaacacagtagatgaatatgaaatctattttagaatggagctgatagggcttatgatagaacttacgattgcttcaactggaaaagtaaatgaagaaaaatattgagaatgacatctcagtttggagtttaaatttctgggtagatagtaataccattccttgagatgtgcaatactgtggaaagaacatgcttataaacatcaagtatatgattctgtctgatttcaaatttgaaatgcctgatgaggtcctttacaaaaaaattgaaagggcctgatgggagttgagtgcaggaaaggaaattattagtgctgtgaagtgtggggcatagttaagtaccagccctgaagggacaatgggaaggaggtggctacgggagccaagaaacttagagggccacatggagaaggccaactctaagatctgtaaccttcgattgagggatacaaccagctcatgaaaaccaccaggtgcctagaaagtaaatgccctgagctccccactggctacatgaaccagggagttcattcatgcaatccagaaaattcagcctcccagagcacagcaggggtggtgaaggtggagagtggatctagaggggcaaacagatatccattcctaaatcccagacaagatgccacgtaggctgttgaagatgtaagtcatgagctcaataggaagaccagggctaaatacataaattaacacctaatgaagtgttctatatccaaatgaaataaactcggagatgctttcctgacactgtcctcagactttaatttatttgcccccaaggatagacttagagggacattgaggaaaataggaagcacagtaatttaactgggacatacagaagttgtttagaatctggattactaaaaacagtttgttaaatagaagcagggtaatttctagccccattcctttctccattcctctagccctgcgttcaggactgagtaagatgaaattgcacaatgacaattgtcaattaatctatgaagattgaaatcgaacactcttggaggaaaaaatattaacagggttcccttatggagaatttctaaatttataaaagcacatgtgtaagattttacatttgtgtgaatcactaatgttatctacaaaaatgttttagcttaagccttaagtttaagtctatgtaggttggagaaccacaagtccttgccagaatttcgctcagccatgatgacagatgaaactgcaattaagattcagcgtgtgtgtaggtttactaagaagaaaacatttttaaatttcacataattttgaaccctactggtaaatatttaaatgagaatattaaatcttcgtgattccagaggggttagagccaaaaggcctctctccaccctacaaaaagagcaaagcaaagaagccagaatgttcgaaagactctagcgagggtaagtcctgtccctccttcctttagaaaattatgccatgaaaagaaacatatttaatttttaaattatgtgtacaaacacactcatgttcagatattcctaagggttaaaatatcacagagaaattcttttatccctttctaatatgtttgaagatgaagaatcagactcaagtttattttgttaaggtaaaacccaaattttaaaagtccattttgtcagtatgttgtattttccatgtctgcaaagcaaaaaattgtaggtagtgcttaccagttacatgttccaaaattgtgcaaaagtgaaggtcaagatttgcatgtgatgaccagctttgcagctattgtcttactggggaaattgtttttctgataaatacattctgagtctttccagattcggacctcaacaacagatgctggaaatggttcctgtctttagcattgtctttcattttctaagatcctacatacctttgcatttttgcattgaatgggcaggtcccactggactcagttttatgaataaatgacacggtctctcttttacacactagtacaacatacaattcattcaaattttcttttgaaatgttgatgagatgttcttttcatgtgaacctcaaacctaagagtagtacaaacttttacacttgatcttagcccaaagacccagaagcgatagagcagtacaaaattttaaagggagcatatttacgctttgtctttcttgcctggatccccacctcctccactgggaaatgaagagtgtaataatactgatggtgtcaggttgggtcttgagggaagaagatgccaagatggaagcagaagtgcaggataaaggtgagagaaatgggcaatggagcaggagcagctgaaaggagagaagaaaagaaggaggctcagctaggaagtgcctcagtctgcagtgcagtctggaagtctggaggagtcctgcactgggcaggaatagctgggctctagggtctcgctttcccatgctcagtcactggctgcaagtagtttggcaagaaagtggccggcctcagcaggaacatgatgccacaggggttctcaacagtgtggttgctgggtgctgtcagcttacttctctcctagcagcaggtctcacttgaaaagaactcttgagctgctcacatgcaggactgcacagtatccctgttgagtgccggggcttccggtgctaagtaatgacgctgctttttcaccttcctgggagttcagaaccaatcgagaagccaaagctgaaagaaaggtggaaatcaaagcattagcttgaatactaacatgatgaggccagagcatctggctgccctgctcctagacaggcttcctaaccctgaatttcagctctaaataggaaagctttaatcactgtcccctcacaggcgagtgcaggtgtcctcagcttcctagaccaagactgccctgatcagcttgttataggatgagcagaccaggaacacgccttctctgtaggcaggtgggtctgagagagacacaagatggaactgtttccttctcccaggcttactgtaagaaaggagaggtgcagaaaggcacagaaacagatgtgacccctcctctacacaaggagcaaaggaggaatatttcctactgacaatgaagagtagaaatagcatgtgtactggcctagcactggcctggccttctgtcagtgatggctgttgttatcaatatgatgatcatggccatcgtagattatgcactgccctaattcagtgaaatgtgcttgaaagtttaaaatcgttcagaggagaacacttagaaccaggaaaaaggccagctgcaataattcacccaagatgttaagctttgttactgcctggttgggagagtagctggggcttccaaatctcctgttgtagttcggtcattttctagaccatctcttaaggccacacttgggtaatgagctggggcaaagcaatactcacctttcccctagagaaactctacctcaccaaatgattcccatcacatccataacctatgtcaaaagttgttttccagaacctgagcctgttgtcatttctgagcctcatataacagctattaagctgtagcagttcttccgcctttaattaaagaagggaattcttccaagttactccttccaatgtgtgaaaacttcatttacttcctaaatcagttgctttgtttaggaacatcattcccgaatcctaatatgactcaataatacagcttcacctcctgtaattatgtggtctaacaatctgctctgaatcataaagatgaaaatgtggtaactggatttgctagcagggacattctgtctgtggtgaaatgtgaatgtgaggcactctccagaaacataggaattgttcatttgttcctaagagggcttcaaagacaaataaaaagtaaagatagctgggcaaggagtgagaaagggagcgccatccggcaggcagcggtggatgattccatgatatgctgttgtgctgaaaccctcccaactttagaggggatgacaccaggttcgagaggctgaagaagagccccagaatcactgaaagagacatggggttttcctgggggctttcatacaggagagagggcctggtggcggcagcctgggcaggaggaccacagccgcttataaaaaacatgcaatggcaacctttacttaccccaagacaaagggcctccatcccttgtacagcctgagttccacaggatgggccgggggctcagatgttccctgtagataaggaatcaatctccgggttgccactcctggattctagttgagaactttgaaccgcattgaggtgcatccaccacatggttcattctcaggatatggttaagtgattgctatcagctgggtttaccacacatacggcacttattacttatcagagtttctattttgacaaaataacctatgtctctgaattcatgcattgtactcttgcatgtgttccatttcctgttatgatacaaagagttacaatcattctttcctagtggatatgcaaatgaaatctggtatcactggaagagggacaaattttaatgctgatcattactctcctctctagatcttcttcccagcttagagttatcaatgtttttttagcttggtcatttcatatttttttagaaagagaagctcctggtatttttatttatagatctctcagcttaatgccccaacacttggccccatctctcttttctccttctttagggttccctggcccacttcccaccctcacaggtactactgatttccaccttttaactgataatgcacattttcagaaagggttgtagaaaacaaactcacctagattttccagcatatatagtcataataactgtatttagattcagaagaaaaatttcaagaacatatggtcaaattttctcattctacagaatttttttaaagtacagactgcaaatgcttctttaacttgcccaagtccacgcagtttgttaatgtcacaatcttttttttttttttctagaaaaaacacagcttctgtaatcttttctctttctctttcctggaaattagaacaaattttttgaaggaagaaatattgtcaacattataaccttgagtgaagcattattactttagtaaatatctcgctaagatactgaacatcaaaattaaaaatcaaacaacttctaaatgtatttatttgcatttttatgctgtgtacttttgaatatagtgattttattatttttagtaaaatttcatgaactgctgtgtactttggtttcacacactcaacaccataccaataatgaaattattagtaatttcaagttactaattgattggctgtcatgtgctataaatgataatgccatctgtgaaccagcaaggcatagacagaattgtttggaaaaaagcctgattagtaccagttgcattaattctaactccccataatttagacctttttttttcttacaaaaagttgaaagaatattattgtagaaaacttagcacctttaataaagcatacttttctcacacttcttcctttgtctttcagaagtaaattatctacaggttcctttagtgaaagtctctcaggccttatttgtctgaaaatggtattattttgcattattttcttaaagcagtattggtgggtaaaaatttgagattgatggttattttcttgcaacattttgaagttttcctgtagttgttaaggaatatttccgtttgttttttgcttcttttaagcttatctgtttttcctttctgtctgttttgacaatctactcattaccttttgtgttccatagtatcactatgatgtgcctaggtatagattcatttttatatatccttcttagaatttgctgtacttcttggatctcggaatgggcatctttcattagttctgaaaaattctcacgtatcactgcaccaaatataacttctaatctattactttctattctttctttctctgttcttcatgacttttaacccatatcgcattttgtcctctgtatctcttctctctctgatgccttccggttaatttttttcaagtctgtcatttaacttgctaattttctattcaactttatttaatctgatgtttaactcttcactgtatttctaatatagttttcttttttgataggttttatttggttccttttcaaatatacatggccattttttatttaattaacacataaaatacctttaataatctgcatcataaatttaatatctctagtctgtacaagtctgattctgcagtttattgattctgcaaacttctgcacttggttatttcctcgtgtattttgcctttttgatgatcatgttccttggatttttacttatggaagcttttttgatgttgctttaagagctcatttatttacacttggttttctaagatacctgaagatattaccttagcaataccttaaagtacatatttggcttagagttttgtttttattttgttggctaatggtccttaaacccatgttagtccatgtataagatgaggaaatctcaacagagacctttttttcccttttttctcacgaccaatgctaaaactgacataggcaaatctcccactatatttatgaccctagcatgggcccctccatgcctcacacgtgtggctcattcaaatccaagctctagctagtggttctcaaagagtgttcttgaatctgcatccatcagcttcacctggaagctcatgcctataatcccagcactttgggagcccgaggcgggtggatcacttgaggtcaggagttccagaccaacctggccaacatggtgaaacccccgtctctactaaaaatacaaaaattagctgggagtggtgacatgtgcctgtaatcccagttactaaggaggctgaggcatcagaattgcttgaacctgggaggcggaggttgcagtgagctgaaatcaagccactgcactccagcctgggccacagagcaagactcagtctaaaaaaaaaaaaaaaaaaaaacaaattctaggttcacgtcccagaccttctgaatcagaaacctgaagtggggtcctgtaatctgtgttctcaaaagctcttcatctgaagatgcacgctcaaacttgagaactgttgttcttgagtctaggttacctggggttggcagatgcctcaaagcaaatactgatttcagtgcctgcttagaactcttgatcctggcactttatcatttcggtttcaagaatttcccttacaaaagcaccagctcagccatgtattcaagaagtagatagatagatgcatacatatatatgtaaatatatatagatagcacatacctactatatatatatatgcacacacacatatagtatgtatatgtgtataccttatatgtatatatgtatacacatacctatatgtgtgtgtgcatatatatatgtgtgtaggtatgtgctatctattgtatgtatgtatatatatgtacacatgtatgtatatacatgcatatatgtgtgtgcacatatatatctgtaggtgtgtgctatctatatgtatgtatatatgtatgtatgcacatacaaatatatgggtgtatatatatctgtaggtatgtgctatgtatatgtatgtatgcatctatttacttatctaatcacacagacatatatgtatatatgtatatgtgtgtatatgtacacacgtgtatatatgtatctttacatacatacagatatatacacatatgtgtgtacatatatacatatatacatatacatgtatatctatacacatacatacatttctaatacatagcctggaaagatacatatcaagttgacctcagaaattatcttggaggagtgaagaaggagcacagttgggttttggagagtttaatattgcactttctaaatttatgtgtaattgaatatgcatacacacatataatgagttattttataaaacaaacacatattttcattaaacaagaactaaatggactatatgttgctaagttcagtagcatgtttcaaacagtaattttctacatacctgagtctccaaagccttcagtggcttttggtaacaaatggcactttccatcatatttttacagaaagcactagcactttgactcttgctccacaattgcctttacatagaatattcagtaggcatacgtgggatgctcattcatcaggaaactgaacccttgcaattctaaatcaagcaaacctatattgcactttaaaatattaatgatgtcttttgtcagatgaaattatatgtggaaacattttggaaactagaaagcactatgccagtttgagggatctaatgataatattaaagttattattattattattttactaaaataaatttttctgaatacatgaaccatttatggaacgtagcttgtatttcccgagaggcagaattttctctctgccccattattttctatgcatattaaagtatcgtgtgacatgctgttttgtgagtggctggacagaagggacattctatctttcagaatgccatgcagcagttcatgcattatattcataagcacgatttttaatttaatttttttgacaagtgcagtgaagggtaaaatcaggcagtcataatttttactttgccatcactcaaatgagcttagtgattgaccagcttttaacaaaataaggatccaggaaaagcagctttcccctgaagaaaagctttgttttatcctctagactttaaaatatcaagaatttaagcaaaatgtgtaaatttccatggtgaaaaatcagaatacaataaatgcctataccaccattttgctttaatcatatttttcttatattctgcttgattccaggccattctgaactatccaccaccacaaagtagtagaaggacccagtggtctattttcatttgtactggtgctccccatgcttacccattaaacagaccacagagtcctgtttcagagtcagctctaggactttaaatgggacttagagaatgtgagtattaaggcattttccattgtgagaagggctgaatctaccaaggcagagaaaccacaggttctgtttgactgggaacgatcccaatttatgcatgttgccattggcatttgttagcaatgttccctttcactcttggaggtaacccaagtttggtgataacatatatggaccctcatacccatagagaaacagttcagtatgagtatggacagaactctcaattgtccatgttctgcttcctacttgggcagtttttctaacctaagactcagtttcttcatacattaaatggacagaagggaaactgatcttgcaggactgcagggcaatttaaataagatgatttatggaaaacaccgggcacattgagtagacagaagagctggtcagtgagtatattgaatttgaaacaagaagagctccctcccaccaaagactcccctaccttgcttattaatgcttgaaattccttttaatgtgaacaaaatacttttgcaagcagagatacatttttaaatgcattgcttgcatcgcacatctagctgggtttgtctctctcctttttcccttaggttcactcagcacactctgcatgcctccccaccccagcccccagttgcactaattccagtcccaaagggactttcttccagtctgtcttcatcttcctgatctctattccccttatcttcaagtccagattcccaagaaactacagaaggtccaccatttacaatggtttgatttaggattttttgacttgatggtgtgaaagcaataggcattcagtagaaatctttggttttgaattttgatgttctcctggactctcgatgtgatagtctttcatgatgctgtgcagtgagccacagcccccagtcagccgcaccatcacgacggtaaacaactgataccgcactctagagtggcctgtgttgtcagcagtttttggatattgttttgtgttttcacatttcatcatgtctacaaaatgcccatctgtgcaagttaggtgtattaaatgcatttttgcttacagtattttcaacctacaatgggtttatcaggacatagccccatcttaagtcaaggagcatcagcagcctatctccaatatttacacaaccacacatctcaaccatttctcaatctctacttaactgtctctaaaactttaaggagggtaccagattaggtcaggggcatgaggaaagaggtggtctctagttatcggccctcagttcagagcttgccactgagacagtcattgtttggtcctcatggtcccttgagatctgttgactctcagctatttctgtaagattctgggaccaagaatctctcttctgaggctgggctattcttactgcctgtagtcttctttccctgataagtgtttctcaaaatatggccaatggaaccctgggggaggtcccccaaagcccttccagcgatccacaaggtcaaaattagttttgcatggagctgtgctcccagaagtctccactcacatggaattcagtgtgcatgaggtcctctatagttgtgcaaaatgatgctactgcagaaacatccactgcatcctccaaccacatcagcatagctgcccaccatccagtttctccaagcactcattccacatacttttgttaatgcctaccatttgacggtgtaggtattgttctaagccctgaacacaatataatatataatatatgtattaatatattataagcccctgctttcttggggcttatattctatatataaaatagaggcctctactctcttggggcttttattctagggtatgtggcattggggattggcagataaaaaatggatacaatgtttaataaattatttatctattgctgcctgaaaatttatcctaaagcttcaaccaacgataagcaattattatctcggagtttctgtcagtcaggaattggacagtagcatatcttgaggttctgggccaccatatctcatgctaatgtgtgacagtttaggtcacaaaagatggcttctaccttgcgccctctcggatcacttgctctggggtaaggcagccgccatgtatgaggaccccagctctgtgaaaaggttctcatggcaaggagctgaggccccctgctggcagccggcgccaagatataagtcatgtgagtgaaccgtcttggagtcagatcctccagtcccaagaaagcccccagatgactgcagacgtagctgacattgtgacaacaacttcatgggagacgtcatgccaagagccatggagaaaaatcaagcaggggaggagctaggaaatgcccaagtgtgtatgagtgtgggagtgagcctgtgtgtgtggtgggggaaattaggagacagctgggttgggttttaaaatatgttagatctctctgattattaagtttctatttgagaagaaacctgaaaagcataaaggggtaagccaggcagctctctgggaaaagagtgttccagtagaggaaacagtaagtgggccgggtgcggtgtctcacgcctgtattccaagccctttgagaggccgaggcgggcagatcactcgaggtcaggagttcgaggctaaaaatacaaatactagccagacgtagtggcgcacgcctgtaattccggctacttcagaggctgaggcaggagaatcgctggaacccgggagacggaggttgcagtgagccgagatcgtggcagagtgagactgtctcaaaaaaagaaacaacaacagcggaaacacaaaatgctaaagccccaatgatcgaggcgtctgacttaccctaataaaaagcaagaaggtccatgtgacagcagcaacagagagtgaaggggaggagagtaactggagaggtcactggaggcctatcctggagaggggtgggttccgcactagagtgtgcatgagaatcaccagagggtgtgtcaaacccagatttcagggtctcacccccaaagtctctgattcagtaggtttgggggtggggctgagaatcttcacgtccaataatcttccaggtgatgccctacgatggagattatatcttgagaatcactgccttgggcattgttggccactgtaagaactttgactgcttctctcagtgaaatgggaagagagcattttaagcagagataggacgtgctctaacttatattttaaaagaaatcttctggttattgtgttgagaatagactgggctaagggaagaaacaggaaagagtttattggagcaagggatactaatggcttgatccaagtagcagcgaaaggcaggaatgataattggtcacttttggacacgttaaaggtaaagccaacagaattcacagacatgttgaatgtggcatgtgagagaaagagaggaggcatagatgggtgttttcattctctccgccactactgaatccagaatagaagttgtaccctggttatgcttaattcaaacattgcaggaaaaacagttcttcactattcatacagtcttcttgtccatcatgtcttcttgctctcctcaccccgggaaggccatagtagcgcaccccgaggccaaagttccttgttttacatttttaatttgtgtttgtttgtttttttagagacagggtctcactatgttgctgaggctggtctcgaacttctgaactcaagcgaccctccagcctcggcctcccaaagtgctgggattacaggcgtgagcaaccgtgcccagcccaaattttccaattaagcaaaagcaaaattttcaggcacaaagaaaaatctcctaaatatcaaaaagagtaaaagcacaaaaatattgacaaacaagataaactgagtaaaaagattattttatgtgatttagatagtatgatttcactatgtttctccccataaaaggtgtttttttattgtttttgtcttgttgcttttcaataagaaacttcccagttaaggaatgatcatgtaattgctgtcatttatgattgccaagctcaagaagacagtaagaaagaaagaaagaggccaggcgcggtggctcacgcctgtaatcccagcactttgggaggccgaggtggccagatcacgaggtcaggagatcgagaccatcctggctaacctgtctctactaaaaattcaaaaaattagccgggcgtggtggctggtgcctgtagtcccagctactcgggaggctgaggcaggagaatgatgtgaagctgggaggcggagcttgcagtgagccacgatcgcagcactgcactccagcctgcgcgaaagagagagactctgtctcaaaaaaaaaaaaaaaaaaaaaaaagaaggaagaaagggaggaaagaggtgggggagagggagaaaaaggaaaatagttgcaagctaatggaaagacccctgaactaggaatcagatccctgaattctattttcatcccttaggtgtacgatcatattctttacctcatgtctctcaggtccatttagatatcaaattctgtaattctacaaaccatcatattcatgaaaattgattctttatgagctcttttcttcatgctcagtaaatatttccatccttaattcaaagcacagaatcatggcttttaatggccaagtgggcctctgagaacatctagggcaacactctcgtttcacagatgaggaaactttcttttaaaactcctctgaaattgtctagaggactcatgaaaggtgatactaagttcactattaaaaaactaaaggaaaagatcagtttatcagggcatagacagtggatctttttatagtaactttaaaggtacctttctttaaatgttatagatgtctgtgagtaatttagactatgtgtttaacaatttgtctattttgatttcctaaaccaaggatgaagaatgcatcagtcagatgtgtttgcctttgttttgttgaaaactcagtccccgggtttatagaactaaagcattagagtgattgttttcaatgttgacaccatgccaataggacatttgaggacttataatattaggtactaatttttcaacagagaaagggtttattttgtcgttaaggagaggtattgctatttgaacagtgttgaattttcatgttacgattttgtagttgtatttcaaaatttcagttttctaatgtaacaaagttgtgctttcctgctataccagagagagccttaaaactgtccacctacactagaatttcctggattcacgccacactctcctaatgccttgctcaagtgtgcctgttctctcctacctcttgtcactctggagccatcagagacagtcttaggaaatgatttcatctccagggatcaccatgcctgaggaatgacatgcagaaacccagggtactgtattctccgtagacagaaaatgctagcagaaccacttgaatcatttctcaattctccatcctgagaattccccactggcttctaacaatctttgctgctggcagaaggaaagtagatatggggtttgagaggaaaggggcagagggaaggggagactggctgtagaatgtggagcgaaagtggaatgtttttgctgagtgcttagtgaacagttgcaaactgccacccttgggagaacctctcattcagccacttatggtgtatccaaaaacgcagattcctgcacctagcccaacccttcaccaaatcagaaagctgcatgctaactagatgcaatgcatctttggagcaccatttcttttgcctttgtttcttattttaaacaatctcaaacttacagcaaatttgcaagtacagtaaaaataacctttttttcctgaaccatttgggaataagttgccaatctactgtttctatccccaaacatttaactgagcattttctacaaattgggcattcatcctgcatgagcacaataaaaagatcaaaattagaacatgaatatggatatatcactactatctaattttcagatctcatttaagtttcaccagttttccaatgatgctccttgtaacaaaaaaaaaaaacgctttcaaactcaaatttctcattttgctgccacatctctttattctcctccagtctggaacagtttcccaatcttaatttgactttactgcccttgacacttttgaagattgcaggtcagttatctactcgaatgtttccaatttggattggtctgatgttttctcatggctggattcaagtgatgcatctttgaagaactatcacagaagtgatactgtgttcttctcatggcaggctatgaagggcccattatctcaatttgtcccattattgacaatattcactcgctttgattacttgattaaggtggtgtctcagaggctcctcaactacacagctgctttttcctctgtttgtaattgatgagtaccccttgtgggaaggcacaatgaaactaggtaaatggcccattcctcattaaactttcaatttattcatttgtgtacttatttatatcctcgtggactcatcatttcccattctattcaatgggttgtaataacgccttagccttggtacccaccaattcttcaaggaggtttggtttcttttagtagagaagcgtatttggaaactagatctgagtattaagtgtgtggatcacaatttgagatatgttatttaaaacagaacgatcagattatcttgatggttcaatgtggggaaccagctcacaagatcagtcaatcacatcttcctgatgaattcatccaattgccagaatggttttcttatagaccttccattatagctgtggccaagagatcaaattgtccaactttggttaagtttggcagagtacagcccaatgaggatggggagagcatggaaatctgtttggtgtttagggtttctaaaagtgttaactcaatcctgttgtcaaattttgcttgtccattatataacaccaaatcaactaattagcaaagggttaatattacatatgtaggcatgcccttgaattgtttatgcacctttttttgttctctttttattgtaagtgttaaaatacacatgagacaaaggtcacatttctacgctgatgacacggtgtgccgtgagtgtggacagtcattttgctaattcttctcattggtggttccgctagatggatgatttccctgaattagccatcataactgccatctgttcctgtgcatagatacagagatctaaagagtagaggtcaggaagaattttaaaaagggctgtgtgctcagttgcctctgtttgtctctctagaacattctctagactgctttttgcctgagacctaaggggctgcattgactggactccctcaccctcaagctttgggttggttaactaatatttctcaattttattttcatgactacactccctaaggaggcttttttagacattctttttctaattgtctccacctgaccatgaaattttaataccataaatatattgcatatctatttatgaactgtatcttttggagggtacagaccattataatagctaagagttttttgctgtgttttttgtttttttcctttttgccctgccaagaacaaatgtttgcttcccattgagaaggcatgcgctagaccagtggaagtcatttaagggagattggagaatggggggaaaagtactaaggacaaaaagacatttattctctttgacccttgctgccagacagaaatgacttcacccaaggacacagcacttgcgggtggccttctccacctccagctattgcttggtttcaggtgaccactccctttctcttctcaggcctatgggtggtaacagctcccatccactgctagtcttagacatctttactttccttgattgattcccttgactctgcccacatcttttaaaatatcccatattaaactttttacacccctttgaatgtgtcctgcttcctgctgggaccatgactagtctcttctagttggaatccatatcaccttctgtgatgtagtctccaagtcaggcagtctcatttcaactacagtctttctttatgcttctctttttcctttctggactcttacctttcttttatttcttactcagcaacagtgtctgcccattaaaatgcacctttgcggtggtggtttggttttctttatctctcttatttcttcccttcctgttgcattttcactggcattgcatgggatttttgtttggatactaagccaagcatcttatacccttgcatgcttgacatttctcttgcttagctttccaaacacccaagtcaccctgacaggctcttgaatactttcttcccacaagttagtgatcttagctggcaagagcagacaatggcttgttccaggtactagggatgtataaaacttgttggcttaaaataatgacatttattttgctcacacatctgcaagcttggcagggctcgacagggatagttgtctctgctctactcagcattggctggggtggctcagaaattgggaggctgaaatatccagggcttctcttactcacttgtctgagccctaagcttagaagactcaaacaactgaaagctggaagaactggagctctttgggcatctctctagcttgatgaagtctctccatgtaatctaccagcatggggggcttagggcagtcttacttgttacacattgacccagagctcccatagtgattatgtcaagagaaagagcttgttattcagtgttatttttaccacattctattggttgaggttaacaagtccccaggattaaggggagagaacttagaccctgccttttgaaggagaatgtcaatgtcacattgtatatttttaaaaagtggaatgagatatgtataggtacagtcatttttggaaaaacaatctgatctgcttcagtatcatacacataagtacataatacaatttttttttttttttttttttttttttgagacggagtctctctctgtcgcccaggctggagtgcagtggcgggatctcggctcactgcaagctccgcctcccgggttcacaccattctcctgcctcagcctcccaagtagctgggactacaggcgcccgccactgcgcccggctaattttttgtatttttagtagagacggggtttcaccgttttagccgggatggtctcgatctcctgacctcgtgatccgcccgcctcagcctcccaaagtgctgggattataggcgtgagccaccgcgcccggccgtaatacaatttttgagaccttgtggaagtcctttggggttcagaagaaaatactggaaattactaatggaaaacaagcagagataggaagatgtcagtaaggaggtcttaatacctactttgtataataatggggctcaggatttctgagtgagaagatcaagagtaggtacagtcaaggaaataagaactctggattcctgtctatgcagattgagtcaagcaagtctctgatctctatcaaatgaagaattaatcttatgattttgatgttctttctcaaaacccctggttctgttacgccatcatcaactcacttttctgtttcctgtttaaagtcactttctctcaaaatttgctgactccaaattctgttgcttttgctgagaagacagtcacactgctgtctatgcagctccactaaatcaagtgtgagcttcaagtcctcagtggcaccaagcgttatttcaagagttattcttcctttgtgtatgaaaatttgcattttgaatgtgtgtcatcagagaagtaatgggaaattggggattgtgatgtggccaagtcagaggacatgtgtgtgtgtgtgtgtgtgtgtgtgtgtgtgtgtgtaactatcaccattctttttctctaaaagagagttttgatggtagatgaggacgtaggaccactagattcaaaagtggaggatgtaaaagaatttggaaatagattaaacacaattctggagttgtctatgaagctctctttataaagtatcttcatatgcaacagcacatgtagtaggcactttctgacgatggtcacaacagaacgcagaatggctgaagccctgaaatgatgcacactgtatatgaaattgaacacgtcggtccacgaatgtttttaaatctgtaatttaaaaaactcccaaggtgtcgccaatgtgaaaataagtgagaaccacaagcaacctaccacatggtttgtagaggccaagattctctcagattcaaggatagaaaagccactcaaaactgttttaagcaaacttgtatctgaaaagtctatttgatacttaattagctaatttaccagttgcatcagaactaggttcctctacccatctctgtgctctgcctccctctgtattggctctatttcatattctcacctctctgggacaaagatgaccactaactgctctctcatcaaccctggtataagtggcatacttctttctcaatagctcccatgaaagatctgaaattgtttcattgtctccgattggctagactctgatctagcatctgcccttgaaccaatcactgtggccatggacatgtactgccctgactaggtctaggacacatggcaactctgggaccgggaggtgcaggggtggagcaacatggttaactataattaaaactatggaccaagtaggagctgagtggttccccagaggaaaacaggggaagtatcaacagggaaaatagacggtatgccttctattctagttcgtcgtcagtaaatattatttgatcattgaattcttgtgtcttgttctttaaagacagacaataagagttaggaggacataatgtcatggctaacaatgttgctgtaaattcgttatcaatttttccctttccactctcactttattataaaagatcaaaggggattttcaggaaagcgttaacactacttaaaagccccacctcgaagactggaggtgtggagagaagctatatataaggtggacccagccaggataaatgtgaaggataggcaagaagcactggtaggtgaaggtgaatagtgcaagggtatggactgaaaatcagtgtggtgggagaagtgagaaaacaccaggggaggaaataaaagctaaacaaaagagagagtgccacctctgtatgttgttgctgggattatccataggaaacagacatgtggaaaaggatcctgtgactaagaatagggcgtacaggaagtaaatagtactgttagcctctggaaagcaatgtggaattcaacttttaaaatttgcatgttgggcgtgttggcatgtgcgtgtaatcctggctactcaggaggctgaggcaggagaatcgcttgaaccccggaggcagaggttgcagtgagccgagatcgtgccattgcactccagcccgggcaacaagaacaaaactccgactcaaaaaacaaaaaacaaaacaacaacaaaaataattgcatgtttgctttttaaaacattgttctgtgtttccaagctgttttgacagtgggtcaaaggaatgccaatagtacggattatgactggcttcattttaaatggcagccccaagcaaagttgaaatttgaacttctgtttacatttagaaattctctggattgtctggtaaccttgtctttagaagcctgatgtttatatattggcagccacagggaattatttccctttgggtgttcaattgctgtccaatttccttatctactgcccattaaattaggaaacgttgggtctcatcatctgcttcactttccaatcactttaccagcaataggcttcaataactagtgccttgcagtgttgttttgtaagccatggtgtcctcaggatgcattttaaaaaatagatacctgaagtaatgtgaagagccagtttataggtttaaaacctgattttgagattcagacatagttcttaggaggctgaaccctgaggtttttcttttcaacttactcactatacagtgtgttgtatttccaaatatgaatcttggtaaggacaggtttgaaacagtctagcttcattgaccacaaaagttggttatcggtgaaacatgatgaaaacatcacatttctcatttaccaaaaggtgccttcagtggaggttattggattgcaaagaggatgtttgttggaaccgagaataaaaaccaaataaggttataaaacaaaaggtagtgatgatttgacattgaatggtatgcccagaaacttaattaaattttaattaaaatgtaattctgcataaaatttaattatatgacaatgagtattctcatagagtaagttaggaaagttttctaaagtcagttggaaaggcaccatgcagtgtgtcataataaaaaggacagaggctacaaggccagccagatctgggtttgaatcccagctctaccactgactggttctaagcttcagttttctcatctgtaaaatgggaataaattcttactctgcttacttggcaaaaattagaagtcaaatgtattattaaaaaaaccattcataatgtttgacatttaaaaatatattaggcattcaaaaatggtagctattatcactattattattattatttcttctggagaatagatatccattgtccctcttctcttcatagaaaaaaaaaatccagaaaacaaatgcctttttaaataacctggttgtagaattcaaactggctctgtccaacaaaattatgtttaaggctggagagagttttgctagtttcccagaaaaagtattgtcaaattacttttttcttgttgtgtgtattttttccctaaattctttttttataacttttactttcatctgtgtggaaatattcttggccatctctctgttgctatcccttcagtaagtctgcaattattttttcaagaggtgccagcccaaagaatcataagcccttatgagctaacagtgaagtctcagccaagaaaagaaatttaaaaaaccagtttcctgaaaattgtaacatacataagtttggaatgtgcttgtttgtttgtgtctttcttttttagtttatagaatgctttgctctttatgttgaaaaactgtccattattactggctgttggccattttttcatctctagggtaatatatttctactataaaatttcaactctggtcaaagcagacagtgtgttataaaaaaatatactgagcacaaatgcagtcgtaaagtctcatatttatttacctctcaaagtgaaagtgcttatagtattttagggacacagcattttttaaatactaggcactcagtaaatatttgtgggtggccaagtgaatgaataaacgaataagcaaatgaacgatgggaatttaccatgactgcaaatcatttctcctaagtgaaatatactgtttgttttcctgtgtgtgcatggagggggcagtgaaattgagataaatctcattgtttaaagagttctttagggactaccagagtagtggacatggtaataaaacattgttctccaaagcagaatatggtagttacagttacaggaagactattaacccctttctttttctagaatggctgccctgtatgtaatttaggttttgaaatcttccttttcctggacagagaatcggtcccagaatatcagacctgtgtttattggaaaacagctctatctatcgcagagcaatttctgttgtccttattaacaaagatctttgggaggtgaaggtcatttcaggccagtgctgaacagcaatgaatttgttaagttgttttccgaatgctgaaaggagatggacgtcagaacctggacatgaacctaaggcagttgggccaggtttaaacctcgcatgatcagtgggaatttgtgtactttatttaatgggaagcctcaattgccttatataaaaagtgaggcaagtgtagcatacacctttcagtatttggggtgaggattacatgagataacacgtggaaagcatttaccataatgcgtaaggactaccactactatgatctgtttctactcataatacttctaacatcaaatatgtgttttttccctcacactaagcaattctctagttctccagacaccaattagttgttctacaatttaagtcaagccttacactatctagagtgagcatcaggtggcacagattaaggactcagtcccacaagactccccccacttcaagatacccatggcaagtccaggcaacctgtacttctgacagacaagctacaaagtcataaagttgaggggttcccatgactctttcttgggtttgataatttgctggaatgggtcacagagctcagggaaaacaatttacttactgctaccagttaattacaaaggatgttggaaaggttgtaaatgaacagccagatgaagcagtgcatagggtgagatctggaagggtcccaagcgcgggagcttctgtccctatggagttggggtgtgccaccgtcctagcatgtcagtgcattcatcaacatggcagttctcctactcctgttgtttaggttttctatggaggttccgtgacattggcatgattgatgaaatcattggccagtgatgactgactcaatccccagcacttctctcctctccataggtcaggaaatggggccaaaagctctagctctgtagtcgcaaggttgggtgccctggcaattagccccaccctgaagctatcgaggggcccaccaagaaccaccttattattaggcttaaactcaggtacgattacaagtgacttatgaaacaaaagatgctcttatcactcaggaaattacaagagttttagaagctctgtgccaggtactaggatgaagactaaatatatatttcttatttatatcacagtatcacactaaagcataggaagttctcaataaatggaaaataaatagtggtcaaacccacctttacatattttgatgccaagtgtcaagaaggattatttatgaaactcttctcacacaagtttccatttcttcctttgtacacatgagagggcctgatcaggtcagaagaaatcacatttcacacccatggttttttgagccaaaggcacaggggtgtgggggtgtagggaggcaggttgggatgcttcctgctggcagtggtgtctcaaagagcacaaggcagggaaaataggggatgggtggaagaggatagctagggtagaagcaaaggaaaataagtacagaggggaggcagagagaaagggagaagggagagtgccatggtgaagagtttgacttgccagagctaattctttgtaggcaatattagggtttcttggaaggaaatcccccgttatggacttggaaggtaaaaatcagtttccataaaagagggagtattagatacactaagctggatcatgaagaggtaaaatgtatgaagattaaaaagaggatgcagaaaagaaaaggacaaaaatatattaaaaattagttcaactcctgctgggttcttcacgctcacagctgattagaaggtgggatatatctgtgtaacatatttgtggagcctgcttagctggaagtcctcatataccccctaccccaccacccaccttcccacacacaccctacttttggggagcctggctctgggctttttctcactgattcttggccagagacagcactcccttgccatgggggctctctatagaggatgcgtgtcctcatgagatggcagctggcttccctgagagcaaggcacgggggagagggagagcatgtcctggcttgaagtggcagtcattttatagcctaatctcaaaaaggacatagcatcactttggctgtgttctgttcattagaactgagtccctaaaccctgcatacacgcaagaggaggagacttaaaacccatctcttgaagggaggaatctctatgaatttgtgggcatatttttaaaaccaccatcatcccaaacagcattctctttagtttcttgttccaagacttcctgcatcccgactatgtctctgtctctgcttttggattatttgagatctctttaaatattaaattccatttactgacttaagttcgaaagtcctttccaataccatctgaagtcttggaatcagtgaaaacatgtcagacacgggcactttgctgtcttgcagaaagtaatgactttggtggacaagaggcagttggaggttatcttaacagaggatcaagccaattcctacactacaagggtaatcactccgcaatgagttcaggtatgcggtttcctaggctgagtcatctcctgctatttcgtcaggtctccccaaaacaggggtcagtacacttctgtaaaggaccagatgggaaatatttttggctttgtgggccacatgtggcctctgccacatattttcttcatttttattacaaccctttgaacatataaaaaccattcttagctggcaggctgtaccgagacaagcctccaggatgtagtttgcagacccctgcgctaaaataatcatagagaggtgcttgtcgtgtccttggaaatattttagatatgcttttccataccacccagccatggtaagagtcttctttctgtgtctctcaaatttcctaaaagatccaatttatcttacttcagacaaagagctgggagtccttttatcaggttggatacattttacataggatttctctcattccttcagggagacagaaacaggttcaaaaattaagtcactaaaatgactaatgtggtactgtcagagaagaattatgaacctgcagggttatggtctcagaaaattcatattgcgtttctatgcctcacgtgaataacaataaccttctccaacaagcagagtgaaaaatgtgaggactgccagtaagtattccttactgctggctaaatgctggcaccacacaggctttctatggcaatgggaatttgtgtcagagttggcttttaatgtggaaaataatccagtttcatactttggcttttatgtctttgctgttttctagaacgtcagcatgcctcgtgaatgacattgaacactccacaaaccaaaccaaaacaaaagccttttctgtgtgtctttatcagcaagtgaaatcaaaattgttggatgagaattctcaaaaccaaaaaaatctacgttttatttttaccagggcattagtaagaaatgtattacttagcccatgagttgacaaaagaaaatgtattaacatgtatgtgtgattaatgaattcatactaaaagagggaaaaaaggaaaaaaaaaaaagctgaaggaagaaactaaaagctgttcatcatattaatgttttgtagccccagataagtagtgctgctttcttattttactcccatgcccaaacctgtagtactgcaaaattgctgactcgaggtcctacatgaaaactgtgcagagacttgaaaactcttgcaagagtggggagttctatgaataaataaattgtttaaagggtcaatgaatcaggtataaacctcgttttgtaatcataaaatctgtggtctcaagtctgtttaacgctcttaaggtttacctcataggactcactattagttgtaattaaaactgaccaaaaaatcataatttaattggcgttaataggacagactttgaagggtcatattttattttggatacataatgtttcttcctgaaattatttattcttgtaaattattctgatttaaaatttattagccagttgttgaagaaattatttacttgccatttatttgaatggttcaagtagtatatgcgtatatttaagtatttatcctaacattttcatgtgatcgggaaaacttttgctctaacttgacatgttttaattggcgttttatgtcacaagacagcatttgttacaataccattatttgggggttttcataagaaaacctattacagcctaaatgttaaaaactaagatcatttagacacttctagaagcaaaaatcttctgggttccataaaacagggaaattgggtttatcaagtccaagatcatctgacattagtaatgagatatgggagaactagaataatttattcttataagcaaactgctgagaagatagaaagacctgaaaacctttctcaagctgttgctgtaagattgttctcctgcagtctgccttacgggtagtgtgctctatcatccctccaccatcggactgtttctgtctactgctgcctgctacatccactgcctcctcatggggctccacctgtttagggaggaaggggctctgcatattaaatgactgatcctagaaccaatgaggggctctgcatgttaaataactgaccccagaaacaatgaggtgctctgcatattaaatgactgaccctggaaccaatgagagggatgaggcattagacagaccgattctcattttcaatgagtgcagtcacttgcagagatctctcttttcatagatcacaaggctgcctgatatattttttaccaaacatatttctgtggagaaaaggcagctggaattcctttacatttatccaaaaaaaagaacatttgataagggcaaacttctgcaaattgaccgatttggcagaaagaacaaagaacatgctagaatactccttagtgagggattcatgtgtcgttttatgtctgtaccattgtacatactggcaatgcataattgtctgtggcctactctgccaccaggagagaggaaacagatgttcctatctgtcttttgatgtggcttctgatacttacattgatttgtctaaaatagcatcagctaccctagaaaatttttttcctagtccttgagttggttggctaattgtttcaggtgactattaataatgtgggccaggcacggtggctcatgcctgtaatcccagccctttgggaggccgaggtgggcagatcatgaggtcaggagttccagatcagtctggccaacatagtgaaaccctgtttctactaaaaatacaagaaattagcgggtgtggtggtgtgtgcctgtaatcccagctactcgggaggccgaggcaggagaattgcatgaacctgggagacggaggttgcagtgagctgagatcgcgccactggactccagccaggatgacagtacgagactccatttgaaaaagaagaagggaaaaaaaaggaatgtgattatcatctcaagacgatccactgtcagcgggtattgccctgttacagggaaaagacagagaccattgggaagtggacttacagaaaaaaaaaatcacacagtattttatttattcaaagtggagtaagaccccagtaagactttttggaatagatctaatgaaaaattgagggtaaatttaaattcaacatcaggaggtcttagcactccctgctccatacagtaattatagaactgtggttataggtaggaagactagataattagagtgttatcagtagtcatgggagaagtgacaggttcattactaaataaaagtaatttaccctaaattgaaaatgacagctgatgccttctaaaagcacagcttgattagaaagaaaccatgaggatattggatatatgtaggagaagaaggaatggcaatagatctgaaatcacaaaatatatgcagaaaggagatgacgggggttagagttctccttttgcttaggctggtcccgagggcccacaataggctatattcttatttatgacataaggagaacagatattggaagcaactgtctcagaccatcagtcaaaatgtacaacgcagacaagatcacgaaaggaaaaaataagctaacagggggtatcaggaagtagcataactatattaaaattgactgttatatgcacattttacttaagaaaatcttatacaaaatttctagaagttattctagagggatttctactgggctaattttttttctcttcatctatttgacctcattttttattaaaagacctctgttgcatttctcatggtcactgtaagccagaatgtcccccttgttcccagactccacaacatgcagtttttccaggctgtcagctagggtggaatgcagggtggcatcaaagcgtggtgactgacagcttgcctttagccggcaaatgatgaaggctcaaatcgtaattctgctccctgctagctatgggtgctttggagaattgcagagactagaacaacatttctccacctaaaaaatagaatattcattatatctgtattattaagttgttaagaatgttcttcaggataattcagagcttttgcagtagaggtcgacaccattcctcattcttcgcacctccgtccaaccactcaccaaagccagttggttcaatctcttgaatctcttttcagtccatcctgttctctccctcctcacctgctgcccctttatctcaggcttctgctatctcttgtggagtatttcaatcaatttcaagtgggtctttcatgctattacatattcctaccccacaaaacagccaggtgagagagaacccacccatggctcccagctgcccccgtagacatgcctcactcccagcaaagggcacaaagccctttctaatgtgaccacggtcttcacctggcttcaatccttccccactccattcgttgtctgctccagccgtactaaattactgtgactccccaaatgtacatgcttcctctcacctctggggcttgctccccacccagtgaaacattccctctttcctcaactcatcctacttcatttgcgtgaatatttcccacttagatccatcgtgaagcaccggccatcggcactcccgccccataggcccctcgtaagtctttgaagatgccaaagcctttctcacataagagttcctggacgtgctcttcactccacctggagcgatcatccctctctctccttttaccccattcattcctactgattaattttgcttcacaagtgccttaggcttatcagctcaaatgccacttctacagggaagccctctccaatactcttgtttgttagaagccatcttagccacctacaacctacatttcccttcgttagcacgtatcatgactgaggatactatatttgcgtaattatttggtttaaaaatctctgagagcagatccctccaagcacatgctaagacaaagattcaagggccagcagttgatctggggagtgattcccaggaagggccagtagagaagcggtgaagtgagatagagaaggggaggaaacaaaaacaggtgcatgaacaagtagattgtcctgtgggcagctgagacttagtcctgcgggaggactccgggaaatagtgtggatgtgcctctgaggagtcccactccaggggcatggatgccagggtaggggtatttgttcgccccctcctgtccgtcattggttgagggctgcttctgggatattaactccccagcacctcagtattggcaggacaagcatcctgttgagaccagaaaaagccctcaggccgcatattcaagagaagaagcctctggtgcatgcagaaatcagaggtaagtgccagggacgatggccagggctttgacagctgtggctacaatatccatctgtcccactggactcagctccacagctcttttccccactagttatctctagagcagcactgttcaacagaaatatagcatgagttacaaatgcatatgttgttttacatttttcagaagccacatttataaaaaaggtgatattaattttaacactatattttacttaacccaatagatcaaagtagtatcatttcaacatacaaccaatatgaaaatcgttccttagatattttacattttttcacactacattcaaaatctgacatatatgtaacatttatagcacatctcaatgtggacttgcctcgtagtccgtggagtgcccatagccatgtgtggctagtggctatcacagtgggcaatacagctttaaaggacagagtctgggagagactgagacctcaaaaaatactcagtgacaaaagtctccgctggggcagtgcctcccctgagcaaatttcactgactgcctccaggactggaattaggtgcttaagagcacctgctgccctccctgcttcctccagcacaatgttagctgtacctaactgggtcttgtattcactcatctgtctccccagcatgcttctggagggggtgggcccccaacttgttcattcctgtgtctgcagcacctggtgcaatgtccagaacagagggagcttccccaaagttttgctcaatgatgaatccattttaagataaggtgattacattatcatctttagtgaaattttagtgaaaaggtaaattctatacattgattttatgaaaagtctatttttgtctacaaatattagtatagccatgagggattattcaactcatggctacagagattcagaatttggacaatgaacaatgcagtaataaagtgggcgttcatagccacatgtaattaacaaaaataaatcgcagcatactttctacttttacctgttaatactctagagcctagaccaattgtattagtctgttttcacgctgctgataaaaacatacccgaaactgggaacaaaaaaaggtttaatttgacttacagtttcacatggctggggaggcctcagactcatggcgggaagtgaaagactcttcttccatggcggtggcaagagaaaatgaggaagaagcaaaagcagaaacccctgataaacccatcagatctcatgagacttattcactatcatgagaatagcacaagaaagaccggcccccatgattcaattacctccctgggtccctcccacaacacatgggaattctgggagatacaattcaagttgagatttaggtggaggcacagccaaaccatatcaccaatcattctcaaagagtgtggccacactcatagcagcagcatcacccaggaattgattggaattgcagtgctcaggccctgtcccatctccgctgaaccagaacccagctatttgtgttttaacaagcccttcaagggcctctaatgcacagtgaagtttgaggaccagtactccagatagagtaatttccaagttactcctttagaaggaaagcaggagatcttagacaagagcttcctgtgcctaaaattccacacaaacaaaacatttggtttatctgcctaaaggtgtgtggtttctctacttgcaaattaatttcatatgaagtaaagagaatatgttgagatttattctggtacaatgtcaaatagcgattagcaaaacatttggctaaacaaagccattattggaaatctgtaatttttaaagagagattaaatacacatagaccaccctcttgtttttatacttgtcagtcagctttggggtggttgttgagttttatcatctatgggatcatactgagggcaagagcacatttttggaaaaagttcatacaaaatcatgggaaacccatatattgctttcatcctgaacttcaaaattccaaatcaacatctttaaagttttattcctactacttgaaatagcatgtctcaacacggaagaaacaagtattttaaaggaagaaagtggtagaaacacagaattggtttttgcttcccatgataatatggggctgcccacaacctcagatatatgtgtattgaattataccttggagagaaaataaattaggctattcagaaagcaggagactttccctttgtgagttgccccagacagacacttgcactcacacatctacatcttcaatcgttgacttcccaaagagccatttggacaatgccaagtggagaactgaagcagttactcctttcatccagcaaaaatacccaacatttattcatatctacatagaggaaacaacttttttttatttttctctggatgatcatctctagcctcagtttcactttgtgcaggcagacacatctcatgaaacctttccattcctctcccttctgtcaactcctaaagggaaaggcttttgtcttctgaatagcctaatttattctctctccagcatcttgaacgttgtaggtactcaacaaacattaattgatgacaaagctatataacagcttttgaatttattcatgggatgattcttctatttaaagaacatctttatatactttccattcttcagcaaaaaaaaagcaaagaaaaaaaatgtttcatcttgccagttctgtatttaacatctgcacagagcacagtgtgtgcctgttttaaacaaatgtgtaggctcactggttatctagattcaggaatgtaaaggacaatacagagaaatgtaatttttagaagaaaatttaaacttagggcttaatgaaaaaaatgcagttgctgttttatcagagagagtgagaaagggagagaacaaggaaatcccattgtaatgctattatgctaacctcattttggccatgattttcccagttatagagtggacaccaggttatgtgcatatctgagaactggcataatttatcatcaatttgcgagcacagaacaactagtagaataactgtgtcagtataagttgatttctaacctcagttgtaccatgaagtcattggaagactttgggaaagttacttaattctcatttgttagttacttttaaaaaacagccacatgaatatatttcttattattgtcattccttaatagttattgattgtgtacaggatgctttgtatctctgcaaggcactgcaacttccccagggaagcccacattaatgaatagtgtttataaagtacttggaaatccttggattaaaaactaacggtatcaaagtatttgtattaacatgccatatgggagaaccgtatgttatttattaagaggctatgtgtggtattgaaaatagctctctggtgcatcactttgtgctatttttatatcaagatatgccacggcaagttttggtacgcttgggtcataccttcaatgttgaaatgcctcaaaattcaatccttccacaggtatttgttgagctccttattgagcacttgactctctgcttaccattacacaacacatatggaaggcccagtggcacctacagtttcatgcatttcgtctctttgaacacgtgttattaaactgaagtccccgttaacagacacacgggcttaaaaaattacaggttccatttttcctcttccttctacatggacaatgctgttttgagacacaatgatagagatagggctgacacgattgtcttgtctgtcctaatggttgaagactaacccatgaagcttgcaccccttctgttaatggggcatggatgcagcactatttgagtttattttgggtagaactggcagccaggagagcactgcccagcatttccccaaactggctacacatgctgcaccaccttcccagaaggctgtaagtcattagtctggagaactatattgtaacgagttccatacaaaatctgcccccgcctggggaggcaattccttctcttagctagttgctctaataaggagacgatggcaatgggtgtattatcacaaggtcctgagatcttatgtcggggccagcatccttgaaaaattctgttctaaatgacatgtggaacctcatgcttcataagtaactgaaagatcctggaatagaagataatctacctctttttttcctgattcatttgtgaactatccagacaaggccaggtaaggcaagagcgtatttcattaactggagaatatttattgaacccctaccaggtacttaggaaacattgtttcacaaagcagacaaagacccttgcctccgtggagcttacattcaaggaggggcaggaacacataaacaatgaacatgatacctacctaaattagaggatatgatatattagaagatgatggacaattgaagaaccaaagagaaaaagttgatcaggataagaaggatggagtgtgtgagggtggggagatgatgcaattttaaatggaaggttcagtacagatctcattgaaaggggacatttaagcagtaacttgaaggagctggagagaaagcactccaggtggaggggtcaggcaatgcaaaggcctggggagaggagactccaatgtgctggaggaacagcacagaggccagcatggctgcagcgactgaaccagcaggataccaggagagaatgaatgaagacagagaaacaacgagggtctccaccacgcagggtcttgctgccatcagagcattcaagcaggggagtggtatgagctgcctcacactttaaaacaaaccagctagtaggctgagaagaggtgttgagaacaagaactgaagcagcaaaacacatcaggaagccattgccaccacccaggatagaggggatggaggatggccccagccggcactaaccattaactaactattaatacttgtgctccccacacttcaccatttgatttttgggaaccattagttgagatcaaagacacatgaaatgtttaaacaaatccacaatttaatgaagttcaagcagaagctgagatagatatcatacttcatctgcctagagaactgaaatacgattcaaggaaaaaataataatgctttgggggaaaatgaaatttccctcctaatcccttgacatgtgtttatggagcccttaacagataaggcactgtgctgggtgccaaggacaccacagaaaaaagagacatctctctgcagagggcttatggcttagctcttgcaggtgagcagaggtctcaggaatctgcaaggcaagaaagagagactccaggatttggcatgatctggacctgtgtttaagtctcagctctgccacgaactgtgtgacttcagggaagtgactttgatctcccacagccttgatttcttcatctgcaaaaatggagataaagtcgaatacgacggtatgacgttcatggttatgtgtgtgaggtgtgtgagcgtgtaaaggcctggtgcaaaggagacatctgtaggaagcggcagctatgactcctgctaggtggagactattcactgcacacctttttatctgcactaaaagatgcacatgaggctcttcattaaaacaatgaggcagccaacatggaaacttttctaagagtaagctattaaaatagatcaatcagctaatgacacctccagacaaaatttgtaaaggtttggaactaacattccctccctcctttccttccttctttcctttcttcctaaagccattaagcaggactgagaaaaataggtgtttgcattggagagaggatggtgctgaggggtcacagggtttggacagagtcggaagggcttctctgtcccagactactgtgaactaaagagacacaacaactgaatgctgtatgatcctagattgctattaggttattcttgaaaagtggcgaaacacagatgtgatctgtagcttagatagcaggaatgtcatctatgttaatcttttgatctggatggttgtattgtggttatgaaaaagaatgtccttgtttgtagaagatatatactaaagtattcaaggctgatgggcatgattaggacatgattatgtctgcaacttactctcaaatggttcaggaaaaaaaagttcttgtcctgttcttgcaacattctgttgcttaaaattattccagaataaaaatacctttagcaataaacacaaaactttagagttgtagcactgcactcacttgatatgagtgccagaggggtttgattctcaatatttgttgtgttcaatgttaattgagttaatccagatgagattatcatttcccacatttttgctgattcataatttacatatcttacccagacaataaatagttacatttctaagtaggcagtagtaggccccaacatcagctaaggctgggttgaaactgtcccctgctgccatcacttgctagctgtggaatcttaacacgcctgtgtctcagttgtctcatccatgaaatgcagataataaaacctgcctcatgcagtttttatgagaatgaagtttgataacctttgcaaagcatttagacactgagtggaacatatgcaatattcaataagtgttagctggtattagctaatattctgttgctcatagagctctatagttaaataaaccataaacatcattatattgatggcagtgcagactctttaagagcattcctctgttatatcagctaattttacttttcaaatatgtaccttctagagaattttggaacatatgagatgaaaatatagatggggaaatacaaaattaaagactagatttttttataaaagagtgctaattttttttaaagttaacttaaagccttcctgagctgacaaaaataaacatgtgtattaatcagctattgccataataatgctgtgcaataaatcaccccaaaatgcagtcccctacaacaaaaatatttattctcatgctcacaggtctgtaagatgactatggttcagctgatgtaggctgggctcagtggggtggttctactgcaagctgtgagttgcttgggcttggttccagactgtgacttgggttcaaacttgctccatgtatctctcatcctccttaagccaagagctacaggggcatcttcttgtcatggcaaatgtcaggaacacaagcaacaaatccttttatgcagtgcatgtaaatcctttgctcacattctctccactagcatttcattagctaaattaagtcccatggtcaagtccaacatcaatggcatggaaatattctctgctcacagtgggaggacactgattttatatatatatatatacacatatacacacaatcttattataggggactgaagaattaagaccaataatctaatctgcaaagcactggttttgaattgtccgtagtctgtctgtgcccagaaatctatagacctttagaagaaaagacagcagtataccagcaggaagtacacatcagattgtttccccagtatagcgatggatttatttagacttacgtcttgtttatcttcctgtcaccatgtagcgttcacaaaaggaactacaaatatcaggatagcaatccgtgatcatgttgttgagattttgcccttacaaaactctcccatgtagagtcaaacatggactgctttcttatcatagtcacgttgcagcaggagcctcttattttatttctataaaatttctgaaatgttcttgcaaacagtacacatttgataaatattggttgaaagagtaggaggcagagtactaatatgggagaaattagaaggacacaaccagtagaattctcacaggtttctgtgctttttcagcatgggaaagtaaagtgttatatcacactcgacatgaatgctatggaaatttatcatctgaaataaatatgtgatcttaaaggaatattaactgagaacatttagcttctatgtggcattatttaagctaacaaaatagcctcgcacttccctatatttcttcaccgttattgtaaggcttttaaaatcccttctggaaacctcaagtttacacatccctctacttaatttttcattgtttatgtgcttcctgtgacgatagctagacagacaaggctgataaaaaagaaagcttgtccttatcaaagacttacgggtaactgtgttaatgtgccttgctttttctaccagtggaagccccctatttcactaagaactcacccatttgcagcatttaaaatggatggaaagttataagccagccaaaatgtccttctaaaagaatgaaatgaatactaatctaattgcccaagaatgcatatgctgggcttggaaaataagccttctacattggttccccctgctggatttgaggatgcactgtcttggaaattgatgaaagcaatatacctggaccgttttatctgaggacatgttactggaatggcaaatccagcattcttctagaaagcatttgctctgtgataaatgtgccaagtgtttcttgagtttgcttccccagggcagaaatactgcaaatagaaaacagtgccgctgagactcaaagagaaaacaaaagcatgccactcagatgtctgttctagggaggggggtagcacacaaggaactaagggtaaaaacccagaagcagtagactaggtaaactgccagactggttgttactattagaaagctggatttcagggtctgaccatggatttccttcttatgcatttacaactattagaaccaattcctcacctttctgtaatttaactgctgtttttctttcccttcttatcttcctcacttcataagtaatctccctacccctactctgtagaagatgtggtaaccagagtactttcaaaggaagcttgtcacctgcaaacttcatggctattgtgaaatgtgttaaaaggtctgtcttttgagggagacagagaagctggcagatttttcctgcttgactcagagtccatttggtgggaggaaagggacagatattggctaagtttttggcacatgctcctgcaccaacttggccttgttaagacagcaagaacagcagaagtgactatttcctccctagagcaaaggccaatgctgtttccttcatggagaaccagaacagggaaaatatcagataatcatgtagtacttgtaaatatgccatttagaacactgaatttaagtggcatgcagagccaccccaggttctcatattatattcaggccaggtgtggtgtcttatgcctgtaatcccagcagtttgggaggctaaggtgggaggattgctttaggccaggagttcaaaaccagcctaggcaacaaagcaagaccctttctctccaaaaaaataaaaaatcagtcaggcttggtggcatgtgccttgtagaccctgctactcaggaggctgaggtgggaggatcgcttgagtccaggagttaaaggctgcagtgagctatgaacatgccactgcactccaggctggacaacacagcaaggctctgtgtctattaaaaaaaaaaaaagtagttatattgtgtccaccgtcacaaacggcacagggctaacccaacacagggggtcctgtacgtatatttattaactgcattcttcgccaacctcagagtatcattcttttttctttttttgtccttctattataaactttttttccccatttaggtcaaatctaaatgtttccccatctgaaactttcttcagtaggtcgttttccagagctgcaggtaaaatgcttccccactgcttctgaggcttttgtttcagctctgctactagtggcctcctcttgggaggattctcttgcctcggaattaagagttggtaggaggaggagatggcgggtcaaagcactcaagcaagacaacgttaagtgattcagtcctgcttgtgggtcaggaatttttaaagggctcagctggatgtctcttctgctccttgtgacactggctgaggtcaccgctcagctgcatttggttggcagctggcagggtggaaaggttcaagaaggcttggctcacaggtctggcccttcatgctccccacacatcttttctccctctctccatgtgtctccctccatttggcaggccagcttcaacttctttacagcatggggattggcttcccagggggagaaagtagaggctgccaggtcttgcagggtagcttgtaggtcccagaatatcacttccaccatatttcattggtctaaagaagtttcacagccagtcaggacttaaagagaaggaatgggctccactccttcagagacaaagcatttgtggccatctttaacccacatgaatataggttggtaacttctgcttctgttttctgtacttcactatatgttttatactttattcttatgtctttgtataaattcatcatttttatttgcttcattttccaaaccaaaagcaatttggagaccctcccagcaatgagttataaaaccatgcctatacttaaccttcaaaaagcttattatttctacagataaatccacagatatagtagctattttaagaaaaaagaaagtttcagatagttgctaatatacagccttcattgcacctgaccagttatttttcagatagctatatatgatagcataaactcaaccaacataatctgttcaagacaaaatattttatagcataggtatgttagactgccatatggaagttaagtgaaaattgaccttttttttgcagcatatatcatacagagaaataaagggcgagaaacttagccaaccttccttacacagtgcatgttacttaagtcaagggagaaaagtggactggagttgaagtttctattatattttgggaaatgccgagcaaggagagacttgttaccgggactgctgagtgaattttgtttactgcggttaaacatttcatctagcaaatcatgtgagaagggatgagtataaatgcacttatttatgtaggtaatttttctgtttcatgcctctgattcatctctctgcctggctttatggggagtcatgctacattggttacaattaatttcagtgctgcatattagccgtaaagagatatttcacaaattgacttgatgcattttttttcctctgtggttttcttgaaagatgagaacggtccagaggagaagcaaagtgtggaagaaatggaagagcagagccaagatgcaggtaggctcagatttcttttgagaagtcacctaggcctcatctgcagaggtgaacagtaacttcactcaatgctattgtctgaaaatgcttatacatttcaccagatgaactccagtgttcattcagggtctccctcaggaagccaccatctccgataactatgagttgagtgctttcaaacagagtggcacattctcacatctcattcaccaattcaattttctgccctgtaacagtttgcctggcaaagctctaagagggacgggcggaggttgaaagtgccaaggcagagcttggctgagttaggtcaagctcaaattagtacatttagcttgagggaaaaaatgaaataaaaactgatgaaaggaaatgaagaagaggcttggcctgcacagtgagtagaatgttctttagtgtattgcattaaattttgaagagctatgcttcaggttatttctctgcatattgcaggagatggtgtgatgggcctgactaccccacacacagagctcgaagtaagatctaaacccttcctgacatcccctctgttcactaaaggacagatgtgtccattgaaagtttatatattccacaccgtagattataaattgaacattttaaaataaaatagcacttaaggctcaaaagggattgaagtcacctgtgatttattatctcttcctatccatttttgtactcagtcatgctctcctttaaaagaatgataggcacaatcattcactcaccaacataaccagcaaaaaaataaaaataaaaatccctgttccctttagtttcccagttattctcccaactctaataagccccatggaggggcacttctgaagtagtgagccctactgtttgccaagcacatcctaggccatatgctgaactcttggaattaaaccaggtagtgtgataagtttttcactgtaaacttcttacattaaccttggagattttgctagggatctggaagcttttattattaacctggaagacggaactgaagaaggccaatcagagaaagcactgaagcaaggcagcaaggactttgtgtacctgtgactgggtcggccggcgtcctttgctgcaagatagtccttgcaatgaaatgaatttctgatgcagaaaactgttgttatccaaccctcccccacccccaacccacacattctgctccatagcagatgagtgaaaagctgtcactgtttttattgtttggggctgacaagtattagtcaacaaactgctgacagctgaggccattctgtgactgttgaggtttcaaaggttttattcactcactatcgtgtcccaaactgttttttttgtttgttttttgttttttgttttgttttgttttgtttttttgagatggagtcttgctctgtcacccaggctggagtgcagtggtgcaatctcggttcactgcaacctctgcctcctgtgttcaagagattttcgtgcctcagcctcccaagtagctgggactacaggcacgcaccaccatgcctggataatttttttatttttagtagagacagggtttcaccatgttggtctcgaattcctgatctcaagtgatctgcccgcctaagcctcccaaagtgctgtgattacaggcacgagccaccacacccaggcccaaagtgtccttatcgaaaaagattgtttccatccctgtacatacatgtacacacgcacactcacacacacgtatgcatgcactcacatacacatgtatgcatgcactcacatttgcctgtgtttgatttattcatcttttccctttaaccagttgagaacaagtagtttgtagatttgagatccttttgcctgtgaggagggagtggtagaatgtcagccctcttctccagcccttgaatctgatagcgttatcaccacaataggggcacttctcaatgtgaagaagggtcctaaatgcatccctgagtgactccccttacttttccaagtgagctcgccggccggcacagaggccaatggcagagtccacctataatcctggccagtgtcaacacacatagttacgttcacactgctcatttcttatcctccctaatcagagctcagagaaatcgaagatgtggttatgggtcgttaaagctcttttgacctgctggtatttttccaaaataaaagtatcttcttttcattcaatataatttccagcttcaattttgattatatagctctgcaggcctcttacacgtcatgaaaaaacacaatcttaaaacactgtaatccagcagttttgactgttgtcatgatcaaatcagatcaaagttgtagataatattcttccaaaaaatttaacaaatacatatcaagggttcattgtgtcataggcaccattccaggcactgaagaataaaccaacaaccaataaaaacaacatctctgtttctttgaaatttatattctggtgggggttccaaacaataaacaaataaaaatgataacatcaatagtgataaatgctttgctgagaaataaggaaacatagaaggaatgcccagaaggcaaatttccattgtctgggtttgggacggactctctgaggaagtgatagttaaaatgagatctaaatgatgagatagtgacagagaattctgttccaaaggacacctgacctgcaagtaatagtacatgcatcatggacaaaagataggctagaaaataagtgatttgtgatttgcttccaaatatgtgttagttttcatgcatatatgagttatctttagttccccgaccctgctactacataaaaaactatgaatatgtatgtgtgcatatgtactatatatatagtttatatgtataaatataccatatatgtataaatatactatatataaactatagagtccatgtagtatatatatgcatatgtaatgtgtgtgtatatatatacacacatatgtaatgtgtgtgtgtatatatatagtttttcatgtagtatcggaatatgtatatataactatgtacgtaactatatatcgctattatatataagtatatagctatacatattttctgctactatatgaaaaactatatatatactatatatgtatatgtatactatatatactctataatttatatatagtatatttatacatatgaactatatatatactctatatatacacatgtgcacactataaatacttttttctatagtaacagggtcatagaactaaagataactcatatatgcatgaaaactgacacacatttggaatcaaatcacaaatcacatattttctagcccatcttttgtccataatgtgtatatgtgtgtatatatatatatatattcattttccagttatcaggtattaaacattgcaaatgattttagtaatcctgcctgtctagatttactgtttgaatgggagggagtaggctagttagctgttatcgtggaggccaaacatgactagagtcactaggggctgatgacactgaggagagaaaggtctactctaatgtagttcattgttgctgtgaggggaacagagagttccatgtccttagtccccattttcccattctgttcttgggtgacatgaaagttcctggtggcttctggtgacctgtgccgaatgctccccttcttccaggcctctgtgctgacagccatcagagctgctccctgcagtttgacagcctggcataatggagcagaagtgctgtgctaagaaaaaaacaaactttagaaacatgcacataaaagcactttgtaggaacttgcaaggatatactttctttcacaatctgttatcaagaaaaataatataccatcctttgagggatgaggaagaaacaaaatgccaaaggatactactagcaacaagtggcattcttcactaagaaatagattgtagcccattggtctctgacttaactgaaggttcctgtttcactaattataaaagagagtcccaaaccactagccccttcaaagagcattcagtgtattcaagcatgcggcaggctcatgctttctttggtggagagtggagggaggtgcagggcaggaaagccacagctggacttccggaaggatgaactctgaggcagtgtttcttttctgctttatagatggtgtcaacactgtcactgtgcccggccctgcttcagaagaggcagttgaagactgtaaagatgaaggtatgaggctactaactatatctaataattgcagactcttaaaagagactgtttgggcttgtttacatggaaaaatgaagcagcaagtcaaatataactaggttttcttaagtgtctctgtttccaatataattgactacaccacctactctcttttattgcatacctagcctgtatagaaaatttatatatatatatatatatgtgtgtatatatgtatatataacatttacatttgttcctttggaaaataactgtttatgaaatgagagaatgatcagagaaattatgtttagagatgtttatttaaaacaccagaattaatcagttctgctctttacagccactcatcaggaaaaggtttgaaagagtggcatttgaggaccaccaaccagggagcaccatttttcaaaaaagaaatgtttgaaaggcatccttagaaatgaatctttggcaagagcatcattctccattctgtcagaagttactatgagaaaatgtttctgacccaagtatttccagaaaaagtaaaaaaaaaaaaacaatttacttttctaggagacagtttgaggaaggaagaagtagggagacattgatctggggatgctacaattaaaaaaatatatatctaaaggaaaacaaaatagtgctttttcttctctctctcctggttcattggcaagtccccagatggaaaagtaatataggcttaccttgttttcttgcccttcattttactgtgctttgaaaatattacattttttacaaattgaagttttgtgggaaccctgcatcaagcaagtctgtcggcaccatctttccaacagcatgtgctcatttcatgtccctgtgtcacactttgataattctcacaatatttcaaacctttttactattattctgtctgtaatggtgatcagtgatcagtgatctttggtgttactattataattgttttggggtgctatgtactgtgcccatataagatagtggacttatttagtaaatgtggttctgactactccactgacccactattcccctgtctgtccccttttctcgggcctccctatccctaaaacacaacaatattgaaattaggccaattaatagacctacaatggcctctatgtgttcatgtgataggaagagttgcatactaaatcacactttaaatcaaaagctagctatgtttaagcttaatgaggaaggtaggtatgttgaaatctgagataggctgaaatctaggcctcttgtgcctagttgtgaatgcaaaggaaatgttcttgaaggaaattaaaagtgctactccagtggacacatgaatgataagaaactgaaacagccttattgctgataaggagaaagttttaatggtctggacagaagatcaaaccagccataacattcccttaagccagagcctagtccagagcaaggtactagccctcttcaattctactaatgctgagagaagtgagaaagctgcaaaaggaaagttggacgttagcagaggctgattcatgaggtttaaggaaacaagctgtttccattacattaatgtgcaaggtgaagcagcaagtactgatgtaaaagctgcagcaagttatcaagaagatctagctaaaatcactgatcaaggtggctacactaagcaacagattttcaatgtagacaaaacagccttctattggatgatgaggccatttagcattttcatagctagagaggagaagtcaatgcctggcttcaaaggacaggctggctctcttgttaggggctaatgcagctggcaactttaagttgaagacaatgctcatttactattccaagaatcctagtgctcttaacaattaggcgaagtctaccccacctgtgctctgtaaatggcacaacaaagtctgtattatagcatgtctctttatagcattgtttactgaatattttaagcccactgttgagacctactgctcaaaaaaaatgattcaaaatattactgcatattgacaatgcacctggtcttccgagagttccgacaaagatgtacaaggaacataatgttgttttcatgcctgctaacacatctagtgtgcagccaatgtatcagggagtaattttgattttcaagtctttctatttaagaaatatattttctaagactgtaactgccatagatagtgatgtcatcctgtaatgaagctgggcaaaataaactgaaaatatggaaagggtttactattctagatgacattaagaatattcctgagagaaggccaaaatatcaacgttaacaagggtttgaaagaaggtgattccaaccctcatggatgactgtgagtggttcaagacttcactggaggaagtaactaaagatgtggtagaaatgtcaagagaactagaagtggagactgaagatgtaactgaactgtaatctcatgaggaacttgaacaaatgagaagttgcatcttatttattaagaaaaaaaagtggtttcttgagatggaatctgctcctggtgaagacagcaggtttgagagtattgagttcaattttttgtttgtttttgagatggagtttcactcttgttgcccaggctggagtgcaatggtgcgatcttggctcactgcaacctccgcctcccaggtgtaagcaattctgtctcagcctcccaggtagctcagattacatgcatgcaccaccacacctggctcttctttttttttttttttaagtagagacggggtttcaccatgttattcaggctggttgcgaaatcctgacctcaggtgatccacccgccttggcctcccaaagtgctgggattacaggcaagcaccactgcgcctggcctgagttcaattttaagataatttctactgtgggtaaaatgccatcaaacagcattgcatgccacagagaaatcttctgtgaaaggaagagacaattattgtggcaaacttcatcactgtcttattttaataaattaccacagctacctcaaccttgagcaaccaagtggtggccgtcaacattgaatggccagtagtggctatcaacattgaggcaagaccctaaccaggagaaagattacaagttgctgaaggctcagatgatgattagcatattttagtgaaaaagtatttttcagttagagtacattaactgttttttaagacatagtgtatctaaaaatataactgatgtcaaatacccacataggctctgataggaaaccctaggtcatcttagagagacaaataaatgtgatcaaatgtgatcagagcgaaaagacagaaagtggtgttcaccttaagcaaaaattttggacataccaatcatttagtttgtgataaaaattttaaagtgtcatgaagttgagtggcagagtttaagaaacatgaaagagggataatttaatttgaatgtgaccatgtttcaggctgggatttttcctgttgagttgtttaatttggagatatcacaccttcacagaagcacactgtttgtgatgtttcttgatgcttttaggaactcacaccattaattgcttatgccaggatccatgttttggaatacttttaggattttttttaacataaaacttttaatgatggtaactccatgaaggagttctgtcatgtatcacaaatgcagttcctatgtaagactaaatgtgaagttttatgagtattactgaaataagccattaatatctattaacctatttacttagggaaaatagaaatgttttgaaatccacactagtatgcaagcttctttcaattaaaaacagaatgcctagggtatgatttttgcctttttcttctgaaatagcatgtatagaaaaccactgtttttaattgattatcagttcagagcttagaccagcttagaacaagtgtctaatgcttatggaactatcatcttgactgatagatacctagcttagaaaaaaaaaatccgttgaaatccttcaagattgaggtcaagataaggttaaaaggcagtcatatgcgtggaggattcatttcaaacattctccattattagctttcatgcagaaatatctcttctcagtgacatctgggctattttagagctctgcagttataagattgcttatagaaatgctcattacactctccaatttaagtggcagaacatttttgctgatcaaatgtcctgaagaagcccttgctctcttgagttcgttttcagactttgatcctgaccaagcatcttcttgggctttagaatcactgatattatggacaggtctttttttctctttctaataaaactcccaaggattttgaggctcattcagttatttccagctttgcttgttagtgggctggctttacatttgttacaaccttggtttccacaggaaattagcatcttctagggtgaaagtattgaaaacaaacaaataaaaaataagatggctaatgtcactttggagaccagatatttaaaaaattcgaacagtcatgggaaagttgaagaatttcaaaaggaagtattgtagtgcaggtgtcctctttgccagcagttttgttttaatgttctagacatattttccactgggaaccaggaacccatgtttgctgcctgcttacccccatgtacttgctaactgtgccagctgccaacagaaggagatgcaactgactggctcatggatcaagagctagattgtgagctacacactgatgacacctgttcccaatgagccattaaagccatagggtgggcaggagttgagctgggagcatgagatactagcaggaagaatgctgatgaataattcatccggaatgcatgccaaagatttggcaaccaggattgaattgaaattaactccaaggtaaagctggcctgggaaaagatttgtgggttggtaggcattttgaggttatttgtgaaataggatgtgtacttatctattgaggacttctttctctactggttaaaaatactctgttgatttaatggtagtttgcactttaaatccttaaaaacaaatttaggagtacaagtattaaggctatttaagttaacaaatatacaagcaatcacattaaatgggcatataaacacaggaatgtcaagtactccagatgaaacttttacaaagttattattattactatttaagatatagtcaacctctttaagataaataatatgctctgttctagttttttcaacacttccaatagctcattttcacctagagccaaggctaaggcagctttctgggggaaaataaagtgctgtttaaactcgtcttaatccacctgccttattatttaatcagtacctaatttaaatttgaaggtcaactagaccaaatcatatgctcattaatattaaaaacaaaatcaattaatactcaggtgcatacccaggcttgtattcctttggaacaccatgtaagtcatacaattgctgtttttggtatttatgaaatgggatgtcacctggcaaaggatttattaactcttgatctagtttcagacctcttagaagtcaaaattgctgtaggaaaaggggaaagctagagccaagagtcagccttgccaaagtgaacaaaagagaaagactacatacaaggaagagaattcaggagtgtgcaagagatgagagcacaaattattccaaccactgagcactgtaggcttggccagtggtgtggactcaaaattgctctggaaaacggcattgtttctgttctttgcctgaactgttgaggagaaacaaaaccaaggccaccaatgaattcctctcgagactctccaggctaatttttctttgtcctattcccattcttggtgttcaccatcccccactaagcgtcctcaccccatcactcatcagagtgaggacaaggctgtcctgtgccctggatctgcattggtagagtgtctgaatatgcttgagtatctctgagttatccctcttggatattaggagccttaagtgtagaatgaaagtggctgtcctctgctagtatactgaaggggaaagaactaagatacattgagtgtctcctgtacacaatgctttacatttataacaatgtagtcttcatttctcaaaagggtcacctgagactcagagaaggagagaggaaaagggtgtgtgtgtgggaagtgaggataagaaaatgattttattatggttaaccgccgtacctaatacctacataagcttatacaatccctttaaaaggtagtatttatcatatttttaatataaaaattatttttgcttataagaataatatatctttattgtaaaatattttttaatgtgaaaaatatacaataaaagcatatagtcattttccctttaaggattaaactgtaggaaaataaaagtctttattctattgcttcatttaacaataatactgtgaatatttgcccatgtctttagaagttcctcaaaggcatggattttattggtgtcataatattttatcatctggttatcccacaatttacatagccagtgccctaatgttagataacttagttatttatagttttcttcctattacaaataatagaaaaatgcagtgcctacattttggataaatctttgtgcatatctatgatcagttcctcaggacaaattcctggattttattgatttacgagggaaaaggttaaaacatttgtattacttacatatattttcttattttaaaagtaatgtgtgtttattacacaaaaaaaataagcaaaagaaggaaggaaaaatatcactcataaccctggtgcccagaaataagcatatgtaatatactgatatataaactctcaatgtttttctaggcaacctcatacatatatggaaggggtttttttagggtattctgcaatgcataaaagtttgaacctgtctttcaaatataacagtacattgtaaaattcttccaacatcttttgatagtctatcatcatttaattgtgtattccagtaaataaatgtttatattcttatccagtctcaattttgaattgtttctgtggtttcagttttaaattccatactgaccagaaacatccttttaactttgtaaaatgatcatgatcatttctgtaagaaaattctagtaaatgtgaatgcatgcaaatttgtgtgttttctacaatgaatagttttttaatttttttggttgtttaattagtatatttattgtataaaattcaaataatggaagagaataaaaaatattacatataatcacatcacccagagacaactaccattctcattttggagactatctatcatgcatctctttctgaatatatgaacatacacagctttatgtgaaacgtatgattgtaatgcaatttttctctttttgttgcttatgtactcctcaccattcaatcactcagagagtaaaatacatggactaagagtctaatctcttcttccaactacttgggcccagattccaaccctaccctgactaagctgtgtgatctttcgcaaattatttagtctttctactcctcaacttgagtttcctcatacataaaataagaacactaatagcacctacctaaaaaatatttagcattaaaatcattcagtccatttaaacattttcaaggtgttcctggtacacagtaggaggctcaatttttttagtcattattaaatatatatatgtttattttacaaatattgtattatattccacataccttgctaaatcttgctctgctacaggcagccaaacttggtggaagtctctgccagtcagtttgcaaagatctaattaatccattttaaagctcacatgataatccatagtttggctgtaccataatttattcaaccattctcctatgataaacaagcactttttttccactctattgccacatagactatgctgcaatagacatctttgcacacatatccttatatgctgatgcttttatttgtatggaaagattccagaaatgtgagttctgctttcagcagtatgtgtttttaatagatgttgccaaattgctttcccaataggctatagcaattcatatttctatcagcaactgttatttttgttctttctgatttttgacagttcaatggatgtaaagcaatctctcattattacttttaaaaagtcatcagtgttattatcccaattttgcagataactgaggctcagaaagtttgaatagctggatcagtttcccaaaagctagaaccagaatttggaagccaaatctgtctgaacccaaagcccatgcattttctatccaccatgctgcctcccgtatcatgaatttggagcagaggactttctttgcctgagtgggtaggatgcaggtgtgtctagagaaggcagagggtgtcatgggaaccctgcaacctgtgcaaggtgagcagggattggaaccacggcaacagggagggcagtttggagctagctgcttggtccacctcatgaccttgaccctaacctaggaactacaatgaaatgagtacacagaaacctccagtcatgcccctgactagatgtaaaacccaaagcactttgtattatattcctggtccttttgtgcttccttagaccctgcacgtgccttacgctatagcccaactcagttatttgtcctttcccaaatgccactggtctaaagcattctgccctcacgctgtcacatccattttgttctttattctgtatatgaaaatcctgatcatttttcagagtcactctcaatatctttcttgccctaactagaacctttactccatccttccctccctcccatccttccttcttccatcacaaattatctgagcaaacattacattgacagaaattataacagataatacaggtgaggggggtggtgcatgcatattttcacctttcttgatttctgttctcttcattacaattcaccccatagagtagtaactatcctgcttctcataaattcgtttataaaccttaaatgttatcatgaactatattgtatcaatattagttatatacttatctaactcagtagaatgtagacctcttaagagtaggtacaaaatctcattcatttttatgttctccacaaagctcaatgcagggggccagcccctccacacctgtgggtatttcttgtcaggtgggatgagagactgagaaaacaaataagacacagagacaaagtatagagaaagaaaagtgggcccaggggaccagcactcagcacacggaggacctgcacaggcaccggtctctgagttccctcagtatttattaattactatttccaccatctcagcaagaggaatgcggcaggagagcagggtgatagtggggagaaggtcagcaagaaaacacgtgagcaaagaaatctgtgtcacaaataagtttaagggaaggtactatgcctggatgtgcacataggccagatttatgcttttctctacccaaacatctcagtggagtaaaaaataataaagcagcattgctgccaacgtgtctcgactcccgccacagggcggtttttctcctatctcagaattgaacaaatgtacaatcgggttttataccgagacattcagttcccaggggcaggcaggagatagaggccttcctcaatctcaactgcaagaggctttcctcttttactaatcctcctcagcacagacccttcacaggtgtcgggctgggggatggtcaggtctttcccatcccacaaggccatacttcagactatcacatggggaaaaaccttggacaatacccagctttccagggcagaggtccctgcggctttccacagtgcattgtgcccctggtttattgagactggagaatggcaatgacttttaccaagcatacagcctgtaaacattatgttaacaaggcatattctgcacatccctagatcccttaaaccttgattccatacaacacatgtttctgtgagctcaaggttggggcaaagttacagattaacagcatcccagggcaaagcagttgttcagggtacaggtcaaaatggagtttcttatgtcttccctttctacatagacacagtaacagtctgatcgctctttcttttccctacactcaacacagtggcttgcacatagtaggtcctcatatttgtttaatcaaaaggaataaaatggtgtgtacataacagtttctataatgctgttgatgatttaacagtttcttggagaatttaattgagagccttgcataaaattagagacttcacatgactctagaaagtatgaatgggaaattatctggaattttttccacaagaattaactagagaattggagatagaacctatcatagaaaatgggccactttttgctggtgcatccaatgttgatgacatcgaaggcacccctcctgaggaaatctcaactgcatgacccctactatgccccaattcagcaggaagcagttagagcggtcattggccaacctccccaacagcacttgggttttcctgttgagaggggggactgagagacaggactagctggatttcctaggccgactaagaatccctaagcctagctgggaaggtgactgcatccacctttaagcatggggcttgcaacttagctcacacccaaccagtgaggtagtaaagagagcttactaaaatgctaattaggctaaaacaggaggtaaagaaatagacaatcatctatcacctgagagcacagtgggagggacaatgatcggcatataaacccaggcattcgagccagcaacagcaaccccctttgggagctctgttttcactctattaaatcttgcaactgcaaaaaaaaaaaaaaaaaaaaaaaaaaaaaaggaaaaagaaaagaaaagaaaatgggccacttttaattctaatattatagccactttcccaaatttgttttttactatgattaagattcctaataaaagaaattccctttcagaattctcttgtttcagaagtaaattttcccaaaactttcacactgcagaaatataaaagtacattcaagcccaagacttttcctatttgttcactttcagactttgatattcttcccctctaagagaataaaataaacttcttttaaggaagtacatgtttatctactatttaatatagtttaaaatattcctaagtggcaattggaaggtaagtggtagttcctttccaaatacactttaatatgcatatattacttttccttactaattaagtatggctataataatatatttgtaacagtcaattccattacatgctctcttgggacatatttctaaagatcttgtgaataagacttgtaaacaaaatcatcctagactaggacatggagattatttgaatgggtttacaattcctttgtccaacatagtgttttggacctgaatttacatccaaataggtccaaatttatatgagcatccttgtgataattttcaaatttagtggccttgtttttgaattccttgggccaagccatgaagtctttatgagtctcaatttatttcaaattcacatcaccattgctgtgtggccttaggtaatgtttttagcttgtgcctccgttttctgatgtgtaaaaaatggaattgtaatagtatttatatcacagggttgctaaaactgaaagagttaatatatttaaagtgcttacagcagcttctcaaacatagtaaactttgagttggcagcattattgttttttacaattattgttattacatttatttgctggctttaaaatcctaactaccccaggtggcacagtgatatgtcattgaatcatcaccaaatcaagaaatctattgatatgctaacgcaggttagagaggttcagtaacaggtaacattcaaaatatttaacaacagatgttgcccagcccctgaccatcaagatgagcattctccagtacaccatagggcgtgcaccagttgagtattgaaaagcaaccagagtaaactatgccagcaagcagaaacacctaagaaatctctacctagcccccattccccagtggagatttgttaactgggtatcttcgcttgaataccagacattccattggtgccttccatagatttttctgcctgctttgtgttttattctcttatagataagacctagaatggaaggtgcctagtccatattttgaaatgcttttgtgggcatcacctaataaaagtaatcatagatcttcaaaaccagcacaatttttagagtgattcgcactctactctaccagaataattataccagaattgacctgattcactaggactagagaaacccaagatgtatacttacccaaccaaaaatgcatgaagtcttttctgtctacaaattaaaatcataatatctctgactcatatttttaaatgtttaactttgactcccaaaagtgtactatttttaagagtatgtatttttctgaccctgtcatttcttgttaattagtataaaaaataatatttggagtaactctttagagtatttccacaaaaggtggtgtgtctagccaatctgagtaaacacaaaacatttactagttaagtgtagtctatttttctataaaatatcatttagactagctcagtggttctcaaactttaatgtgcattggactcaaatacacattaatatttgaatttaaaaataaatactgtaatttaagagtttttaaaagtatttccagagttaattttgaaggtatgtatttttgacactaaatagataggactgtactcagggcaggtggattctgacagcagcaggactctcatagcaggatgaggaaggagggtgtgttaacctaacaggagtggcctctgcccaggagtctccacaaggccacagaaagcccaaagatccatgtgtcaccaactgatcattgtaaataaagtggacctgcttctttaaccctgtcaaaaaagacaaaaacaaaaactaaacaaagaggtggctctactgaaaaacagaaatcatgacaatagttcatgtagaatggcacgtcattgtattttgactgggcaaaaatgctggaaaacggcacttcctttgaagtgaattcagatctataagcaacacggtggggctcttgctcagatattcccatgtttaaaattttatagcatctttgatgatattaataattgttctttgataaatgagttcagcagtcaaaacattttggaaactacgaaattaggcaaagttaagtggtttttctgtaatacagaactcagagccttcagcatgctaacatgaattgaaatgctcaggggagatggaagtatggggcgtttcccacgttaattaactaaatgtgattttgtgaaattttgtttgcttgctcgccccttttttgttggtagaactttctaaaagtcatacaaaacacagtttgggaaaccattccacatcccatctggaagaactcaagaacgcagtttaaagttttgattttaagaaatcatacccattgttataatacaaaataggcaatggtaaattaccttttaaaaatggagtctggccttcttgaatttatggttatggagtggtatcggaaaaacattctctcaagtttcagaaagggatgtagcctatcttagtttttgacaatagattttcacaagcaggaatgttttgctctgactcttttctaatgacatttgttgtcagctattctgccactgttcctaggaggatatatttatctagacacacacacacacacacacacacacacacacacacacacacacaaagagagagagagagagaaagagcacaggggaagatgtctcaactgctgcattctttaataagaagaaaggaataattggctggctagtggcaagactggaacattttttaatcaagtaaaaagacaaggtttaagcattgatggcatttaatgagaagattgttttcctatttcattttgaaattagccctgttattttgcaccagatgtgtcaaattagaatggaaaggcaaaaattgattattttcctcaggcacaaggggcaatgacactcacataaacatatatgtgtactcaaaacaacatgcaagcgcatgcatgcacacacaccctgttttgagaacaaacacaaatatgtgcaaggcgatatttctcccagcctgactcatacataaaggtctcataaagatctatggttttcaaaaagcatgtaaacccattacactgtttcaatttacgtaaatcacccgtaaatgttatctatgccaaccacacctatcttaaacacggaatgaggcagaatcagttactaaatattcactgaattctatcctaaacgtgttatgtgatatggtttggctatgtccccacccatatctcatcttacattaccacatgtagtgggagggacccggtgggaggtaaatgaatcatgggggcaggtgtttcccatgctgttctggcgatagtgagtaagtctcacaagatctgatggtattatatgggggagtttccctgcataagctctctctttgcctgccaccatccatgtaagatgtcacttgctcctccttgccttctgccatgattgtgaggcttccccagccatatggaactgtaagtccattaaacctgtttttcttcccggtcttgagtatgtctttatcagtagcatgaaaacagactaatacataatgagacaaatatttctgtcaacctcttcctcagggtggatggttaaagccttgagaccactccaagtaccaggcactgggtttccctgaatcttccttcatggtttcaggaaaatcagaaaccattttttttttttatcagtactgcatctttctgcatcctgcttctggcttccagcttcttgcttcctgcagctttctgcctaccagaatcctagtgtagaccactctagacttggatatccaaccacctgatttatcatctaatactgacatataccagcatcagcaggaggaaaagcaggtaaacaccaccaagcatccagctcaagcttaccctttcgcacgtacatctccctcttctccacagtattgtccatggtcaaagcccctcccagattctttcctgggggcttctctcaagttggagccaacagagcacaccagactttaggggaacacattagttgaagagctgccctgtatcttccagagatggatgatattgtttgtatttccctaattttctctaattttatccaaccaatacttaggttgggtaacatgcctgaagccacacaagttgaaggctgaataatagatttgcatctaccaccatgccaccctgaatgcacctgatctagtctgatctcaaaagaatagttttgagaagagacttttcgaaaactctcccatttctgtgggggtttcttttccttatgagtctgctcatgataaacatacacaatggaatattatttagccataaaaaaagaaagcctgtcattcgtggcaacatggatagaactggagaacatgatgttaagggaaatgagtcaggaaaagaaagttaaacaccgcatgttttcactcataggcagaagccaagaaaggttggtctcatagaagtaaaaagtagttcaggatactagaggctggaaaggggagggggaagtggcagggatagaaagagatgtgttaaaggatacaaaattataactagatcgaagaaataaattctagcattctatagcattataggatgaatatagttaacaataatatacattatagtttccaatagccagaaggagtatattgaatgttcccaaaacaaagaaatgataaatgttccagatgatggatatgctaattaccccaatctgatcactctatattatacgtattgaaacatcaccatgtaccctatgaatatgaacaattattttgtcaatttaaaaatgaaataaatttatttcatgtaaaaatttagctaaaaaaggaaacacgcatacacataagttaaggcttttttgaatctcagctaattcagcaaggaaaaaatgagtgataaatacttgattttgtaaaaacgtttctgttttcaaggaaaatagtatgtttcaggttgtctgctgtttttaaagtcagtgatgcctagaactaaatgatagtatgttttgatttctgcctgctctgtgttttacagcagactcactctataatttttattacattttcattatttacatccttattccaaaatcatatttgaagtcgttccctcaaaactgacacctgttatgaagcaacagggtctttacataaattaataaatgagaatgtcacaatggaggttcagatagaaccctgattcatgaatttgctcactgttttttcttgtggcagaaaactaattatatttttgatcttggagttcacacatgcatgtgttaaacagatagctggctttaatgagcccaagattaagtgtttatgtttgaaccctatataaatgagcaaacctttatataagtcaaagttcagggtcatattaatatattgcacttgaagataatttcatttcataaattgggtaaaaagtctatcaccattaccagacaaagcaaagtaaacagatcccagcacactccttcttgaatgcccataataccctcaggtttccctccaagtaaaatgcaaatagctcactatagcctgttaggtgcacctttccattgcagactttccctgtctctccagtctcatctcgcacctctcccactcctctcattgtgcttctgcctcaacacagctttctctggtcatctttttggtaaagccacctccactaaacctccatctcagcctcctatgtgttgctttataacactcactgccatctctaactatgtaaatctttttctgttgttgtttgcatgctttcctcctatccatctcccactactataatttaggtttcatgagtggaaagacagtatttatgttgtccaccattttatccctgtgattagtacacagtatggcctacagaggtaccaattaaaatttattgacatctcttatggccatcaacagatatttattgggtcttaacttttttaagacattatgcaatattaaaaagaaaatacagttcctgcctttcaaggaatttacaatctagatggaaatatgagatatacaagcatgtgctacatagctaatatcagcaacaataatatcagcagctaatatttatcaaatccttattatacatcagtttctattctaagaactgcacatgttttcatgcctactgctctcatctatgatatgaatacaattaccatcccactttacaaatgaggaaagtgaagctcacagagcaataacatagctggcctgaggccacataactaggttgcagggcagcaaagaaagtcagacagatcatggtaagtgttaaaaaaggattacattgaaacatactaaggagcttagggttgaggagcatctctgcttggggttgtctgtgaaatgtgggtagagaatatgagatttgggctgggatgtgaagggtgtgcaaatggaaggtattctagttgggaaaaagagcatctttgaaagattggaagaaggacatcagaagacctattttaggtacaatgaataaacccaattgacttaaatgatggatccatgacccactcattaattcgttgctgacacacagtcctgattatggaggactctgaatatcagactaagaaatttaggtccaatcaacataaagcaaaaattttcaaccattgggtattgttcaggtgtaaggtggtttgggtagctgttacaaatgtaccattctctttcatcctccaattccttctcagaacattctctagttaggtcttcttcccagccatttctgtcaccatttgcagatgcttctctataagccaaattagatttcctagtttctaatggatgatcctttggcaagctataattttccatcttcctaattctgcccttcaaataaacacgtatttaagtatttgtataaatcaggctaatgctaaattatctagaacagcactgtccagtagaaataaatgtgaaccacaaatgagaactacatattagtagttttaaattttcaaaaaggcacactaagaaaaaaaaggaaaataattttaattatacattttatttaaccattatatccaaatagaatatttgcaaaatgtagtcaacataaaaattattgatacatgcatcaggaagaatagctaatggatactgggcttaataccagggtaataggctgatctgtgcagcaaaccaccatggcatatgtttacctatgtaacaaacctgcacatcctgcacatgtaccccaggacttataataaaagttgaaggaaaaaaaaactaaaaataaattattgatacaatattttacattctttgtatgtgtatgagctaagtctgtgaaacttggtgtgtattttatacttacagcatatgtcattcggactcaccacgtcacaaatactcactagccacatgtggctggctggtggctaatggattggacagtgtctggatttagattgatgagaatgtgttgtaggaattgtctattacttttagtctttaagctttgttcttaaggagttcttgcctgcagagtttgatgcaatcagtaatgatatgacctgagcctttcttgattccacagattagtttgttgttcttcttcttcttatgaatgcatgccaaccaaagagtttcagatttttaacagtaagacccactaaatctaatgtgaaggagagatgctttgaaaatatctcttatatcttcacatattgatggggagctcccagattctgtcactcagagagctgtgcatccctcctcatcacatgttagaggctgctctctctgtagtggaaaatctgtgggcagtccacgtgaggatacttatccaaaagtcctactttaaatgaaagatgtcttagacacaaaaacgaaatgcatacagatagatacaaattcagtatatgctaaggcaatggctctcaaagagtgttccctggaacagcagcagcggtgtcatctgggaacttgttagacatgcaaattctcagtccctaccccagaccttcaggatctgaagctctggggttggggccccacagtctgtatgctagcaagcccttccagggatcctactcctaatgtacactaacatttaagagtggctgtagtaacaaaataataagttggagacagagtataggagagcggtgaatgttttatgtttgaaaaagaaaaaaatactattcttactcttcaaaaaagatttaccgtagaatctgctgatgtggccagccttcagagtgcaattaaaattcactttcacatgcaaaaatatgaatgaatttcacaaacgtaatgttgtgcaaaagcaagaagacacagaaaaggacaggttatgtgtcattcaatttacgtcaagtccccaaacaggcacaacttatagatgctgttgagagttagagtggtgatgattagagtgagggtagtggctggaaaggaggataatgggtagaaaggaggaaaatggtagacatgttctactgcttgagctggtcctggttatgcaggagtattcattttgtgataattcatcaagctgcacacttaagaattttgtactttaggtatgtttatattcaacatacagttaagaatttgaattttttacaaaaattatgaatgcaacttttgggaaattttttagtaatgtgaaaaacatgcactttaatttggcagtctcacagttgtttctcctaaataacaaatagaggtttacctttaaagtgacccacttcatacgtctctaggttggagcataaacatacataaccttgatgctctctcatgacctctgtttaattaagatccttccctccctcttggtccctgctcaatgccatcctctcctgttctcagctgactttggactaatctttagcaactagttattaagtcattactccaaatgtcacaagtgggatccttccaaggagctctgcattttaaaaagtctcaaaaggcattctgcccaaagaaggaagtctcctctgggaagtgtgaggggtcagggcgggtacttaggaacagatggccttatctggcccccttatatctcccaacacggtggccatcagcttcacctaccaacgaggctggcctgatctgattgcatgagttttcctctccagtgatgtagggagcagtggggtggtgtgggtgtgccaagaggcaggggatgtgctgctggcctaaagagatgtggtgttccacacagaaggactaacccaaagtttttgctggttctatttgcaatggtgctttatcagataaggaccacaaaataagaggttatcacaaatatgtttgaggattattcagtccttagattatagactcttagggaaagctacttcttattcttttcatcaatatgagaacatcagagacttacagttaatgaaatactctcattactttttggaaaatttatcaatatatttctctattatacacagaactgatattccgccagtacactctaatcctgctgcaagcatttttaaaatactgaaacatttacatagtgtccggcaaacaaagattaatgcctctcctttcaagtgacccttcccaccacctccctgccatcctaggacaccagcagggctccacggccttgccccacagctgtggacatgtgcattctgattagccaacaccctaccagttattaagtgttttgaatatctctttggattccctcatgactactttatccgtgctatacaaacactgacaatgtggtgtattttaaggatcaaatgaaaatgtgatgccagagaactgaaatggagaaagagaaccttggacttgggtaaaatcccatttccaaatctattctgaggccttcttctgatgtgcagcaggtatactaatttgaatggctgacattcaaagggaaataaaccatccaagtatccatgtgcacaaatgcatatgtcagtgctgtggacttcgtgtttgtcccctccacccccaacaaattcatatgttgaagccctaacctccaacgtgatggtatttggggataggacctttggggaagtaattgaggctagatgaggttatgagggttggtccccacgatagaattagtgtccttataaaaagcaggcacacacactgaggaaaggctatgcaggaacgtgaccagaaggcggccatctgcaagctggcaagagagccttcgctggaaaatgaactggccagcaccttgatcttagatttccaacctccagaactgtgaggaataaatgttggttaagccacccagtctatggtattttgttgtgtcaggccaagctgacaatatagtcattgcgttaggaaaatctattataataatttctagaactcatagttaagcctactctaataaaataatagcagattaaaacaaaatccttctataattgaaaataacacttttaatttaatcttaagtattcttcttaaggttcttgtaagttttttacagcattttgttttaacacgtttttctcagtttatgaggcaaaacattgttcacattatacaaatacctctgtacaccctatttcctgtaataccagatgtcccctgatttttttctaccatcagggtgatatttgaaaatgaaatttactgaacctgttttactttgtatgaccaggctgtttcgtctttaattttctgtaagttaattggcataatgcctttcagcccatgtataagtttcgtgagtactgtacagtttgaaatgactaaaaaggtgagtggtttttacaaatggatctagaataatgccaaacttcttaaagtaatatttgttttttgtttgtttgtttgtttttgagacagactcgcactgtgtcaacccaggctggagtgcagtggcacgatattggctcaccgcaacctccgcctcctgggttcaagcgattctcctgtctcagcctcccaagtagctgggactacaggcacccttcaccacacctggctaacgtttttttatatttttagtagaagcggggtttcactatgttgaccagtctggtcttgaactcctgacctcgtgatctgccctcctcagcctcccaaagtgctgggattacaagcatgagccaccatgcccggcccaaacttcttaaagtactatttgtaaaaaaaaacactttagaaatgtttaaagtacatatacacattaaagttaaataatgaacttgcaagaaccacaaagtgagttagactatttcaggttatacaaaagtgatacacactgaggttgcttggttggcaggaaagtcagagaatgaggaaaccatttcagcagccccatgaactggatcacccaggaggcaacagccattccatcagttcctctagagactcaacaactgttctagtagccatccactcaaagagctgatcaattcctttcacagttaagtgaatattaattctctcctggtatgtggagctctcatgtcaggccaccttagtgtctgttggtcaagcaagaggtgtctgcttagggcctattactcaccagtcatctgtgacccagctactagggtcatacagtgcaaaacacggtaaccctttttcccaacttgccctaattaggtggcagaaactttccctaacactccataattaaagacagcatggtgtgagagagcagcaggctagaagtcaggagaataggatgagcattctcatatttgctactaagtggtaggagccagatgaaggactatcttggttttctaagtttcggatccacaaaagcaaatcggggacaagattgtgggtgcaaaaggtgaacccactttttatttgggaggtgttctcaggaagcacaggtgaggtgtgaggaagtgggacagggaagggaggacagcccctaggggatattaatgatcaagttactgctgagggaaactgagactccgttcccctaagagatgtatagagtgcattcagaaacatctccctgaagggtgaggaagctggggtatttatctcccaaatccttgggggtccagagctgggcattaattcctggttacttctggcccatccaggacaagagtgccctctgtactggcaccatcggctccaacctcagggatagtccacagggaggtgggtggggcacgttggctacaaggcttagcttgcatgggctgtttttgttctcactactctagctctagaaagatctagcctctctagatgtcagaggtggagatagttgggaaggagtaacagaaggagaagagtgaatccagcctttgaacctttactacaacaatttataattttttagaaagtccccaaattggatttaattagaatgtccagaaatagaaacgattgtaaaatagcatgcggtagagccacacgatgagccactctgcagccacccatattttaaaattatattcaatggcatggagaaaattgaagaaagaaaaaaacagaaaaagtaagcacatgggggaatgggggcccatgatttcgcctcagttctttctcactcaggtgagtttgtggatccttctaggtgtcaggaataaattgatgttcgggagaagtcatacaggtctttgaagctcaacatagtatctcccacaaaggacccaaatgcttgtctcactctccaaacaggtgcctttacatttggaaaaaaaacccaagttctgagccaacaaggtaggttatatcttagtccttgaaattcttggatctcagcagcaacactcagccacactttccaagtgtctggctaaaagcaatctgagcccagcagttgctgcatttatgaatctggagagaaattctgtctcctgcctcaacttctccgtaaaataaaataactcagaagcagtgacccgatgccaggctgtcggttcagagctaaggccacaaaagcctttatcatttttcctaagaaggttctttcagtaatacagtcaccatgacctttcattatcagatcaaattaagccaagctgtaaataaaacacttgtactctcccagatttatagatgaacattttaacagaattccaagccctttacattcagaaccatagatacttctcacacccatggcctggtaagattttattttttaatgttatcaagagagcctgtggtgtgaggcttagtaagagagagggaggcaagatgagaaagaaatcagaaggatggaggtcaaggatactgaaataaccaagtcacagacaactgaaaataagagcagatttgcctttgtttacattgccaaatgggaaaaattaacttgattgaaagggtaattaagcatttctttttccatcatggtccaaaccagcttcatattccagctgttccgttttacattatgatgattctttgttgagtcgctgacttaaagacagccagtgtggcactggtgcacaccttactgcttctcccactatcaacctttattttgtaagtacacagttaaaatctcagtgagaacggtccaactcaggtaggcggatgatgaaggaagagtgggaacatttacaaagaagtgttgctggaacaaagagataatttgagcaaatcagattagctttgtaaggtatcttagagagattatccagctcaacagctgtagttcctaggtgcagaaactgagattatgtaaagtgcctgaatttccctagagttatgaagcttgtagctctaaattctgaatcacaaccctatgactgcatctctcatttgctagtattttcaataacaacttgcagaagaatatcaccttcaatgtaagaatgagctatttcacaccagtttattgtttgaaatttgtgttttctaatagaaatcaaattaattgtgcattatggtagttttcccagccatgtctcaaagactgttagcacacagggtgatgatccctaatttgaaaatccaaaatctgaagcccttctgggcccaagcatttcagataaggaacatcaacctgtccctgaattccatatctctgggaatgattggccatcttttaatggaggttaatgagaccgtaatgaagacaaatgaccaactatagctcatttgggtctcctgatgccctgagcaatgtcctgtctgtgggccctgttacctttcaggtaaatatagttcagccttatttatccagcttcactgggaccaagcacagttcagatcatcagcatcagaatagtctgggaatgtgttgcaggatacttttttcctatataaaagagtagccgctgcaaagtttcagtaagaacattatctgctggagagactctagtttatttagataagcacctggttcagatggaggaaaaattactttgtcctaattgctccacataataagccagagattctatagagcaggccaggataaatgttttgcatagtataatcaaatcagttaacgagaatcaaagaaaatccaggtgatggtgtttctgtgcaatttttgcatcaagctctggtactcatgtgtagacatttacgcattacagagaaagactattttatgtgtaggtttttgtgtatagcagtttttttttggttcagacccattagaagttctacgccaaaatgacctgctgtcatcactctgaataatagtcaggggcttcctctcttactcggtgcgttttttagaccacctagcttgaatagttatcttcaaagacagtgaatcatgcagttagttttatactttatattcacctctaattttggtgcaacatggttttttgccagttggattgtccctctcatttatttaacacatctctatatttgctggctatttcctcaaatcaaatctaccttaagaattcaagatttgccatcactgattaattcatggagcaggaatcaagctcagtagctaattcctcaaaactggtctggaaaatcttttgtaaaatggcaatgtcatctttcaccacagcttaaatccatacatgtaatattctgtgtagatacgtgtaattgactgcattaaaagtgacctactttttggaatttctgttttatgaagtttttcattttattttaatctattttaaatattcctttaaaccttttcaactttctgagtgagggctttttcttttttaatttatgaaagtgtttcttttttattcttgttaatcttaaaagcacatctatctacagccctttggcttgaatatttgatttaatatttgcatttgaaaaaattctttaaatatgacattgaccttaaagattttgaaagtcagaagctacatataaatttaattccagttctctgttattaaaataacattgactgaatctcagaattaggtgataactgttttacatgtttttgaacattaccaaatgataatttttagaattaagtaaaatgcaaatccaaggtgctgcaagagttgtatatgcaactacatttttcagggtagtttatagaacttacatggaaataataagttattttagtgaccatatacactggtgtcttcgtccaggctcctacaacaaaataccattaactgggtggcttataagcaaaagcaatttatttctcacagttctgggggctgggaaatcaaagatcaaggcaccagcagattcggtatctggtgagaactcactttctggttccttctaactgtgtcctcatttggtggaaagggtaaggggactctctgggacctttttaaatctttttataagggtactaatctcattcatgaagcctccacctttatgatccgatcaccttcctaaggccccaccccctagtgccatcaccttagcagttagactttcagcttaggaattttagggggacacaaatattcagaccatgaatatatgcattttctttctccatcattatgagtaaggatttcacgtacatattcaatgcagctttcatcaccccctaagcagaaaagctgcactgccacttcaaacctacaactaaatataatgtaatgagatccatgattgaaaacatacagaatcaaatctaggcctgctaaaggttatgagactagaaattcagagagccctattaataaagtaactttcgtggaaaccatcttccataggtacctgcttatttgtgaatattgtcatgaggttatatagtacttttccttctactttattgatgtgtgtggaggtagaaccatttctggagcaaagtttcacatacgtgacagtgaacttgtgggtttggtggtgggtcgtgctgatatgacatccttgtcatcacataaagacatgtatatttgtgtgcacacatcgaatatactgcaatggcatgtttctaagatgcacattctttcatatattttatttctaaagtcaggacatgtcttagaattgataatgtgttatagtgcatctggcagcattttcttctaatactacataaaataatagtgcaaagaacaactgatggtatcttggacgcaatgaaatgcattatgtagaaacatatcagaaggtgcattaataatgttaaagcaactccccaagaatattgaaattacaaagataacttatttgctaaagacacagattttggtgataaaacagatacagtctggtgagtaatttttcaaatgcttttcgcccatcttatgtgactcattagatcataaacttgtaaactcgatgtaaatcaccattgaggagacgtttcttatgtaatatttgggcagaatcataatgtttatgtaacattatgattaacaacagtgaattattattcagtgtaaatgaataaattttaactaaacataaaatcttggataattctataacattaatgttgagagaaattaatgtggtacaagactaaatatcaaataatataatttttaataaataactaaatctaaaacactttcaaatttaaaatttagcctgatctatatacctttttaaatcattgtatatttttagtgttaatgtgagaaaaatattcaaaatttttttttcaattgacatcttagctccaaaattaaaagagcatattttaatgggagctggtttaaaacaatttgacataagttagataacagtttggcaaatgtgtctgtgctcagttttgcttccaaatttggacttttagacttattgtcagcctcagaaagaaataagaagctgtgcagataattaaacatttgccttgggggaattatttgtagttaattaaaaccacacacttcgggtatatattgatacttgcttcactggttattaaatttgaatcatatgttaactacccaggtttctcacttgtccatcaaatgttgcttgtggcaggttcaagaaacaaactttctcataatattccaagccatattgtttaaagctatctcctaattttgagaggaaatgaatggagagaaacagagggagaaatgaaaaggaaacaaacaaagaatagtttattttagactccatctgattcagctctgttggggagttaaaactcaaccaagtgacacaaattcagtagagaacacatttgtaagtaatcaaggtgttgctgtaccacccccagctttctccatggtcacacgcttacaagattagcttatgacttttagatatctttggattgctttcctttcagcagcatgaaaaatatctactagactataagctccatgagggcagagatttggtgttttgtttcctgttggctccccaacatcaagtacagtgtctgggcaggtgtgatggctcacacctataatcccagcactttgggggtatgaggcaggaggatcctttgaggccaggagttcaagaccagtttgggcataattacaaaatcctgcctatacaaaaaattagaaaactaagtgggcatggtggcctgtgcctatggtcctagctactacagaggccagaacaggaggatcgcttgagcccaggagtttgaggttgcagcgagctacggttgcagcactgcatccagcctgggtaacagagcgagaatctgtctaaaaaagtgtctggcatatacttggccattattaaatgtttggaaaatgaatgagacctacttgctgtcttcctgttgatccattcacaggatcattccagtactttttaaagagcctccagggaggcctaaacatttagcaaggagccctttgtagttttgcaatagcccatagtcacagaatccttttagccatgttaaacatggatatgtttaaccatatcctataacaaaaaaagataagtgtacaacgattccatgtttaaatgtgctaagcgagggagggaatgaccttgcagagaccagaaggtctgcattccctctatgctattgttctactgttatggttcccgaggaagatgaacttaattaccactggatttcaaggttctgtatctgactttttcaaggactcaagactcccatatgtgagcaaccacagtaatggaagcattaagaacattaaaattagatagtcctttaatcttcttcattttgccttccttttatgtcctttcccatagttctaagactttccctgatgcaaaaagcctgcttttattttcttatttgttgcaaaaagacatcccagctagctacatctctacctttgtaagctttgagcagatatctcacatagtatggggggaaaaaaagcgcctatttattggcaaacatatgtatttgagtggttatttttaaaacgaataaattctatttttcctcaaacataaatctatcatgttagtgctgaaagctgctctgtttccaagttaaaaatgctgaccaaaggttttgcttgtttgttgttagattttgcaaaggatgaaaatattacaaaaggcggtgaagtgacagatcattctgtgcgtgaccaagatcatcccgatggtaggttgtgaaatcctttattagattttcttttcttctgctgggaaacagaaaaaaaaaaaaaaaaaaaacccacagacttgaatttttctggaaaaatattgaattccaataacactttattagcactgaataccagttgatcagtagctgccatctttagatgacacttttgctttccagaatcctcatcactcattacttttgtgccaggctggcttcatttattttgtttattgttacttgtctgaattctataagcactgggtttgcaaacactgagatgaatgtgttataacaatgagaataaatattttcattgaaaaacatggagaataaatgcaggggattaaatccacatagtcttgggatatcaagaagggagtacataacaaacagaaatgaaacaatctttagaaaaataacagaaaataatttcctaatgtaaaccagttcttccacccaaaacatgacagtacacattatatttataggcaaaggaaaaactcagaacagacatctgcatagcttcatggaatttctgaagataaatgataaagaaaggcttttcaagtgtagtcaaaatcaggtagtgattaaaaccaccagagtcagattagccttaaccttcttcttccacaaccctaaaagctagaagaaaatggagtcacagtttccagagctcaaaagggcacagtttccatagttaatgaagttattatttatacatgaaatcagagcaatattttctcaggaatacaaagattaagaaaacatgccacccaggtaccctttctgaataaactaacagaaggcctgagcaaaaacaataatatagaaaggaaggcaaaactcaagactgaggaaggcacattcgaaagggactatatggtaagagactaattaaatgtacaaaaatgttgaaataattgttctatcaaataattttgaaataacccttcataattaggatgaaaatgtcttacctaaatatatgtctttaactttgaaatttatagtatgtgttgtttgaaaatgagaaaaaagacagactagctttcaataatgaaagtctaaataatttagatcatttctactaccgaagacaactagacaaaaaatacatatatttatatattataaacatataatattatatattatgcgtatatatatatatatatatatatatatatatatatatatatacacacatatacatatggagagagagagagagactgtttaaaggcatcagtgagctaataagatactgaagaactgtaaagctgagctctgggaggcaatgaatctccagatatgtgagcccagaatttgaagctctttttaccttagggcatttgctgattctacagaaggtgtctggagctccattgctgaaaaaggcaatgaccccgataaactctctgttttggggttgaaaccccaaagatacgtaacctagcaggaagaatgaacgagcagtagattggcggtggactgcttcccagcttcaaatcatctcaatcctcacattaggttaagaccagtccagattgctagtcccctcaggcatctaagaaaagcaaatgtaaaatatttactaggagtgaaaaagagtgttacaggcttcaaatcatttatataaataatttgcaaaatataatgtccagcacacacataaaaaataccccaaaaaatgagggaaaaaaggtaacatgaaaaacaaaacaataaggcaagagaagttcatatgagctgaaaatattagttatgaacacaaagtattagataaatatgttgagtatgtataaggagataaagataagattggaaattttagccgagaactagaagttcaaaaccaattttacaatgaaagagtctagaagtaaatgatgctataactgaaattaagaattcaatgaatgaatttatgactgaacatcatattagacacagccgaaagaagatttgtgaactagaagttaggtcagaatatatccaaaattacagatagtaggggaagaaaggaaggcacacactgaagaaagaggaaaagatattaaggatcttatgataaagtctatcacaagtacagttggagtcccagaaaggaaggagagagacaattgggcagaagcaatagttgaagaaatgtggtgagaaatttcccacactgatgaaggacatcatgttccaaaagccctttgaactctaagcagaataaatataaataaataaataaatccacaaccaggcccatcatagtaaataaataaataatagaaataaatataaatattataaataatataaataaatccacaacatgacccatcatagtaaaattcctgaaaaccaaagataaacaaaacatctaaaaagctatcttcaagcacttggactgagagctgacttttcaatatgtataatgaaaataagaagataatacaacaaaatagctgtgaaccaagaattctaaacccagggggaaaagtatgtttcaagaattcaaggttaattaaggacattttagaccaaaaagaaaggcacagttcatcaccagagaattctggtgttctgcaagtagaaagctattaatcccagatagaaggccaaagataaaggaaggaattaagggcaaggtaaatggtagttactggataagtctagataaatattgatggtataaatcaatactgacaatgatgtcttgtggagttaagatatgcataacattaaaatataccacaataatggcatttattggaatgaggtaaattaattttaagtgttctaatgtttttccattaagatgaagagtaaaagtaccaattagtgttgaaactttgtaagtctcagtggcccctgagagtcaggaaatgaggtgagccctgtgattgcccagctggctgcctggagagtttccaggctgtggtacagagaggaggaacccagggagagcccagcaaactctccacgttgaggagacagaggtgagagtcctgggaggccaaggtagctaacgtttgcaaggtagcattctacagagaagagagctccacaaacggaatgctcagaggtctacagaaggaactcctcagtcttcaactgggtaggaacactagaaaagatctgagagagtgataactggagcttacatagggctagaagaagtgcctgttcccaccagcaagactggaaagcctcaacattcataaagaactctgaaggtttttgccttagtagcagagcaaaacaggcaatagactaaatgctcctcatgtcctccccagtagagcttaaaagtgagacttgaaaggatcagaatatttctgagtaacttaactgcattttagaatgaagctcaaaaatatttataaaaattataaatatatctcatacccaacaaagtaaaatcaacaaaattaccaggcatgcaaagaattattgcaagacaactctccatgcatctttcatatttctgcatgttttgtgagcagaggcactgcttgtatctttgaaaaggatcatgtttctcttcaaattaaagagcatacatacttattgtgcattttaaaaggttcagagaatcttgagattctctgatatggtttggctgtgtccccacccaaatctcatcttgaattgtagctcccataatccccacgtgttgtgggagggaccctgtaggaggtaattgaatcacaggggtgggcgttcccatgctgttctcatgatagtgaagaagtctcatgagatctgatcgttttataaaggggagtttccctgcacacactctcttgcctgccaccatgtaagacatgcggttgcacctcccttgccttctgctgtgattatgaggcctccctagccatgtggaactgtgagtccattaaacctctttttctttataaattacctagtcttgggtatttcttcatagcagcatgaaaatagactaatacattctctaagttcaagattcctcctctatgatatcacccactgagtgtgcaggaatcagctggtccacctatggcaccatgtgggaatcaggactcagagaacagacactaatactctggttactgtgatttctctgaataataaactgtcctttatctttgacccagaagtctttgtcttctgtcagcatccatggaactgtggctcaagcagggtaaaatctcagagtcttcatagttcttgacaggaagcaggaaagtatgatgcacaggaaaagaaaagttgataaatggaactcaacccataaatgatgcagatgatagaattaatatgaaagggcatgttaaaagttgttataactctgttccacatatttacaaaattaaaattaggactgaccatgttaattcgagacaaagaagttatagaaagacccaaattgaatttcaaggaattcaaaacacagtgcctgaattaaaaattatacttgatgagaacagtggcagattagatactatagaagaaaagattaatgaacttgaagatgaagcaatagaagctatccaaatgaaaacagaataagtgactgaggggaaaaaaaaagagcatccatgagctatgagacatcttgaagggtggttctaattacaatataaatgaatgtgaatctctgagggtgaatgtgggagaaagggacagaaaaaatatttgaagtaaaagtgattaaaatgtttcaatgtgatgaaattatcaacccacatatgcaagaagttctatgaccccaaagcataagaaacataatgaaaattacacctaagtacatcataatcaatttattcaacaccagcaataaagagaaaaatcacaaaaacaagcagaggaaaatgacaagttacatatagaagacaaagataaagataaatcaggccaggcacagtggcttacgccagtaatcccagcactttggaaggctgagttgggcagatcacttgaggtcaggagttcgagaccagcctggccaacatggtgaaaccccatctctactaaaaatacaaaaattagcaaggcacggtggtgggcacctgtaatcccagctacttgggaggctgagtcaggagaatcacttgaatccaggaggcagaggttgcaatgagcctcctgagctgagacagcaccattgcactccagcctgagtgacagagcaagactctgtcaaaaaagaaaaaaaaaagataaataaaaggtcccaatggaaactagaaactacaatgacatgcaaaaacatgatgaatctcacaaatgtaatattagagaaggtatgaaagcatatattatttattatataatctcatatatcaagttcaaaaagcaggaaaaaaattaacatttagaaaggcttgtttaggtgataaaatgataaagaagacctaggtactgatcactgtgacagtcagggttttgattaaactttggtgattggagaggagatactgccgggagggggccatgagagggctgcctggctggatggttatcataaaaatatatagtttctgtatttgcatttggttatttaattgatatctctatattttgtctgtgtttctatatatttgtcgcaattttataaaattgtctaaaagaggaagaaagaaaaagaggaaatgaggaagggaatgaagaaaggaggaaagaaaagaagcatcagtggcagaggttgtaaaactagattatagctagaagaaggaagagttgcacattagcctgactccataaataccactcaaaaactaaaaatcccagtgttatggattctgacaatatgttacctttcagaatatctctgaaaaattgtacaataatcacaaatagaattaaataataataaaattaaaagaagataccttactttctaaatttcccaaagagatcacatgacagtatactcagcaatgcaaataataacaataactagcagtgtaacaaaagcctcatgtatcaaataagatgacagaaacacaagcaaatgcttataacagtaagtgtaattaggttactttaataagtgtaaaagccactcagattgacttaaactcaataaaaaggtaaagctttaaaagtataaagttagaaaaatgtatatttgagaaaggagcatcaaaagaaaacatgaagaactacttctatttgaaccaatctattcggttagaagtctagcaaaaaaatctccagtgacaaagagttggttatttgatattgataacaatttaaattcctgatgaaatataatagtgatggggctttttgtgtcagatgatatggcaagatacaatacaaataaaaacctgttgaaaatgcaatgaggagttcccagatacaatattattagtcaatgacagaacaaatagactacggatgacatggactgtttgaaaaatgtacttagcagggtagtccttgctataggaatagacaggctgatcaatgaaacagatgaaagagttcagaaacagacccaagtagatctgggatttcagtacatattctggccgacatttcaaagacagatgactcaatcaatggcattaaaacaactagttggccatttgggaaaataaactgaatcccaacctcattcctttcaccaacataaattccagaaggagcagagatgaaacatagaaatgaaactataaaaatactagagtaaaagaaccaaaggttattattcagcactaaaaagaaatgagctatcaaaccatgaaaagacatgtaggaaacttaaatgcatattactaagtgcaaaaagccaatgtgaaaaggctacatattgtatgaatccaattatatgacattctggaaaggcaaaaccatggacacaatgaaaagatcagtggtggccaggagttgtgggggtggggagggatgaataggaggagtacagaggatctttagggcattgaaaatactctgtataatgcagtaatggtagatacatttcattatacattgccaaaacccatagaatgtacagttccaagagtgaaccttaatggaagttatagacttcagtaggagttacatgggatatctctgtaccatcctctcaattttgctgtaaacctaaaaccactctacaaaaatagtatttttaaaaaacaacaaaataaaacaattacaggctgtttttttaactgtgagcacatacttgcagacacaggatggtatgcatatgttatgaaatgcaggcatacacatatctgtaatgtgtgtgcatatgtcagtatattgcataaaagaggaaaataacaaaattgtaatagataaatgttgacataatgagtaaaggttatagtgaaattaaaaatgaaaactagtgggaaaatattctcacccaaatgacaacaaaagagctaatttttttatttgaaaaaaaagtgtgtgtgaaccagtaagaaaaaacataaacaatctaagagcaaaacggacaaaagactccattataattcacaaaagaagatatacagtcattataaatatgaagagatgccctatctctttattatataaataaatgcaaataaaatagtatcttctctttttgaactagataagattaagtggagttgaaagtacacaaaattagtggaaatagggtttccaaacacgctcgcataatattcgtgggagactgaaaggcataacctcctcatcagcaattttgggaaaacctaataaaaggtagaatgttcatactttgatggaaaaattatgcctcagagatttatcctaaactaacacccacccagagtatggagatatttatttactgaaatgttcattgcaatatgatgtttaatggcaaaaaaaaagtgtaaacacctgaaagctcacccataacgtggaatattatgtatcttttaaaaacaagatttccaaattaattgtaatgacagaggatgatgcttactaaaatatgaaataaaaaagcaggactcaaagtgtaaatatgttttgatcccaggatatatttacatatttttgcatatgtctgcatctgtgtgtgtatacacacatacaagagaaatatgacaactcacaatattaaaactggctatcccttagttataaaattatccacaattctcaatgcttatatgcatttttagcgtatccataaggaaattgcatttcttttgtaactacaaggcaaaaaataatttttaaaaataacttacaataggaaagtaagttttattggctctaagagaaaaccaaggatgtctagaagataatcaaattcacactaatctaggcttaacttttgttcttaatctgggatatttttagaaatttttataaaagtacagttttgaatattagcagcaatcaactttcaagtttaacaaaaagacacaatttacatgatttcttcaacacaagcatcaaagaaacagtctttgttcttaagaaaacttgagcatctaataatctgcaagcaataaaattatattgttgttgctattgttcagaaacagtccatttacaaagtgagttcaggtttatcccctagaaatgcttcattctagactgatgtccccagaccaatttttatgcaaattaattaaagctaaagcattagcttgagccaaacttaattaccaaggctccaagaaacaatcatgtgatctatttctaaagaaaagcgaatggatttttggattatctgttctaatggtcccctcccataagtatggctgattgagttcactgtatgaaaaatatatacataaactgtggaattctttgtgttcttttgtttcctcagccaggagggattagggcagaggacagtggggagaattcaactagtccgaatgtgaagagggaaacataaagcttgcccccatggggccaagaaagcaggatggaatgtgaaaggtctgcatgcactgaggagaaaggcagatgggctggaagccctgggaggagtcattaacacacagcaggcctgggtgcggtgcaaggcagtcaggcataccttgtctttgtgcaatacgccaaagcctgcctcgttttcaaagctggacaccttgttttgtttcttcccccatttttaattaactttatttaagaaaaatgagaaaaaaaattctatttcaagaaaagattgtcaaaatatgtaaagcacacaggtgaaacagatcaagagtagagacaggtttagagggcaaggaagagaaatattccaagagatatttgaaatagcactttatcctcaaagtgaagggtcaagccttacaagtcacagaaactccctggtgttcatcaacagactcaggttgccacctcaagcaggcccaccttttcagcagtgccccaggctctattaaatggggacctgctcattcttgattgaattcctctgaaaatttatcaagtggagcactgggaccaggggacacacaggaatacagattttggccttttcccctctctggatgctctactctttcccttcatgatatagacgaagccagatcacaaatagtacgttaaaggtccttgcaatgacctggtgcgatgattaggttcaatggccagttccctatagcaacagtgatagagaatgaagctcactcagtaaacaaacagtgaaggttccctctcagtatcatccacccaataaacaaacgtcaatgtgactggaaacttcatctgaagacatagctatgaacctaggagattatctcgttccacagccttttttcttttcaatagatgatgaaattaaaggtcaaagaggttgtgatttgcctaaaacatccagttatctttattcccattccagggttctctgcaacaaatataatgtgtggagtgcttagtagcatacaagactttaccttgttgttaaaggatgcaagagaaagtaagttatagtccttaataactatttacagaccttgatgagtactctaatacaggtccaattaaatagacattgattgatgacttcttattaaatgggtgctgggcaggaaaatatgaataaaacaaaatttctctcttaatctggtaagagagacaaagacagacacaactacatcacggtgtgatcaggatctggatggtaattaggaaaattcatgtgtatatatctaaagagtcataaagatatacacttaaggtttgtacattttactatatgcaagtagatctcaattttaaaagctaaaaagcaaaataaagacatttccaggcaaaacaaaaagaaaagagggattgtagtcaggtagagctggttatgattcttgaaagcagaactgagatcacagcacttactttccagaggtaatgtgatgattagagattacgtgtgaagtatctagggacagtctggcatttttatgggatcaataatttgcagattcacttacatcttctaggccagtgcttctcaaggtttaacttgcatgcaaatcacatggacatcttgttatacaatgcaggctctgattctgtaggtctgtgatgaggcctgaaattctgcatttttgaaaagctcccaggtaattccagtgttgcttgtccatggaccatacttttgttagggacaagctgccccaggaccacccccctccccaaaaacaatgcagctgacccttactccgaatattctgcagctgcattcctggacccttatctaggcactacagcaaggtcgccagacttgcttacagccctccgggtggcatgggggaggtcatgagaaacgtggataaacctaagttacaccctcttgtaaattcctatattgtaagctggtcacgagatgatatgtggtaaagttaaccgacaaagaaccccagggtctctctccaccatataaacccctcattttgtaagttcagggctgcctccgctgactgtggtggagcagcccagcaggctaataaacttactcgcctgaccttgggtctctctctctctctctctctctctctctctctcgttctttctctcagctaaccttacaactttgagtggcaatggggaagaatgaggatgaatgggttttttcaaaagtggaaaggtcttgatcaagttcaaattttaaaaggcctttctgctatcaaatcacaaaatagaatataggagaagaaaatgaaagatccaagagacagatgatatatccctaaatgaggaaagaaggcaggagactagaaagtgggaaaaccgaaatattttgcagaaccataaagatggcatttcattaaacgtcaggagtgatggaagaaaataatcaaaaacagcttgaggtttttatattcaatgatcaaatagataaacatgctttagttttaattattttattggatccttttgattaaaattgagctcaggaggagtggatatcacacaaaaaacataatttttcccttatccaggtcatgctagcagagaatgaatcaaggggaagtagtatcatgggcagtttaaaaataattgtatcagagaggaaactgtaagatgaggggttatataagtcagctttgctgcagtaacaaataaccccaacagtttcactgggggctcaacaacaaaggctggttgtgtctctacttagcccgggttggctgtgttccacatgctttccattcaggatctagacgaaggaacatggtttattaggagcaaaagagctgcaggcaacatacaatggatcttaaggcttctgcttggttgcagtacacatgatgtctgttccagtgccatttctaaacaagtcacatgaacaggcctgtgtcaatgtggtgggaacatacacttgtcccacaagggctgctgcgtgtcacattgtcacagacagggaaatataatcctcttttaggacgaagtagagacaagttgaaaccataatgccaccacagggatggactcaggcaaagagtccaagctcctctgaatctgctttgcacctataaccaaccctagctctagaatgttttttaaaaaattccatagttaagtatcctcagcacaaaatctttcattagcccgaggcaaaatggccagatttcaatttcctctcttaatgagcacttaaatgttttaaatgctacaggggagggtaggaggagaagccaaggggtgtggaagaaaaaccattactagataatcaacctaaaagtaatcaagagttggctgaattctctcctgacctttgctgtatttagtatgtgtcctaagagaatggttgagctgtagcaggacgagccgcagacaaaacttctcagacaccaagttgtagaaggaagggctttattcagctgggagcatcgacaagctactgccttaaaatccgagctccccgaatgcacaatttctgtcccttttaagggctcacaacactaaagatttcacatgaaagggtcgtgattgatttgagcaagcagggggtacgtggcaggggctgcatgcaccggtggtcagagtgaaacagaacagggcagagagtttcacaatagtcttctatacaatgtctggaatctatgaataacatcggtttctaagttatgagttgatttttaactactgggtttaggccaggcaggcccaggcctggtttcgggcctggtgcagggctgcctgtctttgattttacttccttgtttttttcttaaaacaggtactgagtataaaacaatataaagcgatatgggagggtctctctcttccctcatttcccccttttgagactctcactttttcttagtgggagttctcactcttatttttgctacttattttttttgttcaatagattgatagtgattcatatagtacacttgtgctgaagcattttggtgaactaaggtagcgatgaagattttttatcatttaaagaagcacaggtagcaaacaagggagcagtaagcaggtttttattactattataactcctattataagagttttaagtcctcttagtgctgggaaccaccttctaaacatggctttagggttgaatctgtgctacacttgtacaggcacatgtgtcagttttgtcatatttttaactatgtctttaactacttgcctttgattatctatgtgtagacagtaattagtaaggttaaatttcttatagacttctcttttagctgctagcaagtacttgagagctaatccattttgatagatagcatttcttatctgagttttttgccgggccagaatagtaaaggcttgaccggttttattagtgatgatttctaaaacagcttgcaaccgtatgactctgttgagcaggtaaatgggggtccagtattcctatgagccatcttgtgtctaagtggcaggcctatagtattgtataattttgtttttagtgggccatttatcatctttttaattacttatggctatgcttcgttttccgcaggaagcatagacagggaatgcctaggagttcgcctgtttttatgggcagtaaaaagaaagatggtttaatggtgccaataacacaactacctgtccactggtcaggcagcttagcgtaggctctatgtctacatatccagtataacctggtagggtcaggctagtcctggtggaattctgggtgggcctagacagtctgcaaccttggaaatttactgaatagatctctttctgtgtaattggaactccaccatgtaactgttttttgcggtatcgttatacagtttttgctttagacaactaagtcatcttacagaatgagtgaattcttttcctgtttttgttgttgttgttgttgttgtttagctatgcaataattgagacttttagaacttagaaatgatcagggtgattcttttgggctgagaatccatcaggaactgggtctgtaggcactaattctcgggcttcttatggccattgatctcttattacagtttttctacaaacataacatgaagtgatatttagagactgggttacatgcccagctaattgcaaaaaacaaatttttagtctttcctggaatcttaggtactggcacatttagttcatcctagaaagtctgaaatactggttctggagagcgtctttgaacctcctttcttattaggctgtttatgctagggtctagtctttttctatcaatgcctaatgatacatattgtttttttaattttattttgggtctgaggggtttgtgatgactaattctaaagggttacagttctcactcgtgcaggaggggctgacttttcttttttgaagcctaacaggatctttttaatcttctgttcaagtagcctaaatgacacaagaccagtattgacacattttacataaatatgattcttgacagacatactttttttttttgctgtgtaattttttttccctcatcagagaaccgcatcttattctatgctgcttactatcaatagcagcacaagcgtcaaattttaaggttacatttttggggacctctctttcttctgttctagctattactttacttgtgtcacctagaaaaggactagtccttaatcttactttaaagactgtgatcatggggggttcagaggggtcatagcacacatcgggcaggtcacttcctggattacatactttgtgctgagtgttattgtacaaacaagttctttttggagttcctaggcatttataataactataaaataataggactgtagcaatcttttgtctcacttcagtgatttgatgtatatactgggaacagttctcagtctgaggaaggtcagttgaagtctttactgtacaagtctaaattttaaggaaaatgagtcctgcaatgagtttcttcatgcttcggccatgtgtggaccagtcagcttctgagtgtgactggagcggggcttgtcgtctttttcagagtcactttgcaggggtgggtgaagctgctcctatccacgtacagctcctagtctactgatgtttaagggtggtcttggaggttgggcctactagagtaaactgagtctaacacctctacacagtttatgttaaactgggctctctgataccaggagtaaggtggcggggttagggtgttgcaaacttcaatggttatgtagggatttttacagagcaagatttggtatctagttagtctagcattcattagctaatggtgtcctttggtatttattaaaatcaccacagcatggcaggactttatgtttaggttttgcctaagagttagcttatctgcttcttgtgctaacagggccgttgctaccagggcgcttggacgtgggggccatttggaaacctcgtctagttgttttgagagataggccactggccttggccagggccttacagtctgggttaaaacttcaactgccattttttctctttctgacatatagagtgtaaagagttttgtcaggtcaggtagcctcagggctggggccaacatgagtttttctttttaactcatgaaaagctcgttgctgttggttgtaatagatgtagtttatctaatctacatttttattgactgtcatctactaaaatattgacttaaatcctgtaactatttgatttcaagctttaaattgatctggtattccttgtggggctccaattgcatctaaatagatgtgagagttgaaagacctataaggggcttctctggctttacgatgtcttattttttgtttttcctctggttgatgaaatgccagggtgaaagggatagccaaatggactaaagcacaagtgccactctagttattcagcagagtgcccagtaaaggtccaccacaataccaccacacatctgcttggggatgaacaacggctgactgattgataagctcttgaaaattcttaagcttactgcatcccttcaggtctccaaggaatgctaagtctcctccttgctgtgagagacacaaagtgaacttagtgttgggagacagaagctggatggacctcaggtgctgatctgcagggactttgggatatagcagagagagcttggcatgatttattactccaggctgtagaatctcagaaaagagctaccacgcagcctacgcctggtcgactggaggaccaccttagtggaagggggacaattagggcctctggcctgccatgtgcacaatcataacaattgcttttgtttaatgtgcagatggaatatttgatccatttcaaccaggcatttgcattcttggtatgctgtcttaattgccaaagtttgttttaagtctttaacttctatgatcctttagtaaaatgaatgtttcctttaacacctatttttattagtttttagactaaagaaagctaaatactattttatatttaataatgtttcttgtatgatttttatagtagataagttaaattttacttttatattagtgtgttattaatgttaaacttaattttaataaaaccttgtagacatatttatctaattttttatgtttgaccataaggtaagattttatagactttttttaactttttataatttttgttaaagagcaggttgatgctttaagaaaaacctgttgcatttttactttaatgtccagttcacagaaaaactgggtgatatctttttaactttagctaatatgtttacacacagaattttctttacaattaacgttttaaaacttgcttaaatttttaaaacaataatttttttaacttttaatgtaggtaaaaatccacatttttatgtccctttataatttttttactaaaggtatattttacttttcttatacaccttgcacataaactgtttctttaatggtactcaggaggccttattacttttaaattatacaacattttttgcataaatttttttataacattttttctttcacgacttttgcagacaatttttcaacatgtcttaactttttgacttattacatttttttctttaaacaactagttaatttatttcaggacaagaatttactatataacactctttttacataaattttgcctcccccccccgcccttctcttttttaaagcgaactttctttatgtctttggactagactgtctaaggccacaagattagaagttactataatacatgttacactgttaacttttagcaaacttcacttttgttgaaaaccttgtaagtttgggatttcaattatcctttgctattaataagatcttgtttagtctgaattaacttagaattggtatagatggcctctttttctctctgctggtctttccttgcctctgccagccacttatgctgctgttctcttaactgctgttggggggaagggggtctaaaactagctgtaactgtctatgtacggaaactggcctgggtgccttggcttacaggttaccttgtgccatacttttgaaacaagggacctgtccaggcttccttctgatggccaacctacctctaatgctggccagtctatttcacacaaagttctaagttttcctggtgtcacagtaacaccgtaatctcctttaaattctttcttgaaattttttaacatagttcctagtagggtgggcttacttacaccggacctgtttttgtttttgttttttctcctgagacaaaataccatgctcacaccacacacactcaccacaagacaaagaacgggtatggagggcacacacacacttttaccatttatagtaagccaaaatcacgaaattcaaaatccgagttccaaaagattcaagacaagtcaaaaccaaaaccaaagtatctagcaattcaagtcaagtcaaaaccagaacaaaagtgccaatgcaggcacactgtgggtgatcaggccactcttccactcagatggagtggggcaagttccaaagactagtcttaccaagtttcagatgtccggactccaagtgccagttccttcccagtgttcagccactgtgttaatcctccacgggggcctgctatgcgctgctctggcaaggcgttccactggggcaatttcctacccgggagtgctctttggatcctgtcactcaggctggccggagtcccccgcaggatgctccacagggcaggcctaagccgcctaaggggctgcctcggctgtccatcagttacctcgtttccccgtcagggaaccaagaaacgtagcaggattagccgcagacaaaacttctcagacaccgagttgtagaaggaagggctttattcagctgggagcatcggcaagctactgccttaaaatccgagctccccaaatgcacaatttctgtcccttttaagggctcacagcactaaagatttcacatgaaagggtcgtgattgatttgagcaagcagggggtacgtgacaggggctgcatgcgccggtggtcagagtgaaacagaacagggcagagagtttcacaatagtcttctatacaatgtctggaatctatgaataacatcggtttctaagttatgagttgatttttaactactgggtttaggccaggcaggcccaggcctggtttcggggctggtgccgggctgcctgtctttggttttacttccttgtttttctctcaaaacaggtaccgagtataaaacaatataaagcgatacgggagggtctctctcttccctcagagctgttatccccccagttcccttgtgcccacattactcaagttttttatgctctgttgatggaaaaatgaaagtgcaagtagtgttttcattttctaggaatcctcactatgggaaatatttgtatcttaaaaggaaattaaatgtagttaacccatacagcccagaaattattgtaaaatttgaaaatttccaggttgtgtcctctatccatatcctgtgcattcataagctaagtaagtatgccaattttgcatcagtttccaaaaaaaagatttttttcctaaattatcaggatatttctcagaaaataattgatataaatctgatgattagaaaaattgtatctttgccctttggtttcaaaactgttctctatctctccatgcatgattaaagcacggtttctgaaggtcaggaataaagctacggtcatgcatatcacatttcttttatttttcaatcactgttttgaacaggacaagagaatgattcaacgaagaatgaaataaaaattgaaacagaatcgcagagctcatatatggaaacagaaggtactgaaaccaaaatatattgttatcagagaatgagatgaaactgtgaatcatgacttctatatatacctgtgtgtgtgcgtggtgtgtgtgtgtgttttaggcaatgattactggaggatagcaatagtgttcaacttggtgtacctattgaaacttgaagggggaaaaaagaactctaactttctataccatagtcacagtattctctcaatgattccaactaaaacaaccctgagtgtccatctgtctcattctatttagaactttcatcaaaccaagaagatgccgtgattgtggagcaaccagaagtgattccattaacagaggaccaagaagaaaaagaaggtgaaaaaggtaggactgctcttaaattaacccatcaagaatggagagtttctttggattcctgcctagaattcaaccatcaaagttattctcatgcaattacagtttgtaaagggggaaaacgaacatttccttaaccccaaatctccgtttgaaagtagagtaaaatctagaagtagcaaaagaaaatactcggaagacttatagcaattacatatagcataaagatgtttttgttattcatttagattcaatttaaatttttaaaattacagtattgagaaagcctataagaaatcaaaactatggactagagggataaagttcatacaaaatctgaaatggctttagagcaaatagactggcctttttgtattgatttcatctgtcttccttagtatagtagtgatgaaagaaacaatttatgtaaaatatgcatgttatatgaacctaaattgcaatcttgcttgctaatattaggatgcaatcatattgaatactgttttaaaaaaagtgagcattataatgatttctgaaaactcaagaggaatgaacactccttaaatattaaagcagcatttggggcaaaaagccaatgtattggagtgaagatagaaatatttttaaaaatgtgtttaaaaaaactattctggttaatttagtgttaactgaagaacttaaagaattcaatttttaaatataaagcaatctcttaaaagaagctaataaaataatttttgttacagtatatcataaatcatactgctcttaaataaatatgtatttgcaaagcagttgcagagtaataacttgacaggccttgtttatagaacacagtgatcaattttgtttccaaattaaaactcagacatgatctcaattgtaaaatcaggtcaatagcaactacagcttccaaattatgaactcttcttggcaggggcattgacagtttaattgctaaaccatgttagagattttgacacttttaaaatgttgactgcatttacagtacaatattcttccatgtctatgcctctaataagcttttcgctattgcaaatcctagttcagactcacgactccactttcctgttaagtcaaataaagggtatattcaaagttatttcatgtctaatattgataactgagaattgaaacaacccttactcagaatcagatatatggtattgctctcctcaattgtagtttaaaaatgtgaaatagacaatgctgtgcgtgttagcttaatttctctgtagcagaaattgttggctctgtttattgcatttcaagaaatgcaaatggtaaagaggaaaatcaaacagctgtacgttttcctcttttgacttgacctataagaaaaaagctggcattcggcacattgacatgtttcccttctcccagagccttcccaagcattgaacactactctgatgactgaagaattaaatatccacctttcctctcttccttgtaaatatgccaatctttttctgataatggtggaatagcatgtgggaaaaaagcaaggtgaaattctgctacttgcttttagcaacgatgaggttgaatttctttattaaaatttgacttttcactgtaagatgactaatgctggtagtcttgaattaaccacattttctcttcccatctttatcatagatatttcacttggtcctgccttgaatatttctggtgtttaaatttgaaataattttaagtgcatcacatttgtcatcttatactttgcatccaagtgaaaagtactcataggaaaaggaggcaatgtagattcatggtgctctgcagtagctctgctccaccattgacaagctgggtgactttggacaagttacttaacctatctgcttcaggttcttcatctgtaagatgatgatggcaaaagtacctgtcacatatagttatggtgcaaatttaataagtaaaacgtgcaaagcaattaaaacaatgcatgacacatagaatgcactccataagtatttagtatttatcataatttgatacattgatgacaaagtcaagaaaatccacatgtgatttccccaagtccatttatcattcttcttcactattttgaatctgtagaaagtcacatattttacattatccttcaacaacaacaactggttctatccatttggttggcagcaccatctcaggccagcagttttgatatggtctaaactctttacattgctgcgtattttattctaaagagataaaacaactaatagaaggaagccaggtggaaggcatttctctccattcataaacacttccttgtttgtcagtatctcaatcttccatttgagaaataaacacaaccataacttctatttttttaaaaaagaaaccattgagctgttgatagatccacaaaagaaaactagtaaataaattcaaagtagcaattttttttactttctttttatttagttattaaaaagtcttgtttgaaaacatttcgaggctatagctccagattttgtattcacaaaatagtgtcttaatggaaagttgtacatatgtattaggaattatctgtaaacaaaacaaatgagtattttattacatttgtaaagatattctttatagctttagaagtattccttctcttttattttaagactccttttaaggaggcagaaagtgattcctttaaaaaaaaaaaaatccagaccaggaaaaatatataacctttttctctcttttttgtagcattttataagattagaaaatgtagataatcttcaggatacatcttctatggctcccaggtatatgggcacagatgttgcaacattaagttttgaagttagttctattaaaatatggattttgaaaagaaggaaaaatattcagcagaagttcatgctgataaaattacacaatagcacagtggacatgtccctgggagacctgaaatacaaaaatttcaacaggcagaaagtgaggtttcacatatggcagcttttctgatatagccacgttgcctcttcctaaatgagcccagttttatgatttcccagcaggacctgcaacacatatgaaatccagtcgaataacgtcatttaggttaataaccaaataggaaagtaatattatagaagatctcctctgaaaaggatctcatgttttagtataaaatataaagtcagcattaaaacatctttcttacatttgttatttgggcaaatttagaaatatttgacataaaatcttaactatatcaacatcgagttattatttcacaaaattttcatatatgttttattatgatatatattggatatttttttctctaagtgttaaacagaatgaatacatttggtcccaataatttttcatatcaattaataagtgtagtgtggaatagtaatcctttgtctgtttacctaagattgagcaaaatgttgacagagacttaaagtatactatggtttaatgttttcttagaaaaagatgcatatgggcaggcatgcaagtaaagagttaagtgcaagccagtgacaagtgtaaagtatcatgcccttaggttcatgttttgaaccaagcatggtctgaccagcatgaccttgagacatagtgtacagacagccatggcttctagccctgcctgtgtgattcctggcaatccttaaacttcgaagaatcccagtctctagggtaataatgaggggcatgaactcaaaattgcaattataaggttctccagttttataaattttcttagaaggccaactctgaagaaccacattcttggtgaaacaagagcgatggcatgggagccaatggtcagccatgctgaaagctgaaatcataggttttcctcagttttagttattgtaccctattgataaaaatatagaggtgccctaggccaggcaaaaaaaaatcagccaaatatattaggacttaccaatgattggacagctaattattccctaaagatactttaaagggggaggggaatgccttttagctcaaggtgggtttacacagaaactctgctcagaaccaagctggatttccatcaccatctttcttagtccatgtgggaaacatctttttttgcaactcctctggctacgatttcatcttttagtgaacacatagcaagtgagggactttctcttctgcttctaccaatcaaatccattagaggtttatctcatctacaaagcacccctgtatagcccttggtgttttccatttctcataggattcttacatcactggcagagccctttcttctctccttgaaaagcagagcttgcactagcagtgttgccatacacagaatacctgtgtattacacaatagcacagtggacatgtccctgggaatagaatacctaacacttgggccatcatatacagactgtgttcttggctataaagaatcattgctcaggcatatttttgattcatgcaaaatactatatacacttgcatgttgagtaacaaacttactggaacattctaccttcagaaagtctttgtatctcttttcaaatgaagtcaagtttagtaatactatattattcatattagcagcacaatcatttagttttctagggcagttttaccatttgttttcttcttttttaataatattttgaatctgaaattcaacaaccaaaattatgttttaggatatcagttaaattaaaaatgctggtctctgtttgggttttatgaatattttagtatctaatgaaattcctcatattggttaagtaccttgaacataaaaattataaagttttaagctaaattgtttaggttttctacatgtctctatgtatgcaatgtaaacatatagaaccagttcattcaaattatgctgcataactgacctataattttaaagttaaaaaacatagaagaataaaaggtatattcactgcactttgtcttgcactttgatttcttgctacaataatgatgttggtgtggatagcatatatgcatgtgtatatgcgtaaagttagattatacgtgtataaagttcacatgtatctacccagtaagaaagttatgcaggcctcttgagtttgttcaaatcctctagcttgctgcaatcatcttgtctttaaagatttagaaaaaaattgccctgaaactccatttttcatgttaggagaaatctatcattccttccaatatctctgagaattctttggtgtcaggtttatttcttctaatctcaggctccaagctcctgcctctggttctcacttcagcctttgccattccttttttcgtaagctgtctctagttctcactatggctcccactcagacaccaccaccacctctcatcccttcactccgtgcagtaccacaaactcaaggatgtgtgtaggtttaagtgaatgttagggtcaatacttgtaattaacttgtgcttgcccatctggggaattttaagagaccatctcttctaagtctccagcatccggctacatcctgtatcgccctttgtcttctttgatttcttgcacttcctaacactccagtttcatttacagtttaactttgtatcatgcctgtgtccttctggtcttgccctgaggtgtatgattctacaaccatgtggcttatcaaaccacgtggtttatcaaaataatttgcagaaacaaaagatgactcacataagtggaattctgtctttaaatattgagctttttactcctctctgccgaattagagttctacaactcaactctctgtgcataaagtacctgaatttttttcacaactaataaaaagattaatgtgtaccttcatctaaacataatattgttttacatatatgatcctgaaatacttcagaaaattaaccttctctaaagatagtgagtataattattaacatttgttccttatatttaacttccttccaaagacattatataatgctaaattgaaattttcagaaagataaaattatggctgtcatacaactataaaatcaatacaagtaaaatattttatttaaatgattaactagtaagggaatcattaagatgttaaaactggttcaaaggagaatttgaagagtgtgtgtgtgtgtgtgtgtgtgtgtgtgtgtgtgtataaaatccatctatcatctatacagtgacattttagtcaacaacagatcgtatatgtcccggtggtcccataagattatgatgctacatttttactgtaccttttctatgtttagttatgttttgacatacaaatacttaccattgtattataattatctacagtcttcagcacagtaacatgctgtatgggtttataacctaagagcaatagactacaccatataaccttggtatgtagtaggctataccatcgaggtttgtgtaagtacactctatgatgtttgcatcatgaaatcacctagcaacatatttctcagaatgtatcttcaccttaagcaatacatcactgtatattgattaggaattatggctatatggatatacacatggatccataatacacacacattcagaaacactgaatatatccatacaatcacacacaattcaggagcactgaaaatttccaaactggctaatatcatacaggacaatacaacatatcctttccttctatcagacaaaattcgttttcactgatatgaacaaatctcattttcattactacaagttttctacatgttaccttctacctgtacagatgtgtaaaatagtctagtgaatagaaagctggtcaaaggaatacaccctcatagaaccagataatcccacagagggattatctggagggtgacacccaaccttccaccccagtgacacccagggatctcttttatccattgtcaagtcttagacaatttttcttgacagtatactgaaggcaaaactgccctttttttaacctgtttaccacctcacttatttgttattgttcactatttgatacatttgatagacagtgataaaatactagggtagtatcagagtagggcagtagcttccaacttcatctgaggttgtagtttacttgctattgttttatggcaagtactgctattctacattttatatagttgtacacacactgtagatgaagttgtacttctaagatgcctcagttgtgagatgtgccattattttacatattattaataaattttctaaaatctggcttattaaagtaagacacaataattttgtatcatttaggatttttattttatgtgtttaaaaaaactcttcgaacaagatgtagaacgttttcatatatcactcttgagaatacataaaaagaaaatgttaggctaaaggaattagttatgatactgctaaaacttcatcaggttcagggtcctacttctaaatcactttcagtcaaagtcatcaatatctgtttttattacacaatattgtcctctgccaatgtctttgatggttcagaacttaagagaattcataaagaatttaaaactcattggcttgtaagtctcttaagacttaagtctgtcttgctatcatatagagagttagcctattttttcttttttgcttctacttagaggcagttaaaacactcctgactcaccacctccctccatatttattatttttcagagattttcacctaagtcattgaaactcattctgcaagtttgagtacttttggttttgatgctaatgcatatatgggtatgataaattgtatcatcgtgtcctgaccaacaaaaattttgtaacaattcactgtttcaaagatgttaagatgtgaaagcagtgtactttatattaggaaatatagtattatttatttcacagtgaaaactactacactgagactagaaaatggaaacttgattacaagtgatataattgagtatatttgatatactcaattgatatataattgagttattttttttctactaactctaatgactagcagtgggatccttactagcacatcagtgcaccctactgcacattgtataactaagaaagtcataaatggttttattcatacattccacaaatgcttttaatgcacatgtaatatgtgccagaaattatatagacactatcactgaaactgaggaaaacagacaaagccactgctgggctcatcccaagcatagagctcaggatgtaagtctttttttttttttaactttttattttattattattattttttttggagatggagtctcgctctgtcacccaggctggagtgcagtggcgcgatctgggctcactgcaagctccgcctcccaggttcacgccattctcctgcctcagcctcctgagtagctgggactacaggcgcccgccaccgtgcccggctaatttttttgtatttttagtagagacagggtttcaccgtgttagccaggatggtctcgatctcctgacctcatgatctgcctgcctcggcctcccaaagtgctgggattacaggcatgagccactatgcccggccttttttttttttttttttttaactttttaagattcctcatataaatgagatcacacagtgtttgtctgtgtcttatttcactcagcataatgccctcaagtttcatccatgttgtcacaaatggcaggatttccttctttttatggctgagtaatattccattatacatatatattccattgtatacatattatgtatacaaatgtgaggtgtgtgtgtgtgtgtgtgtatgtgtgtgtcacatttttctctatttatgcatctatgggcacttaggttgtttctgtgtcctggatattatgaataatgctgcaatgaacacgagagtgcagacatcaagctactgatttctcttccttcagatatgtaaccagaagtgggatggctggatcatttggtaattctatttttaattttttgtggaatctcatactattttccataatgctgtactaatttacatttccattaacagtgtaaaaggttcccttttttccacaccctcaccaacacttgttagttctttcttgcctttttaatgaaactctccctaacaagtgtaaggtcatatctcattgtgattttgatttccaattccctgatgattagtaatgttcagcaccttatctcatatctattgcccatttataagtcttctttggaaaaatgtctactgaggtctcggtatcaacataatgctggccccataaaatgaatttggaagtcttcccttctcttcagtttttttgaaagagtttgagtaagattgtcattaattcttctttaaatgtttggtataattcaccagtgaattaacctggtcctgggcttttctttgttgagaggtttttgattactgactcaaactcttcattgatttttggtttaatcagattttcttttttaaatcaggtaatctgttttattataattcttatatgtttaggatactaaccccttatcatataaatggtttacaaatattttctcccattttatatgttgccttttcaccttgttgattatttccttttctgtttagaagctttttagtttaatgaatatctgtttatttatttttgcttttttcacttgtgcttttgatgtcatgtccaaaaaatcattaccaagaccaacattgagaagttttttcctatgtcttttatgtgagttttatggtttcaggtcttacatttaagtttttaatctatttcaagttaatttctgtgagtggtataagacagaagtataattttattcttttctatgtgggtatccagttttcccagcatcagttatgaaagagactatcctttcactgttgtgtgttcttgacatccttgtcaagtattaattgactttatatgcatgggtttatttccgggattctcaattctgttctattggtctgtgtgtctgttgttgtgccagtaccatactgttttgattactatagctttgaaatgtagtttgaaatcagtaagtgtgatgtctctggcttttttcctctttctcaagattgctttgactatttgggatattttgtgtttccatatgagtgttaggattgttttctttttttatgtgaaaaatgcccttgaaattgtgatagggattacgttgaatgtatagatcgatttaggtatttgggcattttaacaacattaattcttttgattcataagtatggaatatctttacatttatttgtgtcttattcaattttcccatcaatattttacagttttcagtgtacagatttttcactgccttggttatatatattcctaagtattttattatttctgatgctactataaatggatagttttctttatttgattttcagatattcattgctagtgtatagaaatgcacctgatttttctgttgatttcgaattcggcaagtttaatgaatttattagttttaacagttttttgttggtgtctgtaaggtttttaataagactatgtcatctataaacagagaaaatcataattcttcctttctgatttgaatggcttttatttctttttcttgcttaattgctttgtttaggacttctagttctatgttgcatagaagtggtgagtaggggcatctttgtcttgttcttgaccttagaggaaaagccttcagctttttaccattgagtatgatgacagctgtgggcttgtcatatatggcctttattatgttggagtacattcctcttacactcaaattgttgagtgttttttttcctaatcatgaaagaatggttaattttgtcagatgctttttctgcatatattcagatgatcataagattttcatccttcattttgttaatgtggtatatcagatttattgatttccatatgttgaaccatccttgaattccaggtgtaaatccctccatccttctaaactgctgttgaatttgctagtaatttgttgaaatgttttctatctattttcatcaagggtattggcctttaatttttatttcttgtagtgtttctatctagctttggtatcaaggtaatgctggcctcataaaatgaatttggaaatgttcccttctcttcaatttgtttggaagagtttaggtaaaattggcattaattcttctttaaatgtttggtagaattcaccaatgaagtaatctggttgtgggcttttctttattgggaggttttcgattactattttgatctctttactcattactagtctattcagatattctgtttcttcgtgattcagccatgttagattgtatgcttctagcaatttattcatttcttttatgttatcccatttgttggcatataattgttcatagcagtctcttatgaacccttgtatttctttggcatcacttgtgacatcactgtttcatttatagttttatttatttgagttctctcttttttttttttttttttgagacggagtcttgctctgtcccccaggctggagtgcagtggtgtgatcttggctcactgcaagctccgcctcctgggttcatgccattctcctgcctcagcctcccaagtggctgggactacaggcacccgccaccaagcctggctaattttttgtatttttagtacagatagggtttcaccgtgttagccaggatggtctcaacctcctgatctcgtgatctgcccgtctcggcctcccaaagtgctgggattacaggcatgagccaccacacccagctgagtcctcttttttctttagtcagctaaaagtttgtaaattttgttaattttttttaaaaacctcatttttgttcatcctttttattgtttttctattctctatttcattagagatcagagatttcatgagagattagagatttcagtcctaaatttttaccatttttttcttctactaatttgggctttatttcttttttagttccttaaagtgtaaagttaggctatttgatatctttttttcttaatgtaggcattcataactataaactttctttttagaactgcttttgctgcatcttgtaagttttgttatatggtgtttccatttttgtttgtctcaagattctttcaattttgtgatttcttttttgacctattggttgttcaggactgtgttatttaatttccatatatttgtgaattttccaaaattcttcctgttattgttttttagttttatatgtttgtgatgagaaaaaatacttgacatgatttcaatgaacttaagatttgctttatggcctaacatatgatctatcctagggaatgttctgtgtgcgcttgaaaagaatatgtattttgcagttattgaatggaatgttaggtgtctgttaggttcattcactctataatgttgttcaaatctgttgtttctttattgattttctttctgggtgacctatctatcattgaagtggagtattaaagtcccctactattattgtattgctatttatttctcctctcaattctattagtatttgctttatatatttagatgctctgatgtttggtggataaatacatacaattgtacatcttcttgataaattgattcctttattattacaatgaccttttctagtctcttgtgactattttttagttaaggtctattttgtctagtgtaagtatagccaccttgctctcttctggcagcccaagctgtcaataaaagctagaatggtggtgcagaattattaaagtagaagtgatagggtgaaaacccagggttagaatgagagcatgcatagcctttctggccatgccacggagtgtggagactcactgccaactagaatgcagacaaatgatttgattcatcattgattcctttgttttccacgtcattttacagactaaagtcagtaagaacccaaaattattacagttatcgcactctgtcagcctttggtattgaattcatatgggattatatgaaataaataaagttttcttagaacatgcaaaaaatctagaacatttactacctggccctttatagaaaaatactgctgagccccagtctatttatataaagcccaatgttaccctgaatgtgaactccctcatttcatacaataactctcaaattatgaatctttgtcaacacacacagacatatacgcatccacttgagatgtttccatggaaacatggatttattctcacaatgccatgcccttctgtaagcatagtctttgctgtgtttgcatccctccccaacctgatagattggaagaaaatggtgccctctgatgtcagcctcccttaaaggggccccaaggtagcatgtcttgggcctcaagtatttcaggccataagtggaatggagtaatccctacaaccctgtactcagaagcctattaccttactttgacttggctttatctggtcagtctcattttgtttggctctttctctcttagaataatagtttaagtttcctttaagtacagttttctgccactgtacgtagagttcataaagtaaagaaggttctacctactttcccgcgaactgatctttgccttctcttagtatactacaagtcagacttgcattatgactgtgaactaaagatcctaatcataaacattcagacagaaagaccatttcagtgacagaacaagtgcaagtctaatctataatgtatgtggagtagatagtgattgtaataatatggatgtttatgtatacattttttgtaaaaaccaaaatattgtcaacccaaaatttaatttgtacatttatacagtggttggaatagaggctcaacatttacataaaaggctttattttagtaaacgaatggccacaaactattatgtgataggttttggatgacatacttactgcatttggatttagactcaaccacttcacatcaggtgcaagaacttccagatcctactgattgtgcaaaagatatatccattttgatttggatttcaaatgtaagtgctgcttttctctctgcttcagaaggaaactcaatttcttttcattgctctttatacatcaggtgccttcatttcagcacagtatgtaaaaagcaggtggtataaggagtactttgaatgttaattatttttttcatcgatttcaccatgaggatttacctttcaatgtgtttttataatcaagatggaaacaattagggaacttgctgtttgaatgtttcactacatttattttatgacatctgctgcaatgattaagaaaaaagagaaaaagggaggcaagcatttgaacaatagcaaggggtttggattgattgtatgtgattgctttatttcattgtgaaacttcaaaggaaatgttgtcgagatgaatcagtcacgtttctaaccaataatatcatcccattgtttgaatttacattttttacatagaagcacatgagttcatttttcagagatgttgtcatagtttattagccttcattttaaattgaacctaattttataaactgcagagaaatggggaaaaagggaaaaatagatatttcttctgaaagaaaaatttcaaaggagaattttttttccatttgtcatatttggtttgttcctcaaactttaaacataatttacttcatctgttcttttgtttcatatacttacaaacatagttcataaagtaaaaatattcaggattaagaggttcatttttcgtaacgtattaagatatggtcatataatttcaatgtaagggagtacttttcaaaattaatatagtcaatattttacactttgttacattactcttatttttccattaacaaaatattataggaaaccttatgcaatgagaaactaaaacttgcgtaacatctagtaattagataggataaatactagacaagataaatatagttatataatataatgtgtcttatatatatatatatacatgtgtgtatatacataaatatgtatatttcatatctccaaagtctacctgtttaagagatactcaataagtagatctcaaagttatctctgacaatacaggaacatatccagaagatatcttactattttatcacctatagtaaggaataaaaattttagtccagtcaccaaataaaatgtggggttgaagagaacattaagggttactgtttttaattgcctggagtagacagaacaatggtcccccaaaggtgtcctcatcctaatcccaggaacctttccatgtgttacattacacaggaaaagagacgatgctgatgtaattaagttggggggcttgaaaagagaagaatgtcctggagtgtccaggtgagcccagtgtaatcacaagtatatctataagcaaatagggaagcaggagagtcagtgagagggaaggagatgcgttggtagaggcagaggagagaccacaagagagcgattgagatttgaacatgctatgctgctggctttgaagatggaggaaggaggcgatgaaacaaggaatacaggtggcctctagaaaccgtagtaggtaatcaaacagatttttccccagagcctcaagaaggaacatagctcagctgacaccttgacgctagcctcataagacccatttcagacatctggcctccagaactgtaagaaaatcagtttgcattgtgtgaagccactaagtaatttactgcagcaagtagaaactagtacattacctctaccgctactctagtatttcgcatccaaatttagaacactccttttgaaaatcctagactttcccactgtcttcttttgggtggtgatgaggcaaagatgattgacagatgggtaggcaaacagagtaccctccttctgagtctcctcagttgcactttcaatgatgtttattaatttaaaaactatccagcatgaatatgtacaaggcactgggctcggggctggggcacaaacaaaaacaaaatagaaaacccacccacccacccacacacacacacacacacacacacacacacacacacacaaacaatctctaccctcaaggggaagctaagccctcagtagtgaaaacagattcatctggatggaagttcttaaaatgtgttccttggaccagtagcttcagcatcatctaggaacttgctaaaagtgcaaattcctgagctccccttcgagtatatttcttatacaataattgctgtggtttggtttctctattagaatattaggactttatgaaagtttgaaccctgtgtgtgtgtgtgtgtgtgcatctcttgtgttatatgtaggaattcacatttatatatcctagagacaagacagtgaaaacaatagaaagcaaataagcagagtttggaggctcatggtccagacttcctggcaacaggctgcgtaacactgcttagtctgccagtaaccctagctccagcaggtgtagcccaaagtgagggcagaggctttccaagttgaatgtgcatgaaatcacctgaagcctttgttaaagcatggctttcagtgccctatccctcaagtttctggtttagtagatctggagatggcaggagtcaaaatgttgctttttcttttagagacagagtctcactctgtcgcccaggctggagtgcagtggcgtgatctcagctcactgcaaactccacctcccaggttcaagcgattctcctgcctcagcctcctgagtagctgggattacaggcaagcaccaccacgcccggctaatttttgtatttttagcagagacagggtttcaccatgttggccaggctggtctcaaacacctgacctcctggtctgcccgcctcggcctccaaaagtgctgggattacgggcttgagccaccgtgcccggccaaaattttgcatttttaatgagttcccaggtgatggtggtactgctggtccagggaccacagcttgagaaccactggcaaagccctcattatccaaaccagctggctcacaactgccactgtgggagaagatgcttctttagcgtcactgtggacccccagtacctgcagctgagacacagggcattacctgtggtaaggatgaggacctcttcccgactccaacccacagtatgtcggagatcagccacttataagcctctcttcccgcatatgccctctttgtggtcattgcacaacacatttctcccacagtggcaggtgatatggacaagggaacacagagaccgcgtgcctaggttagaagagtacagaaccaaggactgtgtttgtttattggaaagcagccctgtggtacgcaaaatgcatcctgagcagcatatattggagttgtgtatacaaaatcatgtatgctactaaagggtccttgttatgccagggccacgactactccaaatgtcatgctcggggtcaggttccagccccagctgaggtctgatgggagtgggtggatgggcagatggcaggtgaaaggtagttttatttagcagctctcttatcagcagctctctcacactagctctcttatactctctgcctttatctcggctgtttgctccggctctgcggcccctgtcagcagccaactcccacacacagccgcaggaccagcctgcaaggccagctctcccttacagtgttagcagcttaactctttctctctctgggcacgagtgcgagccatggctcccttctctccgtcttgcagtactctctctctttctcttggccccagcacaagagcgcctgtctggcatcagcggggcagttatactttttacagacagtagtgactcagagccaagtgtgaacttaaacagattatataaaaagtggagtatacacctgcaccctaaactcactaagtcatgctggcctggatgtccgccttggcctattcttgagcaaagcacatccatacaccttacagtcattctttccttattttgatgaacaggatatatggggggaaaatgaagataaaaattccccatcattttcatagttctacttgtctttagacatagaaacaagaaggagtcatgtgaaagaagatggcattctctctacaagggttgaaaaaagagcaaaaataggatcgggggcataactcttgctcaacttgcggaagttccccacacaaagtaaaaataaaccctgctttagcagcccttatctgatttaagtcagtttgtcttccaagatctaacatttcctccgttgaatttgaggggcttattttaataagaaaagaaaaaaggagaagctgaacagggcctttagagcaacacacataagctgtttgccatattgaatcaacacctggggcattgatctgaaagctaaacgcaggctgttcacctggattgccaagtataacagaagcaactggctcactgacatcagagagagcgtacttcaccagggctccatctgcaattgcctttgaggaccagagataatcagaaaaaaagtacagaggttgttctgaaacctaattccaacttaggagcatttatttctcctttccgtaaactacctgtgatttctaatcaaaaatgcttttctaaacccagctgacctaattctccttttctccctcacagcgtgtctttttgttgttgtcgatctttggcttcgcttattcaccaagcacagttgttgttgcctagctctctaagcttgtgtgtcctgcctttcccaacattccaaggagtaatggtctcattaacccagtaattaaagaaatcctgtacctttccactctggctagctgccctcttccttttcccctattgttctctcagtaacaccaccagcagatggtttgagattttcaccctttcaaaagctttatgtttttcccatctcatcaagcatatctcagccaagtgtaattagcttaaggcttttgaatccttaagggagatcagttaaagacttgagcaatttcaatgaagagcttgaaaagccaatcctggaaggctaagggtaaccacaggagagccactattatttagaagcaaagaccctctcctccgcccatccctccttctttaggcactttaaattctcagaatattcatgaggcctccagggctttgggactctatttggaccattattgagtaggtgggatatttaagctcttactcatcatcgggtcagttggttccttttaattgatttcaatcaaggggccatttttggggagccttaagttactctcaaatggccaacagtttgtttgctaagtctcttagccttttcattcctttctttatcctttggttgttggaaactagctttctttgtagttcaagcagttcatatgaagtctaaattaattaactgcaacacagatttgcaccctacctttgagtgatggtgaacccccttgattcctgaatagccacatgtattgtggtagttgatcccacagcccaagccctttttccccatacttgggaaaaagcaagttgttttgagaccaaattaaactctatttttattgaaatggagtggagtagtgcttaagtgtgtgaagcacagattgttggtgggatgttaagagaggggcccaggctctccctcgaattgggtgatgtgtattttccccatgctttcaagtgggaggctcggaggctcaggtgttgggtaataggatgattaagtgtgttctcatgtctagtttctcattaccaagacttgggtaaaaggagaattacttttgtaaatctactaccatctttttcaaataaaaggaaccaatgccaaaacatttgattagaacgacctctttttgtctcaagtacactaatcagcttctgtttgaacagtgatgcataggtatggagatgtgcctgtattaaatattatacatctactgtaccattagaggacactacaatcacaacttagaggaaaattccttgtaaaacatgggatgtgtgttctgagccgtggtatgacatggaattggcttgcaaagcagactccaaatacttatgaattaatttattgctgtctgaaaaatatgacataatgtttgaagtacaaattggcttacaaaaagatataagcagggtgaacatttttggtaggtaagacagaaatgtagctgcattttataaatgtttgttttgcataggagagtgataaattacagtagagtttcactattattgctttgaatacggtaggcctaaagaaactagactatcccagccaacgtggcagttctgaaccacagaaaccagttgcattggtgcagagtaggtaagacttagaagaaagaaactgctgacaacaccttcactttataacaacatacagtgaggcagaggactattagcaaacctgataccacagtgtccagaaaatgtgcagaggtcatcttctataaggtttcttatacaacagtttcaccacggccatggtgctatgggcaggaaagcttttgtttattccatttttcaaataactgatgcttaaaaaatttttaggcacagtcaaaataatatttaaaaattttttcaaaacagcggtatctacttttcttcaaactgaaattacaggaattaagggtatgaggagtaaaatatacctgaccagggtcacacattcagtaggtggagcaaggccctgacatttattatctaacttgtgacccagcatcctttccaccctacccttttcccctctgagctgctctgaggggctgtggctaacagagtatgacactcgagagggtatgtacctaattgtaacttacccaactttatataagttgggtatagatatataaaatcacccaactttatataagtttcacagttggaacctggaggtcaccttgttcaacctcctgctgtgatgcagaaagccttgatgatttccttcccagctgatgctgtggcctctgtcaagggacatgcacgatggggagctcactatctttcgcaggagttcttttatcctcaaagattgagtgtttataaatgaactggattttcctgacgtttctgctgactcatcccagctttgctctgcagagggaactgaaatgaacctggcctgtatggcaagagtctcctaagtctttgaaggcaaagccttcctatagcgccccctatactgtcttctggttagtcgtttatctcgcctattccaaacgtctctcacgttacatggtttccaaacctttcatcatttgactatgtacttctaagcaagtcagatttgccaacttctctctcaaaccgtggatatagattgcacacagtgatccataccttcatttgtctgattcaaagctaaagatttatttttaatagaaattgcttcagcccctggcaactcagtacatgaacttctccctgggtgaggtgaagaagtatcctggcagtgaggctaacagccagcccaattctgaagccagactacctcagtttgcagacaggttgttctctaatgagccatgaacaggtcatttaacttggtttccgcatctgtaaatggggatcataatagcacctacctcagcaggttgtttatagggatgatatgatttaacatgtgtaaagttctggcagtagtgccaggcatatagtaaactctcaatcaatattaattattgtggttatcattgttctgagtaaaaggctatactccaaaccaagggaaaacctctcatttgtttgtgatgaacggtgagaaacctaagaactacaggaacactggatgaaacgttacctcctgccatataattactttgctaatctcctcccttagtctagcacaatgtggaaccatgagagacattcaagttactttcatcctctaagtgcgcccaagctagaagtccagtagttttcctgttgctgccaacatctttgatcaaaagagacctcattgaagagatgcagctgatcaagaaaaattccctccaggctttggtgtctggcagatgtgctgtgtcatgagagtgcatctgtcagagctggctctgtccccatgaagaattgacagggccatgcaaacaaccccgaaatctggcaaaaatgaacctgctaacttagggaagaaaacacgaatggaggtggatcgatgtgcacccactgcctttattcctagtcaggtaccaaagagtaaatgttgcagcatgtaccataggacagtgacagtcacagttgacatttgtatagaagcctgacaaaacagggacacaggagcatggaaacagctacccctacccctcagcttaaggatttaaagtttcgagatttatcattaattttatccccttactcatgttccctgtcttggggttttctttttactagaacttcttccagttgtttctgctgagatcaaagcataagaggggccaggcacggtggctcatgcctgtaatcccagcacttcgggaggccgaggcgggcagatcacctgaggtcaggagttcgagaccaacatggccaacatgttgaaaccctgtctctactaaaaatacaaaaattagccaagcatggtggcgggcacctgtaatcccagctactcgagaggctgaggcaggagaatcacttgaacctgggaggtggaggttgcagtaagctgagatcttgccactgcactccagcctgcgcgataagagcaagactctgtctcaaaaaaaaaaaattataaaagcataatatggagcaggagacagaaacaccgcctcctgccttgctctgtaacattctttctgccgcccatcctattgaaaaactcaacatccccaaaggagccacattctccgagagaagcagtggactaaggaaaaacagaaatttagattctggcaaatcagtaactagaagaaattgctgggagagacagtggtatgtctttataatccttgtaggtcattcctgatgtgctcaaccttagatgataatggcagaagtccaatttttctcttactgtacttgattttaaatgccagggtgagggtcttgcttcatataagcttcattataattaaagtcttaatcatttaaattattacgaaaatcacacttcagaaaaaaagaagagagaggagagggagagcatgtgagtgagtgggtcagttgggctagtggcgcatgtcctggtgcatgtgggttacctgtacagcactacacagcctaattgcaggagtgaccttcaaaggcccttggctgcagggctcccacaggaccagcatcttgtgacattttgctctgtgtacaaaatcccacaggcgctcatctcttatctctgcatatgccagtgatcacagccacagaaaccagaggacagagtataaaaggatagtactttgtctcctaccattttatcttattgtccctctagaatttatattttgtaccagacatattgtaacaataaagtcagttctaagaataggaaaaaaaataacactatgataccacaaccttattacatcaaactgctttgggctttatcctctttaaagtgtgctcaggtgttcagccacgaggtttctgacagccctcataagacctccaaggtgtggtgtgctgattctggcttccagtctttgggatccttcagagcttagagtctgtttgggagacagcatcccctccatcccttctggggaaagatttagaagcccctggcaatcactttgtaccaagcacatttcaagccctgtgaatctcgattatttaggatttggattctggcaaatcagtaactggagtaccctctcaacacagcacataatcatatatggtctattccaaaccaagacctttctccccaaacgtggtgttctccttttagaaaccaagccagtgcttttcacatggtgaaaatacatttcaaatgtgtgacaggctgtgaggaaaggctttcctgggcagactaaatgtataacacttgggacagagtatcttttcccaaatgggaaacaagatgatttgggtcaacctgtgctgagactgtgttggtgatgcagggatgttgggtgtcatagatggctttgtgagctgggaatctgaagaagcatgttctaatcgagtttctggcagtcctctccctgttgaacaatgaaattgtgagaccaaatgttgaccacgcggcacttctttgttaaagctgtcagcactcactgacgggataaaatggcaccagctgcacatggtcagagtctgtgaggccaaaacaaagccactgttctagaatgagccaattaaccacaccgtttggctgaaagtggcttctgcctgacatctctgaggtagatgcaaagtcccagttgtccagagttgaaccagtggtaaaaatgttaggccccagtggttctgagcggtgcaaattgttctaaggtgcagagtgtcagtccaagtcctgccaggagcagatgctaagatgggatttatttgggggaatgcaaggagtttattaaaggaaatgcctgtgtgagaggaaagaaagagggtgctggagttgactgggagagccatcagccccagctcaagcgcaagcccgagtaaaggagacagggaaggcagcttgtgaggtgtgcagtgtagggaagttttagcaaagcatccagatgcccttgaggcaaattaggccaagaacagccctgtcttagtatccctgctgtgatcagtccttgactgggagctgcctgtcaggggctccggccttggagcaaatgcagtgatggattccagagggtgattcgtcttgcacttttcagctccatgatcaaggctccacatctcaaaactccaggcggcacagtttattatcagtgatgcccccagtgatgtgccttgcatgggctgcacagctccacacgatggtcctgcttagggtcacttgctccccaccatggtgactgctcaggcagacccaccagtcagcaccatcagctactttccaggtcccccattcagggaatgtgggaacatgaagagattctcggagccaggcctaatgatgctgagacgccagcttctctgagcctattggcagctggggaggggtcactctcctagcacacatgttccaaatcccaaatgagaagtgggcacaaagccccttctcagtttttgacttcaccccaccttgccccacttatctacaaacctccttcctctgggtctttggccttttccccacattagagaggacacaccgtgaggtagactttccatttgcttttcctttctgaatagagctgcttctacattggtggttctcagctttgattgtaaatggaaattacctgggagtgttcaaaattccacttaggccatactcccgaccaattaagtctgacatttttgggaagggaagcagtcatcagcattttaaaaatctccctgagtgactccaatgtgtagccaagatggataaatccttctctacagtcctcttctttctcaggatgacgttggcctttcccgcttctcaatgactacaatggtaatctgttgcttaggaaatgtgatgtgtagtgtagaagaatgaagccgaagcagaataatatttctaatatattatctgattacagtttttatcatacaaatgcttagttttaacatttaggataagttattttggtttactatggttatagagcagaatgtcaatgttaccattcctgaccatgggagagcacgtgtgacagaaggcaggaagtgtaacaagagaaggaaagctagagggaaagtgtggagaacttgtaccctctaggagcattaattaaagatttacagataaccaatagaagagctagaaagttggctgggcgcagtgactcacgcctgtaatcccagcactttgggaggctgaagcggatggatcacgaggtcaagagatcgagaccatcctggccaacatggtgaaaccccatctctactaaaaatacaaaacttagctgggcatggtggcgtgtgcctgtagtcccagctacttgggaggctgaggcaagagaatcacttgaacccaggaggcagaggttgcagtgagccaggatcacgtgactgcactccaacctggtgacagagcaagactctgtctaaaaaaaaaagagagctagaaagttacgttagttatcaaaatctaggaagagaagagggtggcataagtaatatatatcaccattggttattgcaagagtcaacagctacaacctaaggcagattgaacaaaaatagcaacccaattccatgtggtgtaaatgtaagatgatgaagaacctaaaatagaaattgtaaagacttgactcgtaggggtggacctgggatagggaagatgtctgtactttaccttgtacctgtatctaaaaaaaataacaaattaaaaaatagatttgagattctatacctcagtgcatatcaaggggtagtttgggagaacacctccagtcaaggccatgttttctacaacaactgctgcatatgagaatgctgcaccctgaacccttgcctgcagcactgttaaatgcccaggtgacagtgctctgactctccatggccacgttcttccattttagtaagtaaatggcctaccacagtgttgctatatttattgtcttttaaatgttgtatcatacccaggagagagacagagaaagtaacattcatggagaatacacagagtgacattgcaatttaccacctcgcagattcctctgaccatagctgtaagtaatggcatcctattactgccagaaggtttagcagatggttttggtctatgtgccaggtgcctttaggtgttctgagaatatctgttgagataggccctgtgtaaatggagcactgtattgaatagaggaactgtgatgtcccatcctggctatatctaccatcaactggttccacatttttaactgcgacatttaacttctgtaggatcggcaaaatgaagggatccactgactcaaattaacatccagccttaacactttgcacatcaagggtttcttttagaatagaaagtgtcagtgttggactctagtctttgctaaattttttcctatcacctctattcagctttaaaatataggtctgcctgttatgcaagtgagcaacatgccttgtcttcaaatagactaggtgaaaattccagttctatcactttttggctggatgaacttggacatgttacttaacttcttcaagcctcagcttctcacctacaaagttgggattgggtgtttactattgttatgaggatttgaagctgcagtgtatattctccggttctaaaagattctcgataaatagcaacttttgttacactaaggaagaagttagaagaataccatgctcccaagattggaagacccaagatcataaatccacagggaaaagtcctatgtggatttgcagattactaggtcagatttttcccatttctctcatttgtaaagcaaccagccttctgttccactacagagtctgtgtgctagggaagactctgatcaccatctgggttcaacagaagccaagaaaaataacaggacagcaaattaaatatccacgggccatgtccccttcctgtccctggctccccagcctaagcatctgctgtggtttcaatacacctgaccttccttccatgcatgtcctttggtgagggttcctgtcagggcaagtattcctttggccaagtaaagaccccgctctcacctcccaaggtaactgattttcatcctttgaagttccttgacttgtgcaccttctctctgggttggggttagagctctcttataatccattaaatcaagtcctatattctcatcttctatctataggaaaatgagagggaggcagaagagtcaagaaaggaaggctatatcctaatggcaagtttattttgctgttggacatcacttactcttcagtttcctcttttttttaatagaagcaatatttattcagtcctgcaaaagagactttattattttagccttgtgactgtatattgtttgcccttaaagactaagaaggaatcacctgtttatatgtatagaaacctggtcatttgtttttaatttaacaatattgttataaagtaacttactgttgatttaattattaaaactaagcagacaatttaaatgtaatttaaataccatgtgttaagtatacaccaaactgaaacactacagcactcttcccagaagtaacatcctgagtagtgtaatttttttttctattttttccatctctgtagaaaataaaacagcactgatctggggaattggaggtccccacccaattgtcgttattaaactatctcacctagtcctgattcagaggctgcagctctgtttatccactttaaacaaaaggagctatctgttgaataggctctcttacagaatttccctggatatgtcaaatgtttatttttccatgtaaattttataattggtttgtcttgttctaccaaaaaaagaaatcacaatggatattttattgggattaattaagttaaatttaggccatccttacaatgagtctttcttcccaaagtagcctttgtgattaatcttttatagaatttacatttttcatttatataaacttttaatatttttgttgcgtttactgttgactaaacttttttgttatttttcctattgtatagttagcttttggtaatttaataacattatcgaagctgagtgccagaactattgtggttattcactgctatttttaacttttctttggagaattgtatgttaatattctttgtatttctagcagttattcatctttgttcttattgatttataagagtatttttaaatatattatgacttttttatctttggtttggaggtgtgagggtgtgagggaacttatagattatcctgtcctgcccatttttcctactaattaagaaactgaagtgagatgacttttccattgtcacacagaaacttagtcctgattatccaatcaggactaaaaataggtcttttgggtccttattttgaggtttttctctcaagtacttgcctccttgtctacagttttatctttttcctcttaaattgacactatcaggttacttgatttgattagaagtaacaagttggttttctacctctacaaatgaatcaccaagaactgattcatttcttggaagttattgacaataactcccaaatcttgtcagtgttggactgtgggctttgctaaattttttcctatcacttctatttggctttaaaatataggtctgcctgttatgcaagtgagcaatatgccatgtcttcaaatagactagaagaaaattccagttctatcactttttggctattgccaaaaagttgatatctcctttgaactctagatttttctaagacatctctccagttggatgtctcattgacattttcaacttaaccttttcaaaaatgaggggtttttttgtttgtttttggtttactcttgttgcccaggctggagcacagtggcgcgatctcggctaactgcaacctctgcctcccgggttcaagcgatgctcctgcctcagcctcccgagtagctgggattacaggcacctactaccacgcctggataatttttgtatttttggtagagacggggtttcaccatgttggccatgctggtctcgaacgaaactgagcttttaatatccgcttcctcatctgcaattcttagtctccttcatctgagcaatggcaattccattgttcttaatggtcagattcaaaattgtgcagtctttgactattccctttatcccaaacatccaattcatcctgaaattctattggcctattttcaaaatattgccagatatgttcacttctcccatctcctccaccctcaacctaatcaaaactacctttcacatcaatgattgtcatcactttgtatttggttcccttgctttatctgtaacttcttgtattttattgtcttaccacagctggagcaagccttttacaaaataagaatataacaatcttgaaccactgccctctttcctccaagtttctttttgttttctgatatcaatttccttaattcactcatgcctttgtttgtcttcaaacagtataagcgtactcttgcctcaggacctttgtacttactactactcctttccctgaaatgccaacctccacacatactcaaatataagcacattggctgcaaggatattttctgctttgtggcttctgtatcctcaggacctagacagtatctgacactcagcaggtacacagtatatgattgcagaatgattgattgaaccatacttactagcaatcatttttggtggtgttgtgaaggatattttgaggcatcatgtggtctttgcagaactggttgaatttctagaactaagatgatactgctcacttactgatttatttgctttagaatgaaattcaaattcctggccttgtcagtttccctcctttctctccctccttctccactctccaatcacaatggtctcttttcacctccttgaataagccaagcctttgagccattttgctggaggtgccccctaaggagaaacatctgtttctgcatcttcacatagttgactcctcagagtacatatatcaacagcaaataacttacctatcacttctaccacatattgccagaggctcacatttcatgacacatagtgggtacttacaaaatatttggagaatgaataaatgtcattagcctagcttctaaagatcatgagatgcatgcccccatgacagcaccagccacatggtgctgaaatgatatatttgtgagtctgtctcccacagagtctgggagaacctctgagacagatataatgtttaattcatagtcactgccccaccgtctcctacacctagtggcatctagtggtattccatagatgtttgctgaactaacatgaagctacagaaaggcctttagccctcttcatcaaattcatttcacttgagagatggggaatatggagcacagaaggtaaaatattaaaaaatgaatattatgagatggctcaggaaggccttatgaggaagaggacaacgcagagcaaaggtgtagagaaattaagtgcctagaattagctcccatagggagaagaaatgcagcagtgagatcatcggtttaggtactcatttcagaacaatgccaaccttctggtgctagaaatttacaaggcctttttttttcaaggctaaaaaatgatgttactgatgtgctatatgtaatggttcctgtgagtaagtcatccttttgactaccaaagcatactctttatagtagctgtttcaatgttccccattctctctctctcttttttgcttttcttctccaaaccccttttccttgcagatggtcttatctcctactttgctgagaaaatcaaggtcattaaaggggaaatctcctaaccttccatcttccccaccaaaattatctttaaccggatatatgtcccctcctcatcctcttctgtcttggcatcatagccttccaatattgaccctaatattacatctggattcctttctttttttctttaatcatctgacatactgtatcctcaattatttccagttttccagcattatacaaatcttttttttccactgattccttctcttggaccttcaaacatacacaagtctttcttgtcttgcaaggaaataattgttgccccccttcaagccaccatattttcctttgtggctaggtgtcttatatgccttcatgacttaactctctctattctttcaccatatagtccttcactatcatggaatcctcatgtttcaggtctcagctctgttaacatgagacatcccagaggcttctcttcttttatttaaaaagtcttctttaagagtttttctactctccccaataaaacaataaatctatttccaggatcactgagcacattctgagggccagacactgtttgggcatcattcatcaaacatttgaatgagtcatagaaataggacactggactagatggataaacattgaggcaaacataaatatgtttttccaggggtacaaagagaaccaaaatttgaaaaactttaaaaagaacaaaccaacttagaataaaaggtataaaatggtaccatacatatgtacacatttttttatatactgtagagggtggtagatggacaactagccgggtttgcatctgaggagccacactggtggaaataagggccatgctgggacctgcagtgtgagtagggttagctaccttaggatgggggtgggttggatgttgcaaggaaaaggaggagtacagtcaagcattataggaaaaaatgtggcacagtgtggcgcttgccatcatgcacccacattcactggagactttccttgcttgcttcatattccatgggagttctgagttggagggaggtgtgtgagggactactccacacagttattcaggaacccaggattattccttcttgtgcatcttgtaactctgtattgtttagggcttcagtaaccacaatgtggttcctggcccagcagcaacagcatcacctggtaatttgttagaaatgcagattcttaggcccaccacaaactggctgaatgacaggctgtgagaggatccagaaacaaatgttctaccaaactgtccaggtggttctaatgctcagtcacatttaacaactcctgcccaaggcccggcagaggagggtagggcacatagagatcacacaggagagttttcaggtgtcagccccagcagtagcacatgttgcttctgtccacagttgttggttgctgctcagtcctgaagccctgactgactatccaagaagctgagaaatagcccagctctgtgcccaggaagaaagggctcacctcccaactgttcttcccactgccagtctgttccccttaaattcattcacctcagctaatcatgcaaatctgtgatgaccctggctgactgaaacttccacgggtcccatggccttctgaatgacatttcttagtcccacaaaggctggttcctgttgcctctctggcttcatggtttgccatcccaccctgaccctgaactctaaactccagccgtcttaaactattacaaaaacacctggctgatctttacccagccctgtgccttctgctctgggcttttgcaccttctgctcttcccatggtcctttgctcctggccattcccattcatccttcagggctcagccggatgtaactttgtctggaaatatctccctgaagccactctctacctcccctccacccaagacagggttagatggtctctactaattcagaataatccttaattactttggcttgtaatcacatcagtctgtggaaggaagactgtttcttatatatagttgcttctttgttgcctgtaaagagcttggcacatggtagatgctcagcgaatgtctgctacgtaacgaaagcaaagtggcctactagatgtttagtgggtgcttatcgatgaggacattgattgtctatctcatactttggctaaaatttattattaacgaattcactcttccttaattaggtactgcatcttcattgcagccaagaacttcaccactgactaaaagcatgcagccacgtacaagtgggatggggggaaggaaatccatccccatggacagaaagttaactcaaagcctcgctcggctctggtcacagtcagcccatctttttcacagacaaaaatctgcatgtcttcatcttacattaatttacatatgtaatttacctaataggaaaataaggaagcacagtgtttgaagtgtaatcaaattacattgtttagaaaacagagaaaaataaagcttcctggtgctggcgggtcaacaaagatctctcagtagcttactcatccaccaactgaatcagtcccctgttcctgtcaatgcttctgccatgactcattctggtgggcaaatttttaatagaaaatgataaactcagggatattcaccttaaaaatatgacaacacttcccagggacatgaaaataagtagtattattctccaaaagttaaaataatacctgtactcagaacgtgagtagcaaccactgtcttccccttgcccacagcctccatgactcatgaccgcattctctcctggacattgcctcatcagtgactgccatctctccctctctaactgatttttgtgttggatcctccaataaggagacacctagttggagttaggagagcacagggctcactgaggaataagacatgcggaagttgaatgaagcagcagagttgtgcagggagagacagaggtggcatcgcctgtccagggtgcgcagctagtaactggaaaagccaggatcaaaaccaggcaaagcgagctccagaaaccagtggcctgaacactgccttgtactgtctgtgtcttcccctgcccagatggatagtgcattttattcatactgaaataatagctgttcataattggttattatgagcctaacactccactaagtgctttattaaatgcattacctatctatgaggtaggcgtgggttttctgacttttacctattaggaacctgaatcgcaatgaggttaaataacatgcccagaatcactcggccaataagtcggagaatcagaattcacatctcaaatttatgttctccactctgactccagggtcttttataccgctatttcttttgagttatttctattcatctttgtagttacacaatccaacaaaatataagcattgaataagagtttcctgaattaataaatgaatgaatgaatgaataaagtgcttttccagaaattctgtccagaattatgggtattgtggtcatttagcaaaaagtaggtcattttagtaagcaaatactgctcccaaagtttcagtttctttttttttttttttttttttgagacagcgtctcactctgttgcccaggctggagtgcagtggcgcgatcttggctcactgcaagctctgcctcccgggttcatgccattctcctgcctcagcctcctgcgtagcagggactacaggcgcccactaccatacccggctaagtttttgtagtttttagtagagacggggtttcaccatgttagccaggatggtctcgatctcctgacattgtgatccgcccacctcggcctcccaaagtgctgggattacaggagtgagccaccgcgcccagcctcagtttcttttttaattttagctatagcttttatgtaattaataaaatttctagttgtgaatacattaaacatgcatagtagaagaggtccaagaaccttaacattgttgttttggtgaaaagcaatcagtaagccaatgactctcaagcttttacatgtacaagaatcactagggcagcttgttaaattgcagattacgaggctctgccaatcacaggttcttattctgtacagctggtaagatgtctggaagtctgcattttataattatcctgagtatatccaatgcagatggttcctggaccacatcttgaaaaattcagatggaccagtggggctggcagttgtctaatcagcctccatgtcagacatgagaaaccttgaaacacacgtagcttttcaaaaggataaaacagtgtgatgtccgttgtttcctataacgatttcagagctatattataagacctgagacctgtagcacaaatgcatgtatgtgccaaccgaatcatacattgtgcatgaatgcatgtatgtgccaactttgcttaactggatcatgctggacagagcacttcataactatttaaaacttggtattgatctttagaagaagagctaatgactcattttgtataatcaatgtgtttatggcatctcagaagagttttatttttctactaatgatatcttactgaaattaaggtaccttccactgtaagaacaactcttctgtatatgtcactgagaaggaaaataaaaagctcaaagtggagagtttaatataagacaacaaagagcactaccctcagatgagactgaagaagatataagagatggtgccatccgggcatggtggctcacgcctgtaatctcagcactttgggaggctgaggcaggcagattacgaggtcaggagatcgagactgtcctggctaacacggtgaaaccccgtctctactaaaaatacaaaaaattagccgggcatggtggcgggctcctgtagtcccagctacttgggaggctgaggcaggagaatggctgaacctgggaggtgaagcttgcagtgagctgagatcctgtcactgcactccagcctaggggacagagcgagactccatctcaaaaaaaaaaaaaaaaaaaaagagatggtgccttggtttatggccctctaaaagcagatctataggccaaatcttgagggcaggtgggttacctgggaggcaatccgaggaagcacatgtgaggaggtggggaaatgagaccgagaatggaaggcacccattgaagtatgatcatgagcagactgtcattgttagcagttgggactcaatcccactgaggcctctgtgaagcattctgtagaacacacctcagaattgtacagtcatgggtagggaagctgggctgttacccagtgactccctttccttattggttgaagtttgtctgggggtggggcgagtagatctccagcacttttagtgaagagcagtcagtaagcaaatgattcccaaattctatgcgctcaggacccctgggctgtcctctacaagggctgaacaagctacattggtgcttttggtggagaagtagaaaaatgtaggcacttgaggagggataccatcagagtgcagagatactgtcccctgcagctgcagtggagctcagaggtgggctggggtgatggcccaggcatcaacaatagctgctccaaatagctaggagacttaggtgtcttaattgcggcattgattaatggaggtttaaaaaatgtccccttaataatttggatcacagtctaatgctaatcatgcaagtttgtgtcctaaattcatacaagtgtggttcatagaagcctcagttagggactttaagtggtttcaggttgataatgctgcctagtgtgactaacaaggaagtgcaaatcctctctgtctgaatgtggcttcaatccagattaatagcaattgtaaggctattgatcattctattcatttcaacttcttcaatgtgaagatgtagaaaaaatgtcttcaaaacaatgaaatacagtagtaacaaatagctataaaaaatacaacttccttcctacataataaaaatgtaaagagcactactttttcacccaacccatgcagccatgttcacacacacacacacagacacacacacacacagacacacacacacacatgccaactaccacatagcctctttgtaatggaggacattgactggtaaaggagagcctgccttctttctttctctcaggtctacaaccacgcaaatgatcaatattctattgaagtcagccaaatagcaaccagattaaatacgacagaaccaggaagctgaaaattgagggtagctattcgtataactcttttatttgctcaaaggaagccacagggcaaagggggagggggtgttcctgcttctagctgcattattttcaactttcaaatttttttttacgagcaaaaatgtctatgtaattctataaaaagaaagaaattaactctgctgggtttttttcctctttaaaaagcctgctcttcaggtttttatttgcagactggtctaggctttttgtttgtttgtttgtttgtttttagaaaagcattgtgccctgagatcaataaatcaaaactggattgccttcttctcaaaggtgaattgttatcttgccgaagaagttatgtgacagactctctagtttggtaaaaatacatgaacaagaaaaggattaaggtgtctttgcctgaaaggaaaattctggatgctatttttttctatgatagggaaagtttcttgaactgtctcctggaacaagaggttaaatgtcagtagctaaagcagctgtgggcccattatttggtgctcgcagagtccattctgtcattggaggtgctgttttcacacagagaatgaagtcagcttgacaactgcaggaacagctgtggcagcctgagatatgaggcaaggaggcaaagcccaaacagagggcaaagaacatctgtttgttgtcaacattctgaaaaaagcaaaagattcttgactatgggagagaccagggtacctggagataacagcagtcaagacaaaagcaattttcagcaggcagaagtcaatcaagcttgaaggaaaaggccagttaagatgcttagcacccaggggttctggaagagtgctgagccacccagagatgtcaggcctgagtggagctggtgctttgatatgaattcaggaagccgcctggggatggcgggttgggggacatcatcacagacccaactgctgtggattgacctctgccattactgctgggaccccaggccctctggtgctcaagaaaaccataaagccttgtgctgcctcatttttagaatctgttccctggcattctaaaccatgccataatgcatttctaaccacagggataagagatccaaagcaacattaatctggttttccagagcagggccacagagtgatcccatcttagagaattggccgggcatggtggctcacacctgtaatcccagcactttgggacaccaagacaggtggatcatctgaggtcaggagttggagaccagcctggccaacatggtgaaaccccatctctactaaaaaaaaaaaaaagaaaaattagctgggcgtggtggtgggtgcctgtattcccagctactggggaggctgaggcaggagaatcgcttgaacccaggaggtgaaggttgcagtgagtcaagattgcgccactgcactccagcctgggcgacaagagcaaaactccatctcaaaaaaacaaaacaacaaacaaacaaacaaacaaacaaaaacaaaggagaatcaaaccaccaagctttgatcctgaaacatctgaaggggaatgaggtccatgctacagggctctgcagatcctgcaggaggggagagcctcagtacaccaccattttactgtattcactgccacagatggtgcagatcatagtgatgtccctggcatgtgacaggaacttactgtcttcattgtgaatgagtttacttgactatgcctcccccaagaatctcaggaatatggaagatgtttgagtccattactttcaagtggattacagttgaccaggcaggcctgtgaaagaaagtttagggccacctttcaaattccagccccatttcacctgcctctgcaaggctctctcaccactgtcactagtgatggggtggaaatatcccagaagtagagttaggagaacatttggtcccaacctcattgctgggtggcctggagaagtcatgccacttctctggggtcctctgttcacatctctaaggggtttaattggactgggagacagtcaaggagttttttttattttttgaggaaagtggccctttttcagacaacaaaagacaacacttgttcataagcctaaaaagtggaataaagcccctacgaggagggtttcggcaaaggtaacatcaacatctcacaggtagctttgacttctccttagccaaagtcatctggctgagtttagtagcacttttggttgcatgtttagttaatgtgacctagacactctttcaggtgtgtgtatgtgtttgctctgggagtaattaactctcagaaggcataaaaatgtttaaacccaacaaagatcaaagattaaggcccaagtatgtgtgatattgctttgtgaaaataagctgcctagaaaatgggctttcacttaatgcagatgtgtttggaaacttctcctagtaggaaaaaaattctatcatttttctctgaagctgaaagaattggtgttgagagactgagaccggaaatggaattagcttagcagaaccgcatgcatttacttccagttcagagccctcagacagccttcctctaatgcttctgtaaaccagcaagattatttcttggatgcagcgtacatttctagtcctttggtcatggacaaaggtgatgcactagattttattaaatattcagaacaaattatgctatttaggaaaatgtgacctacaaacaggacaagatatagcgcaaataattaaagacatctataattaagaatgtataggattaagttattctttgactgaagagctagatacataatcatgcaggatttcaaccctcgccatcagagatgcttcttctgtgggccttaagtgtatgatgaagtttcaaagaattcagccttggttattttcagcactaagttccttccttgtgagatttcacataaagaaccattgaaaagacagaagttgcccccactgtggctccttacatagttaaaaccctattagagtaaaagaatcaagaaactcctctggaaaaagtacatatctctgtgttcactaggaccctgctgtgtacagatttagctggtttctgcagagaaacaaaagccacaaaaggtgcatgatggggtggaggggagtgttagagacacccaatttgcattattcctgctggaaagaccctgatctgagatcagctctggcagcccccagctgagaagggcctccttatagtcttcatttcattccagccaagccctggaggggtggagaatgcataatgaggctgaatgagaattagatgcttaattgaggcctggaaaagggaaagaaaaagccagacatgtggaatgtgatcagaatgcagctcagttaagccaaatgtgatgacacctgggaaggcttcagtggttgggaccactatacagagaagctggaactcctttgaaactgactcatccatctagttccaactcaaatgttattttcttgtcctcaaagatttttcttcatcctcacaaaaggtggctcactctctcctttgtgcatccaccatgcttggttcatatgacagtgcttgccatttggcctcgtgggtgggggatgactttctctctgcgttggctggcttgtgaactccatgagggcagaggtgtgcctcattcattttgtatcccagaacataataggcattgaagtacctggtggacattttttttttttttgctcttcttcctaaatactgagttctctgtagagtagttattctgacgatgactgatgaagcatttccaaaccattctcaaagaggcatatggaggcatattatctggccaaacataaaagtatttctatatatcaggatctcgtgctcaccctcagctatcatcactgcctttcatcacttggtaaagacagtttctgattttgattagggtagagtattcccaactaatacatgaaaatttctgttgccatggaaagggtcttttgtaaaaacaggcacaggcacattttccacaagtatgttcctgtcagtgtaatcattcactatttgactttggagagggggccaaatgtgtgtgtctacagtgtttgtccaagtgacgaagagaggttcagtggtcaagtagcagctttaggatggaggctatttggaaaaaacagactaggtgagtaacagatggcatacaatcaattgtatctttgtcctaaagaagcatggactaagtgtaaatcaagtgtatccatctgctcggctgccataacaaaataccttaggctggggcgcttaaacaacagaaatgtatttctcccagttctggaggctggaagtccaagatcgaggtgctgctaatttggtttctggtgaaaatttgcttcctgtttcatagacagccgtcttctcaccgtgtcctcgcatggcagagcagagagagatttctctcttcttctttgcataaggccacagtcctatcagattaaggtcccaccctcatgacctcatttaaccttggttgtctccaaaaggccctatttataaatacagtaacttgcaggttggggctacaacctttgaattttgggaggacacaaatactaatccatcatatcaagtctgatcagaaccatcatttgaaaaatattcttgaaaccagctgctggcaaaggccaggtgcatgtgacacccacaacgaatacctagaagaatcaagagcctctgaacacctgatcttgggtgaaagaaggtggtgtgtagtcacattttaaaaccttactctcctccaaacttaacaatatgaaggaagagaagtaaaacaggcaagcaagtatcatcaacaaaaacagtaattaaacgaaagaaagggtgggtagccagcaaaaggaaggcacctttctggaaatgtgcggaaggaacgagcctggtgttgccctaccccatccctaactctacaggctcagaaatcatcctgaataagatcacaccagctaccatttacctccctaactaggagagaaaaggccaaggaaatttccacaagagcatgaagtcagccatgaacaccttttactcagtctttccccagagaaacaagaataacctttgtaatcctccatgtcaatacctctgaaggaaaacgggaaagaaaaagcagaccaataacaaatgactagaactaattatctctagcaaaatcccgggaatttcacaaaatagaaaatttaagaggacatacataaggcaaggtctctggcgtgaacaagaaccagggaaggaggtgctagcaggccccaggtgatgcttccttgaagaaggagccaccttcgctctctgacaaggctgcagagggtttatcacctgctagggtggaaggctaagaaagaaaacagcaaaagggaacagaggaactttcagactgactctttctcctggaaagttctgagtctcatgttgaattgaaggaattatccaagccccaaagatagtgcccactatgggaagtccaagccccaaagatatcccccactatggaagtccaagatggcaactgtgcagacaaatttggggggaacctgggctgggcgtgggatatgctatatacttgctgagaaatccaacacaatgaatgtggctgctttacccctcccaaggaaaacctccaaatgaaaggcttctaggcagctgctggaggaccaaggagccacagagcagtatagaaagggagcagcttgctgacatgcatgtggcatacacatcaccctgcaagcacactgaaaccttgactgagaaagagagggaaggaaggaagagagcaagtgagcatgcaacccagtaaagggcaggtgaagaacgtactgtggaagaaaacataacccaagagaaagatccaaattccctgcaatgaccacagatgaactttgaaaaaatgttaacaagcttgaagatgcagtgataaaaataacataactgatctgaaatgtaagaactaaggagataaatgttccactcttagagaaataaatcagttaagaacagcaaagaccaaattactgacaaagaaaaaaggttgagattttcacagtgaaaatataatacatatggaagagaaaacacaaaaattgctctatgtgagaatgataggtgtcgctgaaatttagaagtcaatgtatagaacagaaaatgtcttaaaacaaagggaagctgaattgatgatctaatggtcaaaccatgttttaaaaaatcaatacagaaatctcgtcctgaaacacatctttgataagtttaacgatttttaataaagaattttatggttatactggcacatgacatgtcacttaaaaatacctaaaacttttagaagaatacatagttaaatttatttaatgtatcttaaagaaaataaaaagatgacaatccaggagaaaatattcacaatgtattagacagggaagggttaattttcttagtttagaatatacaaaaatcatggaaaaaaaacaatcaaataggaaattggtaaaatataaaaacagatgacaaaagacagggaggaggaagaaaagaagggaggtagaaagggtaatttcactcgtaatgtaaatcaaaacaatgaggacatactgttttcttccctgaaaagtttgagtatactcactgctggagattgcggagaaatcattatcgttatcattatcatgctctaagtgatctgattgatctgacctttttggaaggaaattttgtaacatctatgaagattaacagttcacatacactagatctagaaattcactcggaattcatccttgggaaatatttacaaaatctttccaaaatataagtgcaagaacattcactgaagctgtttgtaaaagcaacagtgtagaaacacatcagaagtccactgatgtgggcctggataaagaaattatgatatatctatatttatgcaatgagatattaacacagattacaatggcatgctcatcgatatatagtaaatgcatatattgaataggcactaaaatcaatgcacatattaaaatgcaatactaatcaatgcacatttgctagtacctgctaataaagtatgtacgtattataaatacatatatttatgtagaaaataaaaaggccagactgcagagaatagaaagtatcatctatattttaagtaaatgaaaactgagatgagagagggtatgaagtagggcaagagtgggaaaagagcaaagagagagaatgaaagagatgggaattgtgtgcattatttttttctgggaaggtaataggaacattttaacatggaaagagttgttcagggtcatttttcattagcatttttctgagcagtttgaaagtgttaattatgtgtaagtgtcctttctgttgttttttaatgtcactacagttatttaagggttaggtttattgaactttatctttatttctatttagaaataaacgcatgctattttaaaaagttagcatatagtatgttttcacctgtaagtgggagctaagcaatgagcacacatggaataaatatgggaacaatatacaatgtggacccttggagggtggagggagtggagtgggtgaagaaactaccaatcgggtgctatgcttaccaccagggtgacaggatccgtactccaaacttcagcgtcatgcaatattcccaagtaacaaatctgcacatgtacccctgtatctaaaatgaaacttgacattaaaaaattatatattaatatctcattaaattgtagtttgttttggttaattaaatcttcataaaacatgaaagtgtccataataataagtcttaaattcaaggaagaaaggaagaaagaggggagggaaggagaaagaagggaggcagggaaggagagaaggagaaactaggatgcaggaaggaaggtagaggaaggagggaaggagggacaaaaagaaggaagaaaagagggagggaagaaagaaaaggaaagagggatggatgagaagagggaaggagggaaaaaattaggatacaggaagaaaggtggaggaagaaggagagaagaagggaagaaagggaggagggaagagaggaaggaagagaggaaggaagggcaggaagggagggagggagggaaggggaggaaaaaagagagaaggaaggaagaaacaaaaggaaaatgaggaaaaggtaagaggaaggacaggagaggaggggaagactctggacaccctatctactaagaggtaaaaactgaaaatgcctctgaagagcagcacaatgggttaaaagcctttgacttattttgcgtgactgtgactaaagaatttaaacattacttttgactaaaaacaattattcttggcacttgttaattaaaacagcccatttccaactaaaaacttaaagactgagagtaaaatagctacatgttaataaagtttttatatggaatctgacttttaaataaagactggaccaatttacctatagtaaattgaaaagaataaatcttgttccaaagtcagaaagagagactgtgtgacattttatttttgatacttatttgttcttcatgtagatgtagaatgcaagaaagctaattatggacaaggagaaggaataaaagaaaaatacaatgccgaaaagcaacagtgctttctcctctgagatttaatctagctacatcagagctctaattcatttaactttttaaattaagcttcatacatagtaggtatgcagcacaatatgctggctgtataatagaataatgaatgaatgataccccagaggagggatatgtggtaaattattgaatgatatgaagaggtgattcagctaggtttgtgttcttaagggtcagtgataaagagatacccagaagtagccaataaatattaatcaggcatttatgatagtcagtcattatgtctttcaatcctccagttttatgagagagttatcattaactccctctacaagtgacaaaaccaagactctggaagtgagcagaacttgcccccaaatcacataaatagaaatgccaggacttggatttgaaatcagctctgcctaagtctagtgagttaaacttcatcccctttcactaatagtgacacctctgagaaagatagccagaagtaagcagacttgaggttcagaacctatcacagtagggggtggggtgggggagaaagagaaagggagagacacagagagagaaaaaatcaaaggcatactcaatgagagaaggaatttctagaagttggagttgtggtttgttgaatggcatttgttgtagggaaagtggggtaaattgctacctgttttattttgactcctttcacactggatgaattttaagagcaagtgtttaccccttgcacccctatggattttcacaaaatacctgaatatgaaacctggacattactacagctatgtgaatgaataaatccatgccattatcaaggactggaatgcttttttagaagttaaatttatttagtttatggctgttggaaccacatgatgattattttagataatgctgttgacttcattataaggagcagtttgtgggaaagcatcattacggtatagtgtaccgtggactcagcttctcttcaagctggtgttgatattgacgctgtgttattcctcattaaattggtctttgatctcctttcacttagttgcacatgcattctagacctagacagtgaactgggaagtctaggggaaaatgaaatctaattgagctcatcttttccaacaatcattagcttaaaaagaacataaattcgtgtctgtgcatatggaataatagccttcttccatccgagcttgggagttaaatgtacgtgcagatgccctaaactccaagaccagttttcttccattttagaaccataccacagtgagcacagtttattttttgtttgtttgtttttggtattatattcagttttaacactttattattattattttatttttccataagttattggggtacaggtgatatttggttacatgagtaagttctttagtggtgatttgtgagatcctggtgcacccatcacctgagcagtatatactgcaccatatatgttgtcctttatctcttgccctctcatactcttccccctaagtccccaaagtccattgcatcattcttatgcctttgcgtcctcatagcttagctcccacatatcagtgagaacatacgatctttggttctccattcctgagttacttcacttagaatcatagtctccaatctcatccatgtcattgtaaatgctgttaatttattccttttaatggctgagtagtattctatcatataactaatatataaaatataatatagaatataaaatattatatataaaatataatatgtaatataaaatattatatattatatataaaatataatataaaatattatatattatatattatatataaaatataatataaaatataaaatattatatattatatataaaatataatataaaatattatatattatatatataccagagtttctttatccactcattgactgatgagcctttgggttggttccacgattttgcagttgtgaattgtgctgctataaacatgcatgtgcaagtatctttttcaaatgtagaactcccagttaatccagcaatcccactactgagtatctacccagaggaaaagaagtgagcagagtttagcctgttaagggacttctcctttgtatacattaattcagtgtttctcaaagttatgtacactcaccatttgtagtttgatagatgattttaggtgatgtaaagattaacacattatggcatgttaaaaaattagccacaaatgaagctcaagatttcatagctataatttctatgggacaaaattaagaaaaatttagaactgaatcgattagaagtgtattattatgtgtgttagttagctatcaccacagtaatgtaatgcttcatctcaaaccatcttcaacctcaggggatttagaacagttgtctgttcttttgctcatggatattaggatcaactgcaactagtctgggccaggaagtgtatccatccacatgagctgagtcctggtctcatcctcctcggatgagctacccctaaagcatgttgtccttgcggtaaaaggtaggagaaggaaagccccaactgtcaaatgcatttcaagtctctccttgacacacttctgctaacatcccattggccaaagcaaattttgtaattaagcccagcatcaagagagagtgaagtagattcccatgagggtggcaggtaggaaggaaacatttctgaacgcattatctaatccaattacattaatagtgaagttggaacataggtatggcaaaagttgtcaaggtggttcaagaaggtttgctttcggttgataccactttaattcaatacaattgaatccagacaggccctgagctctgtacctatcatgtcacctatgcaactacagattctgccaaataattacttgtaattctatttgttgtgtgaagtttactgtcaatacacatctcaaaagaaaagcttggaggactcctcccccggccagcatctctcacgtttatatatttaaaagtctaattaactacattctgtgtgcatctcagtatcttttcttctatgatgacatctgcctcatttattactttttatgtaactccactaacctagaaaaaattgctataatcaagggtttgagcagtacagttgcagttgttgatagaaaatgaaaatagtactgaatgtcccagactttttctatttctgcatcttttatcccctgctaggagctctggaatgtacctcttgtttgtgtttcaaccagcagcaatccaaatggaaggagggacaggcaaactgtaataaataggccacagaggccatttttgtttttatcagattatgttgtctatgtgaaatggattcatttctgtagggcatccagttgcactgcccagcgatgtagaagctattaggatagtaccagttccacatgcatgacacagtaagaaatatctgtcattcctctcccactttccaaacaaacaactcacacacacatgcacgcacgcacatgcaaattcacataaacataccattgcacacatatgcatcatattcacagtgcatgtccacacatacaggaaaacctcatgtgcactcatgatattaaattaatgaacaatctctaccaaacatgatattggagtcttggaaagcagatctaacagactatacttccctctgctccaggaatatagtggtatacagagctacaactttgatttctgtttttttctctctgtttcatggatttcaaatctgccattgaatctcatactaatctatgccaatactgtggcacaacctgagatttctcacacattccattgtgaagtgaggttagaaggacaagcatagggctagaaatttaaatgtttactgttttctgatttgctatttgcattttgctttcttcaactttttcctctctctcacctaacttttgaaagtgttttgtaccctcccttatttcactaagcattgtttaatagactagaattatgcctattagatagaaagttctctgtgataccagaggggtttccccatagtaatgtaaccagggttattaccattgagagtaacaacttagaaagatatttcctgaaagaatcagctacaggtacctctagatcccatcagaaacaaggaccctaagaaaatagtcaagaaagtaatgcttagatagagcttatcaattaatttttccacagtaatcatttcatataaataataataatattatattttaaataggtctgatgatgtcccagagagttaagatgagtcagaatattttataatcattttactagtgaaaaagccaaggcttttaagtgctatgagatttggtcaaagttattgaaaaaattaaatgaccagccacaatatcctcttttgtgacacgtctgtttgtgtcttgtccactttctgttgggttccctgtcttttcaaggttattttgtatgtttatttcttatatattctgtacaggagtcttttggcttattttcctctcccttagcatgttttgataaacttattttaatggttggtgctttgtcctgtgtaagaaattttgcataatgatgtgaaggtctttgtccacattacctttcacatttatttctttttgagggtaggggaaactatttcttcagcataggtctgtggacaccaaattctctcagtcatattctctgaaaaatattttatttcaaattcaaatttgaaaatctttttttttttaacacttcaaagatgtcattgcatcatctctggcttccattatttttgttatgaatttatctataagttttattgttattttgaagttaatggatctttattcactagataactttttttttctttaatgttggttttcagcagtttcacaatgattagactgagtgatagtttttttcattaattttgcttcggaatcataacagtcttgaaacagtggtttgagatgatatctgatatctttcattaattttggcaaattatcagacattatctcttaaaatattccttttgctctattttacataggataaatcctatctcatatggttccttcactcttatctggggttttcatctgcaatttaggcttcgtatctttttccgacctagcttttggcttactaatcacctcttcaactgggtctacctgctgtcaaaatcacctatttaattcttaacttgtttttgtggggtttttttttttcggttctagaattttcatctgacttttgaaaaagtatccagctctctgataaactactttgccgtaaaaattattcaacttggcatccaatttccaaaatacattaattgttatttaagctgcctctgcaatacctggatctctgatgtctatccatatgtcatctcttttattctcttggttttcagtgacttgttcttgttcctctgaaatgccaggtaattttcgcattgaattctggacactgtttgaaaaactgtagagataacttgaggcttttaatcttcctccagagaagatttacttttgcttctgacagcagagcactataattcaatcaggaattgtattaattaaaagttagacttcaggtttttttaaagagatggtctatttcaagttcatgcttgtccccaggatataacccttcagggtaccccaccaaaaacctgaggtagttagcagggtacctctccttggtagaacccaaccttcaagttttgctccctgcccctagcctcacaaaacacctgcaggctctattcaacttcttgacacatgtgcaatgtcagcttcaccattttgcatttcctcaggtttgtcctgcattcatagcactctggggccttacaatgctattttaaataatatgttcagtgtttctagctgttcttggtagagggttagtctgaatcattacagtccaccttaggcagaatccctttctcattataattttaatttgcattccttttgttgttagcaaagtaaattaccttttcatgtgttttgcaggccatttttatatcttcttttattaactgtctgttaaatctcttgtccattttcctattaagttggtggtcttcttcatctccatttttaaaaggccttatatattaaagattgtagtaacactttgtctacgataaaaggtgcaaatattttccctcaatttgtagctttttaaacatttcttttggtattttttccattaaaaagtttattatgtttataaagtcaaatattttgttcttgctccctattacttctgtgttctaaggcataattagcaaagttttcctgctcgcaggcttaggggagttcacaaatggtttcttctgtaattgtgtgttcaaggagtatgttgatgaacaattgaaaaatgatatatttctagaataggcagtgtgagaaaggtattatatagtgttaacaagtccagttggaagttccaagttttgtttttccttttccacctcattctcaggagctagtgaaaagcactgtggacacagtgactttcatcttgtccttgaagagttgaggagaccatgagtcctttttttcccttgtgttatctttttcctgagttctttcatctactttcatactatgaatgttaccctatcttggtgtcccccaaatacccacatgttccattcataattctcttctcataattctctccccagtgctagatgcaaaacttgtttgatatctcacataaatgcccctacacttcaggctttaaatctaaaatgactttgttcttcttttcccactctgcttgttttatatgtcatcaattaatgacctctctgccattcatctacctaagctcagagcccagtcacctttgaatcatatttcttaattgtcaacctcaatacaccattaccaagagtacaaattctacctctgaagatctcttcctttgtagacattataaactggatctttcctgtccttgcttttttctcatcaataggcacatgaagtttaacatactctggacacagtaagtaatcaggtaatgaaaataaatttaatcctctctttaaaaatgtacaggaatcataaaacctttaaaattatgggttttctagcactttatgtatgtatttgtatttacaaatgtccttgctcttcaagttataaaaacttaagagagatttaactaagaagcaagaaatgattgtccttttgaatacctggaaatgtttttacaatatgaaacacaattcctttactacattgaagcatcttatcgaagcaccttgtgaagctgtgcaaatagaggccagtcacaaaggaaatctactgacgactaaattctcagcaatccgaaatggcagcatcagaggtctcctaaggaaacaactaaaccatttgtttctgtttaaaaaacaaacaacaacaacaacaaaaactctcactaccaggagaatgaatctttcagctttcagtcatgcctaaggcaaaattcattttctctttttcttcttctaaggttaaactacataaactctctctcacacccacccatgcatacagacacacttccctaaatttaaactgtaggttgttctgaggaaatcaacttttcctgctgtcatgctaccagatttctaatttgagaaactatatatgtatatatgtgatcatctcacaaattaaagagaacttagaaggccacacaaaagtattcaagcaactcaaccctctgtttcctcttttaaccttttctgcaaaagaagttgaatcccaggagtatttttgaatttaaaagggcaatggagggtgacagaaatgattggccctcaggctgttataattctctattcatcagggactgtggtctttttctcttccagctccaggcgaggacacacctaggatgcctgggaaaagtgaaggctccagtgacctagaaaatactccaggtcctgatggtaaggttctgagctattggagcccatggaaactacaaatctggcatattttctatgtgtaatctaggattaagggaactatctgttctataaagcaacatatttggttagaacacagtaaatttcaaaaacaattttgtgctacaaactaataaaaatggcaacctcttatttaaaaaaaaaacctgtttctagctgttttaaaacagcatatgtcctggtttaatcatatcttataatactgaggactcaatagatactttcaagactaaactgaactgaagtctatctagtgaactttatggaagcattacttacttctgcaaaaggtacttagcctacttagcctcctgttaccctgctccactcagcattcgggagagccctacctttggtgtgggctaagattgttcttgtaccttcatcacttcactccactgtatcacatccattgccttggttaaaaacatagtgagtctttaaaagcaccttaaaaataaattttcaaacaacctttaaaaacttacatctaattttgtaggcatctaaagagtctgagcctcaggaatattaatatcccttttcccctgcacaaagatgctaagggccctttgaaataccattacttacattagagaaacaactatttaagcctacctaatgtaataagtatttgattccactggcccatagagtttaggagaaccagaattggttaggtggtcagtcatttaagtatcttgccatttgggttattttagccaaaggaaaaaaacaaattactttgagttgataatgaccttggaaaaaatttagccaatggtggatgttatttatagttttaaatagaatttcctataccaggtattccttgttcccaccggcttatcatcacctgaattgccttccttaattataagcccatcggcttatattgcccaaattggctttttactcatgggcatgcattgcctgtgagaacaatgtttttaagccccagacccatcccttaagagccactgcttgttagttatgagcagttgaactaaacctgcttcagcttggttgtgatgctacagacatggttcttaactagttatttacaaatcatgttctgaggactatcaggcccatgaataaaagagaagtaaatgtgaaatacggagttttagtcctcacttagagattcaccatacacagcagaggattgcaggccctcagaagtctcagaggtaaagagacatgtttaacaagatttaaagttgcttttcccaaacttatttggtgatgggatgctttttattgtaccatttattagtaggttttagaactagtatcccttggttggaagaagaaacagaaaaggaatactctcctgtattttatcctgcacactcccacactgagaagggtgaactcacaataactttgcagagcaggatggacggtggatgaatgcttatacttacatagggttgctgcatctggggccagtttatttatggggtttaaaatgagttcacacatcattagaaactcagggcagtttgcaggtgagaacactgagacctgcttttaaaaccttccttattgggagagagttcagtggatgccatataaagtcattctctctttcaagcctctttgaagtgtgaaaatcagcatctgccactactttacactaatttcatgtttgtgaaaaaggagatacaggctgttggttttgtgcaaataaatgaaaactgcccaaatgagaacaaacagtggttacttattcaaaggtaactataacaagggtggccattatcacttgtgtttggcaggctcaaaggcgggcaggggatgggaaacccccctttataggttagaaaaagagaatacttcaagcatgctctgattggaggttgttggcctagagaagctggacatggctaactagaagtggggcaccttaagtgattgtattagggaatacatttggccttccctggttggtcccaagttggaagcagaggtaaaaaatagggacgctgacagtcactgaccaagtcctgaccattctgagtcaattgctgcagagactgtgttttggttgcctaggctagcttctgcagaggttttacatcagaattctatcattatatatgatctggccattgtctatttgtatactgattttctcagcttataatgtggactttgatgcttgagaaaatatcaatctaattaaacctactgacccttggaaaatttagagtgagtgctatgcctgctctgggttacttctggagaatggcagtaatcatgcattctatttttattcaaatgctcacatagaatacactgagtcaggtaaaagcacacgttttatcacaactacgggatctggttagatggtcggctttttaatttcatggccgctcactgccactacagcagccgtcggcaagtctacaaggtctgttttgaattcgaaattgaaagtatggcaaaccaaacaggcctgatattgacattttggagcaagctgcttacctctctgcatgtcagtgatgtgctttgctttgccttctctctttattttcttagatatctattaaagcctttgcatttatccaagaatcataatatgtacatccaaactgtcaacccaaaaatctggtctgaagtgacgactcagtttcagttgagggaagaggcaatcctgccctcccacaatgggttaggccttttttgtgttgctataaagaaatacccaagactggataatttagaaagaaaagaggtttgtctcatggttctgcaggctttacaggaagcagggtgccagcatctgcttctgatgaggaactcaggaagcttacaatcatggcgggagaggaagggggagtatgcaactcacatggccagactagaagcaagactagaagcaacgtgtcacacacttttaaacaaccagatctcatatgagctcactcatcactaagaagatggcactaaaccattcatgaaggatacatccctgcaatccaatcacctctcaccaggccccacctccaacattagggattacatttcaacataagatttgaagggggcgtctgaggtatatcctctacccccaccagtaaaaatctacaagaatagtccccaaatcttgaatgaatgaaaacaaatggaaaagaggcatcaaataggaaatcaggaaagtatcaaatcatgggtcattttaatgtgtctcagagatttaggtttaatgaatatttaactttttttttttttctggtgacagttgaaatgaatagtcaggttgacaaggtaaatgacccaacagagagtcaacaagaagatcaactaataggtaagatgccccttgtggtgagattttcaatgatcaaccagccataagaactatttgcaaatgacatactggatttcccttggttttgccaagtccccacagcatggcttgggataaaccttgaaaatctttaaaccaaataacacagcgtaaggggaaacgatcacccctagaagcttgccatcttgaagaggaaaagatgagctacagcacattcaaatcatgtataccctggttttctgtgctttgacaagtaaaaaatgtctccatccatctcaccccctggcctcctggagtggtcaaattatttcagaaactccaagctgattctgaagcattgcttttctagaagctacctgctgagttgcttggtatatctgtctttaagcataacactcaatctttgccctggagtttgtataaaggaatatgagtgtgtttggacagaaacaagcctgccttaggtcctgtttttttcacaccactacctgtggacccgtgcgtctgcacaaaggtttgttatgttgaatgagcttcagggaactcccaggaaaataaaaagcctgggtttgttacgttgaatgagcttcagggaactcccaggaaaataaaaagcctggtccagatcatgtttaggagtttttccagaccaacattctaaatctctcagtagagactaaaatatatttagaatgatgagtgtaactgagtccaaagccagtactgcttgcttcatggcagccaatacatcaagagacaacgtgttgaggcaaggaaaatgactttattccaagagccagcaaaccaagaagatggcaaattaatgtcctaaagaatcaccctaaatttatagaattttaggctccttttctctttgaggaaaaggaacagagaggtggttgagatcaagaggtgacagacatctggactgcagcaagggttcaagggggagttgtgaaacgtctttgcccttggtcaggtcacattgctcctataaatctttaacataatgttgttacttgtgtgcatactgtctttatctcttcggtggttagttttgggaaggaactattgtcatctttgctttaaagttgaactataaagtaaattcctgccgtagttagctcaccctgcatgaagagatgagcaaaagcaatcaacctaaaagatatcactggacgggggcagcggggagcaaaatggagctagtcatgctaagcctcctttacactgctacctgagtggtctataatcctcttccataccctgagggctgatgagaagaattagaagaaggaaattatgcttgatgttataactgttccaagttctggtttaaaatatttagttgttaaaaaaaaaagaaaaaaacctatggaataaatgaatcatgggtcatctagtgtaaggcacaaataatgtgttgacacccttgccccctgtacctccttgcactcactgcatgttcttgatggttctctacactttcctaagaggcttggctttaccactcttgtgctccagcatcatggaagaataaaatatgggaatgtgtgaaagagtacatgtcttattcctgtatggtcttgaatatcctataaaactaaatgtaatggtatctgtgtaatgcatgtatagcataagactgctaaaaagtataagctcatacaaacatgttcttataaacatttctcctttttttttttactttctttatatatttaaaataccctgctaagctgcagaaatgatacggttgaggagtttccattaaaaagtaatgaaatgagactaaacttgaacaatttaaatgcaagctcctcagtgtttcctttccttttacccttttgctgccaataaactataggcttcttgtctagacttttttcttacagacattatttctttcctgtgtgaccagtgtccagatgaagtgccaggattagtctgtttttcttggttaatatcaaaatgatatttttcttgaaaataaaaatgaactcatatgttaacccaaatgaatcaggtgtcaaaactttttttttttttttttttttttgagacagagtctcactctgtcacccgggctacagtgtagtggcacgatcttggcttactgcaaacttcacctccctgtttcaagggattctcatgcctctgcctcctgagtagctgggattacagtcgcgtaccaccacaactggctaattttttgtatttttaatagagatagggtttcaccatgttggccaggctggtcttgaattcctgatctcaagtgatctacttgcctcggcctcccaaagtgctgggattaaaggccaggtatcaaaacttaaagtccaaaattagtttaaggaaactaaattccaggaaggagaagtgacatgcacagggtcacctggctaataaatggaaatttaaatactccaattcaaaattctgctccctaagcaatagcaagtttctggacacagttgtcacagaggcagaatgaatgatttgtgcaacgtcactgactcccacagcaatatttacacagaagggtttgttaagatgatctggtcgtttgacagaaagaaggaacccttgctccatgaatcataccttcaaggaaattaaagaaatacagtgaaatagaattagagagctcaaagacataatacaagaatgtttggcgttgtataatttgtaattgtaaaaaatcagggatagcataaggatacaacagggagagggttaaatgcatcagtggaacactttccaaatgtaaatgttttccaacaagtatttgagggcagtaatgatggttatggaatctgaacctttggttctggagaaacatggcagactgagtgtggcttctaggttgagctttaagaggcttgtaacttccgtttttgcactctcgtaatgctcgttgcctggaatccagacaccttggaagaagcccaggttatcctatagaatgaaggaggtcacatggagaaaagtcctagaaaatgagaatccctttcagatgttctggccccagcaggtaccaccctcaagcagatgaactgtcctgctcagtccaggccagatggtaaaatcatgagaaatagtgaatcactcatgttataagccactaaatttggggctttagattgttgatacagagacaggccttatggccacagtcttgcattttaatgcccaccttggaccttgaaccattcaacgtaaggagttggaactgatacctctgcataaataaatctaggacttctagctcaagaaattaatagaaagacttggatctgcgccaggtactgcatggggagagaaaaaggctcccaagatagatagaaaccgcaaatacactgtgagtttgaaacataattttatgtgatccaaagtcatgcagtaataaacaaattgaaaaatgaacttaataattgattacagaccagtgtgattcctggtgtatgtggcaaatggaaatatgaaactaccccatggaatttctgcaaaagaaaaacaaattctgaagttgaattcatagttttaagacttacagaacacacaaggaaatgatccattttgagtgagagtcagtaggtaaaattacaggacaattagcactatgagaacgttaagagagtaggaaattttgaagattttataaaataactacatttgaatgacaaaacaaataaaagcagacctaaaacaataagaaaagagcaacactaaataattaacgacaatagaaaaaacaaattaaaatgtagtagtatcaaagacacgtgaagagacatgaaggagaagaagagaataaccaagacatgttaagttcaataagagttctacaaggagactaggcagtgtagggctgtgtatttgattgatacccaccaagcatctccaggtttaacttaatttggactgagattactgaaaaccagggaccgcagatataaaatacagaaccacaaggaaatcccaccacgatcccactagtattgaattataaagttaacaccaccaaatgttacagaggatgtggaggagctagaactcttatacatggctgggggacatataaaatggttcagccacttttaaaaaattgttagtttcttgtaaagtatgtatccatcctatggccccacaattctgttcccgagtatttgagagaaatgaaaacctatattcacaaaagccttgtacaagaatacacatagcagatatgctcacaaaagccccaaacttgacacaacacaaatgtctcgcagcaagaaaatgaactttaaaaagtgacatatacatacatgggaattctagttagcaatgaagaggaacagattactgttaacaaagcagcaacatgaatgaatctcagaagcattacactgagtgaaaggagacagacacaatgaggtacttgtatgattccattagcagggagtcctagggcagaaaaaaactaatttatggagatagaaatcagatcatttgttcattccagcaggagtggggtagtagggaagggaactttccagggtgatgtcatgtatatcttcttggtggtgtgggtttaatgtatgcatttttcaaaacagattgaaatgtatgcttaagatctgtgtgttttcctgtaggcagattatacctcaattttaaaaatctaaaaaaaataaagagtataggtttttgcaaggcacagtgtcttcttagtgtcctctcatgggtagtgaataaggcagataatttaataagtacaatctgaagtggtggcataaccatcaatgacttttgcaaagcagcattatgaaaattgttattatttatatgctgatccctggaaactagagtgtgagcatgggcctgaaaagggaagccacatcaactcagggttacagttttcaacgaatactttgaagaattgagttaatcgtccccatcagccaaagctcgttgtcaatgtggcatacatttattaacagtgatttatatgctctttaaagataccatgtgccagcaattacagttcagacatctaaagctctttgatagtcaaataagatatttctgggcctatgtgaggggtgagagacatttaaatggctgtattaaaaatgtattccttgctaagcctgtgaagatgtcttatctttaatctaacaaatggcttctctttgtcttcagcaggggcacaagatgaagcgaaggaacaaagaaatggaactaaatgacaatcctcagcatcgcaaggcctctcctggctctgggggagctcgggaagatagcagcacacgctgtggaggagggtgggggtggggggaaggcaagtcccatggaaggacggggaatcctttactctaatttctccagctgcattttgttccgtttatctgcagaaaaagaaagaaaaaaaagaaaaaaaaagtttcctttaatttggtggagggacccatgttgacgcatctttcaggcattatccttgtaatttctgtcttttctcttacaactttgccccagggtcacagtggcttgattgaacactcacatgtgtatcctggcccctgtctgctttcttggttatttcacaaagctggtcacacagtggtttattcaaaggaaggggaggaagacagtggtttgataagctgcaggataaattttaggaatcaatgagcccagcagcagtataatccccagacagaggaggcaggatagaaaatgggcaaaagcctcggaaaccacttggaaaaggtctggacaatgaggtgaaaatattttcttcagggttcccaaggcacaatttgttccaagtggctaatgagaaatatggaagctgaattttttccagagcagagtgcagaggcataacagaagggtgggccctggcagccatctgggtctcttccttcctaaccatggtggcaggtgcatccttctttgacactgactttcagcagagcttacttggttcatgaggtcttcacatggagactaccagcaagaggtgactctctgctgcataactgtaaaggatggccctttgctaggtgttacagttaaaagctaagaaaaggggcagtgcatttaggacccaaacatatgcctatgaatatcaaaagctcctcctgaaattgctgtgagttttccataaaagaatatcctgtcttcacccaaggcttgacagcccacagagtggtctcatttgaaattacaggaaattagagcttttgcttgcagttctgccttcctggcctgtgtttaaatgctgtcacttgtttatgccaagttcaaggctgattcaatggttggtcccctcacccagaaaaccctgaaggggaggatacagctctgaaggggggcagcagtactaaaaacccaagatgccagtggtatagtgggcacaagggatggcgaccatgaggatgccaggcatcatcaccaatatctatcctagagccagtataaggccagatgcctacttcccacagcctccccgggttccaaagtcatgtcattgttttcagtggaaacatatcgtttgttgcatatcttcttaaatccatcttccttgtaagggctttagaactaaaacttacttatattgtttttccttaacagagggagaaaaatagtggattattatttctaaaataaaaggatgttctgctttctaaatatcccatcaaaatcttcagttttgcacttttttgatggaaaattcatcttatcttcctatgactttggttttagcctttctgaatttgttaccccttctggatggcttatttgatatactggaatagttaacaagctatacttcagcatatgcactatattctaacaaattttttttaataaaatcaagacatcagcaagaatgacatttacgtgacctcataatgtgggattatggccttctgttgctattccagtttgatatggaagcatctatatcctctattgccgttagatgttgttgcttttcagaaaagtaacgaaaaggctcattttaaagaatccaagaaacgatgtcatccaaatattgacagtttctacatttcatgccatctttataactcaattgaaagttgccgtcattcttgtgaagtatttgacaagtgcaatctgctagaagctcgtttttcttgtgactcccaaatgttagtgctacttagcctcagtaatgagttacagttgaaaaaaacatgagggaaacagagggacagagattttctaatgaacaatgatggaagagacctaatgtccttgctagaaacagccaggatggaaattatccagccctggcattctccttatcatcaatgacagtcattttattcatttatttcaaatgtgggtgggctagaagtggaaggagggaattctctctgcctaaaaattctagaagaatgaaagtaatctttgtatccaggaaactaagagaatgaggaataaatatcttcagcccgactcctgaatttgtttattcttccatctataattagattgtgttttcatttttgctttgtcatgctttttggttgttatttggctatacagttttatgctttaaaacaaatgataaagttaatttccaattcaatagtgaaatattaacaatctaactatagccagatcaaagacacctgaacacagaaaacctttatttgctggtgctgccattgcacaggctgtacaatgaaatagatttgaaaagctgattgattttcccgcacataaattctggatgtcaatttccaaccaaactccaatacagctatgtggcatgaagagttacaggagggagggaggaaaatagccctatgttagtcatgtttgcatacagaggatcaaagtaggccttcaccataatagttctaattaaaatggtcctcgctgtaggagagacaaaggggcttttcctctagctggtaactattcagatgatggacaagtcttctttcataaaagattacaaagaaggcatccgaatcactgtctgtgatactgggtcacatattaatcactgcagctaattgtaaatctttctatgaaacactgaaaagcctctttgtgaattaatacagttctgcttgatgcacttgatttgaaaagacatttctctgtatgtggcgcatgtcggctttgctttgaaaaataacaaagttagcagaatatgttcaatatattttcttggggaatagggtttttattacatgattcattaaggatttgccttaccctgacatttgtgatataaaggaaaatcagaaaaaaagtaattttcttgatcaagatatgtttttacttaatgcaaataaatgtagtctgttgcttgcaaggaaaaaaaaatggcttctgatatctggtataaactgctaaataggataatacgtgcctcttttgttaaaccggcatttaaatgctggactgcttctaaatctgtttgtttcttttcatctgtgccatacactaaaaaacaactgttgccttcatactatatttgttagagcagaatacaaataaaatttgtttgagaggataatgtgaaattatctgtgttttgtgaaatttgttctttagccacaagcaatgagtaactaaaactactcacttaatactatttgactgcaaatatatatatttaaaattattcctgtaagtcagctttaacttactgatagttttcccttactaagactggtcagcgtgttggccgtgtttttcaaattttaaactatagagtagttttgtatagctgcaaatcccagtgtctaaattttctctgaatactagataattacttaccctagcatcagcctctgaaatgcaagttataagttgttgagataaagccaacggtcctgtgaacattggtctatctttcagaacccatgaccatggctggaatttttagtgagcaccttttatgatacagtcactacgctgacactacaatcatggcagcagtgattctcggtctactgttggtggaattgacagaattacggaattgttaagagcttagcagtaggccaccaaaaaatcgctacaggaaaaactcagtgttcttttgaaaatggaatacgcttgccaccaaatttagctcccttcatctcctacagaaggtatcagcattattatttgaggaggcaatacagaaagccaacccctttgtcaaacaaagccagatacttaatagtttaaggataataaggttttccaaactgctgtaccactgaagtgtttttcccataataaacaaggttggatgagacaaaaattatagataggacagtcttatgctgcaatgggcaaccgcaacacaaatgcttcagaatagcagtgaagataacgtgaaatggccaggtgcagtagctcacgcctgtaatcccagcactttggggggccgaggcaggcggatcacctgaggtcaggagtttgagaccagcctagccaacatggtgaaaccccatctctactaaaaatacaaaaatcagccaggcatggtggcaggtgcctgtaatcccagctactcgggagaatcgcttgaacccaggagatgaaggttgcagtgagctgagatcatgccactgcactccagcctgggtgacagagagagactccatctcaaaaaccaaaccaaacaaaaaaaaaaaaaaaagaaaaaaaaacataatgtgacatgaatctagccctgctagatgcagtttttcatctctaaccaattttcatatcttggcctggccctcttgtgtttctcccccaacattcccaacatttctgcccctgtgccttgcattgaccaaaggtgccaacaaagattgcttaagtgtactggtggttctcggggctgaaaggggtaatggtatcaatttaagttgttctcgccaagactggcccagctgtggggttttgagaacgaaactgcctcagtttctttgtttagaagatgtaaatactaatacgtgcctgaactctcttacaaatgtaaacatgaataaaatgccaaaatatgatactttaacgtttggaaaagcacttggtaaattattagcatcagattatgctatttggtgctgttggcaaatggtcctttctctagctgaggctgctccaccaaaagaagaaatgatttttacaattagtaaatatgaaattttattctactgaagttgatttaaactttgccctcaaattaaggacccgtgaggttaagagaaattgttttgctataatttagagaagtgggaaatttgaggtcttaaaattaaaacatctacacactgacaaaaatactgatggcgtgaatttttaaagtcatcttttctctgataataaccagcgtatctgtaaagaaaaaaggcagtacacttctctctacttcttggttcacatgtatagaaggacatagatttgcaaggagataactataccaatatgcacttcccttccccagggaggattatacttcctcatcttactgaaattggatatggctgtgtaatttcctttgttcaatatataggcagaaatggcatgtgtcacatcaggcagaagcatgaagactcacgctctattctttccccatggtaataaccagcaatatcccagacaggctgacctgtcaccatagatccgggagtgaagacatagtggagtttcaggcaaccccagtgagaaggtgtcatgactgagaaatcaaactgtgttttgaaatttgggggtcatttgttaccctatggtaacctgtcctatactaactgatacataggccatcaacatttaagtaaaaacggtaagaatctaaattatcctcttttccaacctcttctttggtgactctcaacttggtttaagatgctgccagcatattggccttctgtccactgctacaacacgccaggttccttccatccttaaggcctctaaacttgaaagctctttcttcccattctcatgggtctggtaccttgtcatccctgagatctcagctgtaatgtcactttctagacatgccgtccctaatggcccagttgaaaatagatcccttttccctacttgtgtttgcctatctaactcctgtttgctacttcagaacacctacaataattttgtaattgtttatttgtttatagggcagagataaaaattatatgtcacaactcagatgtataaaataacgtagctgctctccaacccctgacacccccaccaaaaaacaaacaaacaaacaaacaaaaaaaaacccaagcttatcttgtttccaagctctattcaaatggtcacaggggattgtggtaaaataatttaaatttgtcaagtaaagttatctagtcatttccagtataaaatgctttggaataaagatttggtcagattcaaggtttaaactccacactaatgctatttcttgccacctaaattttgtgcccttctcatagataaaggcctttctttctttctttctttcttctttctctctttctttctctttctttctttctttctttctttctttctttctttctttctttctttttctttctttctttctcttatttcctttctttctttcttttttttttttgatacagagacttgctctgttgcccgggctggagtccagtggtgtgatctcaactcactgcaacctctgcctcccaggttcaagtgatttgcctgcctcagcctcctgagtagctgagtttacaagtgcccgccaccacatccagctaatttttgtatttttagtagagatgggctttcaccacgttggccaggctggtctagaagtcctgacctcgtgatccactcgcctcggcctcccaaagtgctgggattacaggcttgagccaccacgccctgccaaggccttattttttaatcaccatgcaataaaactgccaataaatattaaaatagtagttactataatattttaaaagtaattctctaaatgttttctcaaagagggtatcaagaataaaatgatgtattatttagaaagtaacaaaaccaagaacactgctacggtctgaatgttggtgacccccaccctgcctcaaaatttatatgttggaacctaataaatacccatgtgatactactatgaggtgggacctataagaagtgattaagtcttgagggctctcctttcacgaatggaattagtgtccttataaaagagatagagaggaaccgccttgcccctggtgccatgtgagaacacagcaacaaagtgccatctaggaagcaaagagccctcaccaggcggacaacctgctagcaccttgattttggacttccagcctccagaactgtgagtaataaatttctgttgctggcatattacccagtctaaggttccttgttacagtagcctgaacaaactacaacaaacactattaaaaacgtgagatgaatccaaagcactatttagaagaaaatttagttttaaatgctctaattgtgtattacagcattttttgcattaaaaataaaaaagaaaatagtattaaaagcattcaaattaagattttcgaaacaaaaaaaatccaaagaaaatgaggattttatatatatgtatacacacacatatatgtacataaaactgagaaattttaaaagcagtaaactattaaaatcaaactaaatctgggttctttgaaagtcaattgaaatagataaataatctgtaactcttatgagtaatttttaaaggatagcaacatagaaattaaattttgaggatgataatattaaattttatgcataactaaccaataacaagtcaaagaaattggagattttttaagataaaatttaccaagatcaatataacatgaggcagaaaatccacaaaaaatttcatagcagaaatgagaaaagatatcaaaaagccacccaggctaactatatctatctatctacccatatatcaattgatcgttcaatcgatcaatctagctaagaattatgtgccaattgtcaaaaacttaagaacaatcacagataatatgcttgatttgtttccatttcatattattttataattgaatcatactgtatatcatttatgtatactactttttcacatggttgtaccacaaacattttcttgtcaattaaggattttcccaagtcatttaaaaatatttcctcatatggctgtaatttttacttccacttccctattctgtgatacttagtttccttgattttttttttttattttgaatgaaatgacgaataacacttttggtcacaaatttttgtttacatcagggtatatttccaaaaggggattttcagggttcacaaacacttgatatttattatcgaattactttgcaaagtcaaactgctagcaattaaacgtgagaatttccattttgtagaacactcactggccttgaggggcctataaatatggacattaaaacatgtcagcatgagaaacgtttgtcattattatttagcattttttgtttactaaggtgggtaaacaaatttctatctgctatttttatttcctgattaaggaattagtctgttcatgttctttggtcatttgtcagttgagattttaaattttcattgatattcatgtgcactttatatactgagactattatctttttgtcatatttcctgcatataattttctacttgtgctttgctttataattttgattgtgatattttctgacacacagccttctttttatgtttgtacacaatcaagtctctccctttgtgctggctttcatcacttttggagttgacattgatggtttttgactactaatcatccagtcctgctgcttctggggatgaagcccttcagcctaggagaaaactcttcttatgcaatttctggagctgtccttccactcctactctctgtccagacaggcacacataggacccaggctggacaatcacaggactttatctccctgttttcagtgactgattagagagaacatgtgaccgaaactgcgcccctcgatgtcttccccaacactttgatttggggagcctttgttctgactcaggaatgtgagccattgaactccccttttaagcaagtttgagttaggtttctgtctcatgtgactgaatggctctccaaatctcccaaagaacaaaagtcttacagtgtcttacgggctccctgtgatgtcatggtgccctcctccctcatacctctacaaactcatcctctgctattctcccctatgggcttctctactccagccacagtgacctcctgaaatatgccaggcacatttcttgccttaaagctttgcactagcccttctagaattttcctcttgtatatatgcatatacatatatggctactttgcttacctccttggagtcttctcaaagctttctcagtgagatctgccatcaccaccctctttaattctgcaaacaacccccaactgaggccgtcctcactggctctacttttttccttttccatggcacttacataatttacctattattaaattcatttcaaagaaaaccgtattgaaaatctcccactgcttgatgaggaaaaggtagtccctatgaggacagagatttttatctgttttgctcgctgaagcaccagaacagtccctgaaacatattaggttcccatttagtgtttactgaataaatgaaagaattccactgactactgtgttctgggaaacacttggcaaaaccccttttatgagactggtgacccctggctaaggtctcttgcttttctctttggagaaaaatgtagaggagagatgaaattcaactctgattattatggaagttaataggaggctctgcaccctgtcccagaagaaaaatattaataaagaatgatgaaagagcaagcaatgtttgcaatattattgcaaaaactcccttttggttcataaattatgcctactccatatttaattcaaaaaagggggaatctgttcattgatccttcctcaaactgagcaagggattggattttgttttgatgttaccacgttccatctttttatctgagagttgatgatgacaagaactgtttagctagggttggccaggctaccttgggaagacaatgacatctctatggctgaacacaatgaaggttgacttgcaacacactccttgtgagttgagcagctttcctacaggcttccatcctgtggtgctgttaccttcaatgtgtggccttcaaggtcaccatggaacaagaagagagaatggagattgttatcagccagatacaggaaacattgtacatctccactgcccacatttcactggtcataactcagtcaactggcccaacttgatctcctggaaaatgcagtttgcccaagcacctaggaaaacacatatgtttggttattacctagcattgcgtctaccttccctcctttgagtcatagctgtgggctgtggaccagccctcaattttcattccccaagaccatgtcagccacagtggcttagggaagaagtaccacctggatatcttagatgctcgtagcaatctcacactgggcaaagagcttaatagtagagtggaaaaacctgaatggtgctgtatgttgcctcggacagaaagttgaggatgtagtaagataagcttttgcctggccttgttgtcctagaactgactttttatttgttcttaagaacaccaaaagaaaacatggtccaggggaggtgtgtgtgtctaatttttctaagtcctaaaatgtgcagattttgaacttcaaaagtctttccctgtccagagataggcaaatgttccaccagatattcacctatattttcctttattgtttagaaattctttgtgtttgggtgtgtgattccattttttacacctatatctttaaggcactttgaatttatttcagtagttgatatttagaagggaatgacttggttgagtagctttaaaactaatcctagcaccggctgggtgcagtggctcacacctgtaatcctagcaatttgggaggccgagatgggcggatcacctgaggtcaggagttcaagatcggcctgaccaatatggtgaaaccccatctctactaaaaatacaaaaaattatccaggtgtggtggctcatgcctgtagtcccagctactcaggaggctaaggcaggagaatcatttgaacctaggaggtggaggttgcaatgagcagagatcacaccactgtactccagcctgggccacagagcaagacttctcaaaaaaaaaaaaaaaaaaaaaaaaaaccaaccaaacaaacaaaaaactagttctagcactaattatgaaataatacatccagatctttttgctccaagtttatttctttaacttatacttattttacatttatacaaggatctattttcttggcaacatcttcctttggtttctctagtgctattctgttttaattagtgtaattttagaatatgtgctgatgtttattaaggcaaactcaatacctactcttctttgctttcaaatgttcttggctatcacttattgtttagtggtccagacaaatcttaaattaacctaatcacctttccctcctacagtccccgttttctaattctccctctctcagtatcctcagaaaaatgaataaaccagtcagtttagccagcccatgcttagtttaaagtgggatggcatctgttataaatgcagcttcctgagatgttccagagaacaacatttctgttcatctctggtctactgacaaggctgggctgtggtatgaataatgattggtttctgaatattctgttacaaagccttttcctgactgtcttggcctctggtctcatcaatctcgtctaagccgtttggttctgcatagtgagtcaggaggcaaaagctaggtaaatatcactgtgtcttgagtgatcaccctctttaagtaaccatccgctttgtaaacaaatgctgaaggactcagccgagctggtctacaggactctcaatctgcaggcacgggaatacagcatttggttacacagggcatagatctcggttattcttgaagaaaactgaaacaagttcagcctagactcgttagcagcctggccttgcaaagacttacacactgcaacctcagagatgctgagcctctttaaatgatccaggccagggggtaaaaagtactgttttttttttttttttagtttttggtgaacagaaagcatcataattatagacagagaatgtataaatagctaatgtgaaatagctcttttcattgtttaaatagcttcatatataattcatttaatcttaacaaaaatgatgtaggtactatgattatcccactatacagataagcaaactgagacaccaagagacaaagtaatttgcaacaagcccacccagccagtaagcagcagggatgtcatttgaacaggaagtttggagccaaagattactatcctaaccactatactaaaggctctcaaacttgggtcagcatcagaatcacctagaggccttgatcaatcacagatcctggaccccaacctagagtttctcattcaggaggtcatgggtaaaaagctgggattttgcacttctaacaacttccaggtgctgccacttctgctgctgcccagggaccacactgcgaaccactgaaatggttggcaggtgtggtcccatgaaggcgaagcaggatgaacagaccgggacaatgactaagccctgcagctaactctcagtctctaaaatcagaatatctgtattctcctagtccctaaagcaacccaaagctggcattgcctgcatggtgccagcttcctcttatttccattaggtttataggcagctatcaaaataggagacagtattaagaccactggctgcagcatcaaaacatctgggtttaaatctcagctccatagtttaccagctgacttaacctctccaagactctgctgtcacatctctaaaatactgatgatcattatttatcacttacgattttaataaaggtaaattttatacacacacacattgcttagcatacagaaaaaatgatggttaattatttttatgagaaagaggtatctgattcccttccttcctctcaaataccagcagaggtatttatctttgagaaggcactgcagaaagacttgtcagggtcacgtggggcactcaaactttctttacagctataactgtgacaaggataaaagagaaaatacacatacttgacaacctgctcccacccgatcctcatctctgaggccattttactgtgtgcagaagaaacagaggaattggaaaaatgggaagtccccaaaggaggcgtgcaattaacacaaagggaagccgggcaactggtaaaaaagagagatcacttgaaatcattttagtcagcgttatgaatgaaatatcctctccagcaattattgaactttaaaaaattccttctagctacaatttctttcatttatttaacaaatatatattgagtccctgttttgtatcagccactcccctgggtt

SEQ ID NO: 243 - DNA, 31827 bp, Homo sapiens
atgggtagacagggaggacaggcactcctggcatgagaaatggcacagcaaactgtggaggtgggaaggagggagaacaaaggacttcaggactgtgtcttaacctcatggtgacattctttagcaggacccaatacagagccttccacacggtaaacgtgcgatataaatgctttgttccctccttggtttggagagggtgggatctttaggaccagcacttagtgatgtctttccacagaaggatgggtaaggagaaaacgtggctctgaataaaccaggggtttggagctaaacacagggaagggtcagattccaggggcagtttggggtcgtcttccttggccttgcccttctttcaccctgtcgtccacacccactcgccagtgtctgggctctccctactcccggcgtcgtgccagggatttcccaaaccgtccaaaagggctgggcttggtttgccagccccgggaatccctggagtctccgtgttccaggcttctgtgaaggatcagggaaggggggctaggaaaggggaggctcctcctggggattgcttgaattggccccctcaacacgggcttccgttgtcacgtgactgcgtcccaggtctcgcaagtctggggctggcgagctccagctatcctcctcccgccccccggactgagcgctggagaagcacggactgagcgctggagagcgctggcggcagcctgggtggctccttctgctcgtagagctccccacacctgctccctcccccagctgtgctaatccaggcgccacccaagcctggggtacccaagcaggggcaaatgggggatggctaggtctgggtgctccaaggccggtgagtgggcagggctgcggggcccacgcgcgccccggaggttgctcgccaacccctgccccagcgtgcaatcgcatggttgcggcggccgggaggctgcgcgccgagcgcaagccgcgagcacaaacagggcgaggaggctggtgtgagcgcctgggcccgctgccagcgcgccggggctggaacacaatgtcccgagcgggcgggcgggcgggcgagcgcgagcgagaacagcctgactcagcagctgggtaagtgggtgtgctcgctcaccagatcaaccgctcttgcagcctgcggtcagcgacgacccggcactcggcagctccctggaacgggaggggcaagcatacggcccgctcctctgctcgcgccccagcctgccgcgcgagacctccacgtggccggtttgcgcatccctctgccttctcgcccctctattaaagcgtctcccagcccccagcctgagcgcagcaggctctgcccacctgggagaagcactctcctcaccccacccgacaggtgtggccaggcacacagctgctgtgtacatgtcctgttttccccaaatctcacccctttgggacgcctcggaaggtcttggcatgggggatgtaactcttagttgcaaacagaggtaggagtttgttctggggtagtggtggagtagggagccgaggaaggggatcctaggagaaaagagggacatagggcaagaggatctcccctatctctgtcctcagctgacccagagttcagagtctcttcctgccccctcccctcaaaaccactaggcccctgaagatttcctcctcggagggagggagaggcaggtggtgtggtgttttgaagcccgagaccctgcttttctgcccccacccccaaaccacaataaagacccaataaagatcctgccacctagccacaaagctcctccttccccctctatgcaggggaaatggggtcccatttggggtccccactggggacttatgctgtccctatgctgtctcctggcgtcttgtggggccattgtgaggatgacagcagcccagagcagggttattcctgggggtggggacctgtctcacgtcccagcttcctggggtgcctgcgcagtgccctgagggatgctttgtgcctggagagtgccaggacaggcggggaggagtggttccgggaaaggccctggcaggcagcataggcctgggctccagggcctttgagagtgggcctaggggagggacctcaggctgctgaagtgcctcacctgggcctcctgccatctggtggcatctctggcaccctctgtggctaaagatgccaacacaggcctgggccgtggacccccttcccatacacacatcacgcttcccacacaggctcttacccagccaatgcacactgcatctcccagtcgagaggcaccttcactgccatctactcccaccttcttcctgatgcttgaaatctgtccgtgatcccaggtcagtgattgctcgaggctgtgacagggacactctcagacagcagcccactgctcttctggacttccctatctccaagtccagtcacctacaggacacctgcccttacatggcctagaagtgactgaactcatattcatgcccctcataccagctcctccccattgcccaccatgaccctcccagtcctaaaactcactgcaaaggtagattaatttttaactgctttctctccttcaccatccttatgtctgatctcttatcaaattcttccctttgttgcttttatttcaaaagatattgtttgttcattacttttctccttcaccctttcccctccagccccatagagtccacctttggcccaaattctcacagcatctgccacactgtcctttctttttccttcctcctacacaccctgctggaataatctttctcaaacatcatttattgtgtatgttatcaacttcagactcctcaaccaagcacagtgagtacactagctaacctgtgtactctctgtgatgggacctgagttcattcatggcatgtccaggccacggggtttagtgcagtgcctcctgcacagcagtagggcagcaaatgttcctcgtgacccattcatttggtggtgttccctttccatccttcctattctctctcctgccttggtctccccagtcccatcaagcctattggcttactggtgctcactggggcccttttgtttgaagtgccactatttttcatttccccaaaatctttggtggggggcggggggtggtggctggtggggaagggagaggctgacatccaagttaatatcagggaggttgtggcaaataccaactgcaaaaccttgggtgcagagtagaatgagggcagatgcctgctaggagggcagatgcctgctcagtaagagaacaaaaccacagaggagggcagaaggtggaaaggagagtggcgtaactagtggcttccctctgagcctgtgagctgcctttaatcttttcctttttttttttttattttttgagatggagtcttgctctgttgcccaggctggagtgcagtggggcagtctcggctcactgcaacctctgcctccccggttcaagcagttctcctgtctcagctccccgagtagctgggactacagttgaacgccaccatgcccggctaatttttgcattttagtagagacagggtttcaccatattggtcaggctggtcttgaactcctgacctcaggtgatccacccgcctcagcctcccaaagtgctgggattacaggtgtgagccaccgcgccctgcctaatcttttctatattttattgcttagttatgtcctgcagtattttaaaccctttctcccatgggctgtaggctccttaatggcagggacagtgtcttttatttatttgataccatttacttattttgagaagtgggcatgaaatactttggagggcacataaaacttgggtctggatcctggttccaacacttagctgtttggccctgggtaagtctcttaacctctctgagccagtttcttcgtctgtaaaagtcgctagtgacacttgttttgcagaatgaggggcaaaaattacagagaatacaaagcaccaggaaagtgtctgttgtacccaatagtttatattccttccccgtatggttagagcctttcctaaattgggaggaaggtgttccttaactactgcccatactgggacactttaaacttgaaaaggggcactgttaataattacgtccgttccagggacgcagagccaccctaccctagttcacaacaactggcagggttcggatagcacgcaatatcccagtgcctaagcacagccccaagcataacgctcaataaatgcctgttgaatcaacgagcgaacagaagctgaccctcactccgttttttggacatcattgagtgaagcaaattgaaaagcccgcccccgctgcgcccccacccccaccccgtcccagagccaccagcagcctcaattccccgaggtctgcccttctctagcccaccgtcccgcccccagttgccttgacatcagtgacgtcgcgaggggcgtggcctctctccatcgtctcctggtgccctgggcccctccgcatccgaacctggggggaggatgaggttggtggcctttgaccgtactcgcctcccgccgggccagcatctaactaagcccgcctggccgcccttctcgggcgcgcagttgtctcgagtgtgggtacccacctccacccccaccctcacccgggtgaactagcgggggttctagagagtgccggctcccagtgagccctctccaacagctgcgggccacgagatcctgagaacctgggcccagcgctcagcccaggcccgccccttcccgggcagccccgtcgctccgcgtcctagggggcgggcgggaaggatgggacccccgcctaggaggcgcgcaggcgccgccgagcgcgggagagaaagagttaaactaggtgccggcgccgggcgcggcgggagtgggggaggggagcgaagagaaagtgagagcgggggcggagcggggacgggagcgaaagaacatcctgtgcccgtcgccggatgcgcgcggggggaggaggtagtccggggagggagagcaagaccgggggaggcccgggacggggaaaggcgcggcctccttccccccgccgcaacctcctcctctgggggcgctggccccctctgctccccgcgccttaggctgagctacccggaggccccaggatctggttcctgggcaggagtaagcgctagctggggagatgatctcggagagtgtgggatccacgttaaggcaggggcggcccccagcctttcatctcttggctttctgcaagggaagctcgcacgtgttgagcgtcccctgtgcaccgaaagtacacacattatctcagtcctgacagcggcacttccaggcagtagacaggaattcatagactcgcattctagaggaggaaacagactcagattatggaatttgtccaaaccccacactgttgggatgtgaatgcaagcctgtcggactgcaaagggcttttcactggagtttagggtagggtaatttccccttagcttctatgcgcacaagtgctgggccgctgcagcgtcaccctcgggaatggcggtgtcttttcgtagaggacccccaacagtatctgtctggagcttctgtcattaactaggcttaaacaaccattgccaggatactggtaaagagaatgaggaaggggccttaggattccacaggtagttggatggttcttaggaacacagtttaggggaatgtgttgcagggctcctgttcctcatttaggtatttgtgggggcttcaaagatggctccagagtcactcaaagcagttacatggattacaggagttgggattgattgactttaagaagaccagggaggcctggtgtggtggcgtaagcctgtaatcccagcactttgagaggccgaggcaggcggatcacctgagtgtaggagttcgagaccagcctggccgaaatcgtgaaatccagcctactgaaaatacaaaaattagccgggcgtggtggtgcgtgcctgtagttccagcaacttggtaaactgaggcacaagacttgcttgaacctgggaggcggaggttgcagtgagccgagatggcgccactgcactccagcccgggtgacagagccagactccgtctcaaaaaagagagagagagaaaaaataaaaaagacgaccagcgtgagaggtagtgggtaagtggaaggaagggctgactcatgtgcttttcaggctgggatgcttcgagggctaccatctgtgttctcactgcctgcccacgccccacatgttgtccaggtgaaacctgcggagataattaggattatagtaaacatttgttgagctctgtgtgttgggcactgttccaagtgctttacttaatcctcacaaacaatcccatgaagtaagtcttattgtttctattttacaggtggggaaaatgaggcacaaggagatcacaaagctaagtccatgactaaactggtttgtttgttttgagatggagtcttgctctgtcaccaggctggagtgcagtcgtgccatctcggttcactgcaacctccgcctcccgggttcaagcaattttgcctcagcctcctgagtagctgggattacagatgcacaccaccacgtccagctaatttttgtattttttagtagagacggggtttccccatgttggccaggctggccactctgaccttgtgatctgcccgtctgggcctcccaaagtactgggtttacaggcgtgagccaccgcgcccagccctgaactggttttgaaccctgcctagaacccatacttacttactaaactcaaatgtacttaacacgatgagaacatcggccttgaaggtaaaaatgctggcatagatggcaaagaggtgtgtgcttgggcagctcatgtccttttcctgggtaaggcaggtagtaactcacagctggctgtgtgtattttggctctcagacttctttttaaccagtggttccagatttctggatttgacagaaaaacaaagccagaaaacaagtgaaagccaggttcccataaagagttgcagctttaaatttacgctccctaagggcatggagaacatacctacgatctattatcaccatcattaaagaaaatacttctgtttctttgagacagggtctggctctgtcacccaggctggagtgcagtggcatgatctcggctcactgcaacctctgcctcccaggttcaggcaatcctaccgcctcagcctccagaatagctgggactacaggcacgcaccaccatgctgagctaatttttgtattttttgttgggggttggcggggtttgcttcagcccaggccaggctcgaactcctgggctcaagcaatccactcgcctcagcctcccaaagtgctgagactgcaagtgtgagctaccacgcctgacctaagaaaatacattttaattctcaaaataggagtgacatcatctgaatctgttagttccagccaggcgcggtggctcgtgcctataattccagccctttgggaggccgaggcaggcggatcatgagctcaggtgttcgagaccagactgggcaacatggcaaaaccctgtctctaccaaaaatacaaaaaattagcctggtgtggtggcgcatgcctgtagtcccagctacttgggaggctgaggcgagaggattgcttgagtctgggaggcagagattgcagtgagccaacatcgcaccactgcgctccaacctgggtgacagagtgagaacctgtctcaaaaaaaagaaaaaaaaaaaagaaagaaaacaattattcccaagaaaagatggtcaatggactttatgccaacaaatagacattcctttgtctttaatttttttgttgtactgtggactagtaaaaatgtcactctaggaatgactctgcctctaatctctctgaatcatttgaaggcagaaccagaagaaatgggccttaggtgtggcaggagggagttaggttgcagccaagaaagaacactttttggaggtctttaaagaacaggtgagccttacctgtgcttaggaagtgagggttgcagaatcggctccatgggatggaggggccagtaactctgggtcccaccctggagaagggcagagcaaggaccttgtcttgagggatttattctcagatccaccaaagtagcctgggaacctaaatgacagttcccatcaggcagccgttttctgctcggagttcagtggagatgcgatggggttgcatggcagtggggaggcttccatgggcttctactcacccctcaccacagggagttcatgtagtcacccaccttggggctaaatagagtgccaggaatgatgacccttgaggagggctgaggacaggaatagaatggccacccaggagtgttgcttgttccctgcctgctgcctagggtgtactgggccaaggctctgagtgggcaggcctggctggccgcagcatcattggagatgctgtttccctacctccttccatcctgggtgcagcccaggacccagagccttctgtcccagttctcccaaaaagggatcagggccaggtaggtgaacacctgttctggtgcagcatgctcagcactggctgtgggcgtggccctagtttggagctggccacttgcctgttctgcaacagagagtggggacagaagttgcggggagaccctggtggggaagagggaagggtctggtctcacctgccccatcctagtggtggggatcaagacctccacaggtgggctcacatcctctggggtggtggcatcttctgactccagaggacctcacaagccgcctcatatccctggggaggctgagaggtgatacttccaaatttagctgaaaggcacagacttacccacattttaatcctggagttttagaatggtaaatccgaatccctttaggttacaaatgcagaaacagactaaggcaaaggcgatccctttctcctccaaggtcactctggttagaagggtctggagccccagttactagatgctgtcattgttctgccgccaagtccttaaagaatggcagaacatgacttaaaccacctgctaagtacaagattctatgctggagatgcaaaggtagctgtcctcaagagcactttgtcaaacaggtaaacttcagggcaacatgcagatgctggaaaagggtggatttgcctcaagagtctgtgcatgctttctaagatactcccctccttttcatcctctgatgcggggagggaaccctacctgaagaaacaccccaaggcccaggggtagatctagggtggagagatcacatatgggagggcccggaaagaaaaggaacagggttgtcaatgggcataccccaaacacctcacccagaaatgccctaaggccccagcccggaaatggacctctgctgccctctaatggtggaaaggcagcctctggagctacctgctggggtccccccttaaagaagaggagatgtgaaggacacttctgccctctccccttttattccccttctgtcttatgcttcatctcctgtggtctctaaagcagaaccttctctttttttttttgaaatggagtcttgctctgtcgcttaggttggagtacagtggcgtgtcagctcactgcaacctcaacctcccaggcttaagcgattctcctgcctcagtcccctgagtagctgggattacatgtgtgcgccacaatgcctggctaatttttttgtatttttaatagagacaaggtttcaccatattggccaggctggtctcgaactgctgacctcaagtgatctgcctgccttggcctcccaaagtgctgggattacaagtgtgggccatggtgcctggccccatctgttctcgagcactcctggctgccccatttcctgaccactgccctccatcccattatctccccagtttcctttgttgcctaggttccaattctggtaccctggttcctgaccctgccagagttctggttccggaaggccccccacaggtgccttgggcctagctctcacctgggcccagggcaacactgaagacatgggcaagagcatcccccaatacctggggcaactggacatccgcaaaagcgtagtcagcctggccacaggcgccggggcgatctacctgctctacaaggccatcaaggctggcataaaatgcaaaccacccctctgtagcaactcacccatctgcatcgcccgtgagtgtccgggccctggggagagggctctgccccaggaggcacctgctcccgaggcctctgctgtgggagggcccaaaggtgatgcctccaagttcctctttcctttgtctttctcttgtccatcttcctcaagcccaccctgcagcgtcctaggcaaggccctgccagagatgctagctcagggtccctggatctcactcaagtggatcctcagactcatctggcaggtctccaaatactacatttcctctggctcccaggattccacttcttggaaacttggtgtcggcagctccccccatcccttttctgccctaggaacgtgaggctttaaggaaagggaagattggaggacttactatatgcccagagcttccactagtccacatgttcttttgtgcagagtaggaaaatgagccccttctgcaagactctttattgccatctgctggaatatcattgccacatactggttatgatgaaatactacttgttaccgccatatgccagacagttgttagagtaaatggacaaatctatgatggtacgttatggacaatacaacattagatagggtgcccttgtgcagtaaacattcgttcaactgtacatggtggtcctgcatatggcgagaaggcttctccgaaaaggcaaggcagccttgtccccaagtccctgtcccctacttcccaaccccattctttcatcacttctgagtccacagcctgaactgggctggggtggctgtctaggcctggcagtcgagcgagagcggcacgggcgggactcaggtgagctccggaggctcctcaactctttggagtgcaaacaggatgagtatgccaagagcatgatcctgcacagtatcactcgctgtgtgtacttgctggaggctgaggtaagggaagcaggaggtcccccctagccggcctggcccctgggggttacggccgatccctgcccctggaatggccagactatatcctgggacctctctctggctgatagcggtggggggggggtgtgcggagggatcttggtgacatggggggcagtgggcccagaacacccgcttctcctgcctcttccatctctccccaatactccaggcctctgcttgtactacggatgacatcgtgttgctgggctacatgctggatgacaaggacaacagtgtcaaaacccaagctctgaatacacttaaagctttctctggcatcagaaaattcaggctcaaaatccaggtgagcccagggatgcgtggtggggcatgcaggatgtctatagtccttaagtcctttaattgccataggataaatggtcatgttccagaagtttgtttgggtgtgaatttgtaacccagaaataagtgggaaaacggtggtcagattcccagcagggtcatgaaggcctttgaatttcaggatgaaactgaattgaggcactagtggtatctctcaaccccaaagagaaggacccccactaccccacaagctccctaccactgccacgttttttctgacaccaattcccaacactggctgggtgttcaacaattcaattcagttcagacactatccatagttagggcagacttcacaggttaagggctgagtcccccaagacttccccccgacttcaggtaccaatcataggtctgacttctgactggcccgctatgaattcgggggttcccacaactccctttttagatctactaatttgctagaatggctcccagaactcaggaaaggactttacttactattactggttttttatataaaggacacaactcaggaacagctaaacggaggagacacatagggcagggtgtcagggcgcggagcttccaggcctgttcctggaccaaactgagggctgggctgctattgctcctggcccaataacgagatgcagatgaactggggaggaagagagtttttatttctgtaaccggttacagggagaaggccaggaaattatcgctggaccaactcaaaattacaaagtttttcagaacttatataccttctaagctatatgtctatgtgtaaatgtgcattcatctaaagacgtgattaacttcttttaatttataactaaggtctgagtcctgaagaccttccactggagcctcagtaaatttacttaatctaaatgggtccaggtgctggggtgattacccttattttgtctcttgctaaatcaaggagttttgaggaattccttcagatcccaataaacttgtttgtggagacctgtggcgtttcttcagatccacagtaaaacttgtttaatcctaaatgggtcccattaagaattccttcgtaattttgtcatgctttaaggcccaggaaaggcctaggcaaaactcctggtgggcttttgttacattccagcctttgtataagggcactggcttttaacatttaacttaaccacgcagtcagtactgaaacagttgttatggaggcctgccacaagctcacttcaggagtgccctgctgttcccagcacctccacacgttcagcaaccaggaagctctttgaaccccattggtcagaggtttttattatgtagtcttgatgaattaaatcatgtccagctgctcacccctccccagaagttgggagcaaaactgaaaatcccaaccttctaatcatgctttggtctttctggcaaccagaagctatccaaggaccctgcctggagtcacttcattagcataagctctgttgtgaccaaaaagggttggtttgcagtaacaaaggacactgctgtcactcaggaaattccaaaggtttcaggagctctgttcctggaactagggacaaagatcagatgtattttttatactctatcccctgggcctgtgttaatcagaggttggtgtcatggccacggataacttctccattactccatagacaaaatgtaaaacaccacatgtcacttccccctttccctgctatcatacccccaaacttacagtatccacacccatcctccctgctttcctgctgctgccatgaaaaaaatggctttctcctggtctgtggccagtgatagtctcaatcctgcctcccaccccttccttaagggcctctctgattgcttacgctccgctcccccatcagcatgcagtaggctccaacccctcccatcttacaaagcaaaaccaaaaaagcctctcccttgacctccacatctcttcctggcaaatagtctatctctcccaaattaaaaacaaataaaatatgtaaaacttgcaaatattgtatatgtgtaagttagaaggaataacaataaaacagaacatgcccaggccaagaaatagagcacagccccctcccacatcttggctgcctcccccaccagaggcagtcattaccctgcattttgtttagcagttccaaattttctttgtagttttaccatatatgtatgtatccttgcatattctagcagggcatagcagataataaagaggtaaaatatagtctggtatgtttttaagcttcatgtacatggaagtagatggtttctattctgtggttggccttttctccctgctacgtggagagattcatccttattgggcagctctgcttccttctggttttttttttttttttttttgagacagggtctcgttctgtcgcccaggctggagtgcagtggcgtgatcttggctcactgcagccttgacttctcaggctcaagcagtcctcccacctcagctcccctagtagctgggagtacgggtgtgctcagtgagtacgggagtactatgtttctcaggctggccttgaactcctgggctcaagcaattctcccccctgggtctctttcaccgctctgtggtggtctctttcgtgaatactctgccacttgcccgttgttaggcatttgcattgtttccaggtgcttgtcacactcacattgtgctgtgaacattcctgtgttcgtctcccttgtgtgcctgagagaggattctagggtgtgtatgcaggagtggaatggtttggtcaaagggtatgcccaacttttccaggagggaggtatccattttcaccccaccagccctgcacgagtgttctattgtgtcataacctaacgtttgataatttcacattttaattttttttttttttgagacagagtcttgctctgttgcccaggctggagtgcagtggcacgatctcggctcactacaacctctgcctcccaggttcaagcaattcttgtgcctcagcttccagagtagctggaatcacaggcgtgcgcgcaccaccatgcctggctaatttttttgtattttagtaaagacagggtttcaccatgttggccaggctggtctcaaactcctggcctcaagtgatctgcctgcctcggcctcccaaactgctgggattacagacatgagccaccatgcgtggtccacattttaatttttggcatcaaacttttttggggaaaaaattctctttacatgtatcctcaaaatatgcacaactatgatatatcaataaaagcaaacacacaaaagaataaaaatagattgagaaacaaacagaaaaaaatacctagagagatctctgcttgctgcctcatccctcagccttctcaagtgcagtggtacgatcttggcttactgcaacctccacctccaggactcaagtgatcctcccacctcaacctccctagtagctaggattacaggcatgcaccaatatgcccggctaatttttgtatttttttagaggtggggttttgccatgttgttcaggctggtctcgaactcctgagctcaagtgatccacctgcctcagcctcccaaagtgctgggattgcaggtgtcagtcaccacacctggtcaggctgtgattctcaagcatattataatcacctggagagcttgttaaaagcaaagattttggctgggcgcagtggttcaagcctgtaatcccagcactttgggaggctgaggtgggcagatcacctgaggtcagttcgagaccagcctagccaacatggagaaaccccgtctctactaaaaatacaaaaattagccggacgtggtggcgggcacctgtaatcccagctatccgggaggctgaggcaggagaatcacttgaacccgggaggcagaggcttgcagtgagccaagatcacgccactgcactccagcctgggccacagaacgagactctgtctcaaaaaaaaaaaaaaaaaaaaaaaagcccagggagttcagttcaacaggagaactttgtttttcacaaatcccccaggaaattctgatgcaggcggcctgagtcccactcttcctttttttccccagtgtctttatgctgagggcctgacccctggtctcttttcaggtgaaagtagttactccttgatctcaatttccatctagctgtgcccttctggatctctgcagcctgtgggctcccctgccttccccatgggcagctgctactaggcatatccacttagatgccctccaagttctctaacccaacatatccaaaatggagctcaccccattccctgaatcagcccactctctccagagggctcttaggccatcaggccctttgggtctgcctcaaggctctcagcataaagtgcgtgattggccatgggctgcacctccttgccctaaccccagccacgtacaatgcatgctttatgctctcacatgcccccttgctgctgttccctcgttctgaaaccctgtcccagacttgctgactccaacctgtcctgcgggtcgccacggcttttgaggggtgggggaagggaagggcaggtactgatgggaatgctcacttccactccaggactcttgcttacttcttacatggctcataaaggtgcagctcgtgaggttacctgtctttggtaatgcctctaggtccaagcatcttactttttttttttttttttgagacggagtttcgctcttgttgccaaggctggagtgcaatggcgcgatctcagctcaccgcaacctccgcctcccgggttcaagtgattctcctgcctcagcctcccgagtagctgggattacaggcatgtgccaccacgttccgctgattttttgtttttgtagtggagatggggtttctccatgttggtcaggctgatcctgaactcccaagctcaggtgatctgcccaccttggcctcccaaagtgctgggattaaaggcgtgagccactgcgtcctgcccgcatcttgcatcctagaaccgaagatccctttattcactcaataaatgtaatattgaacactttgtgccaacacgctgctctaagtacaggagagaaagcagtaaacagaacagggaagatccctgtgcttgtggaatttatattctaacagggcaaggcaagcaatacacaaataagtaaaatatatagtgtgtttcatgtggtaagtgccatggagaaaaataaaaggcggggggtggataaaggagtctgggtgggggtgatgcagttttcaagaagaaaatcttgaacccaggaggcctgtaatcctagctactcaggaggctgaggaaggagaatcacttgaacccaggaggtggaggttgcattgaaccgagatcaccacattgcactccagcctgtttgatgggagtgagactccatctcaaaaaaaaaaaaagaaaaaagaaaaagaaaatcttttgagatgttgggcttggtgaagagttcatgacatcaaaagcatgatctataaaaggaaaatcaatacattggactttattaaaattaaaaacatttgctccatgaaagatcctgttaagagaatgaaaaaagctgcagactgggagagtgtatttgtttttgtttttgtttttgttttgagatggagtcttgctctgtcacccaggctggagttcaatggcacaatctcggctcactgcaacttccgcctcccgggttcaagcgattctcctgcctcaccctcccaagtagctgggattacaggtgtacaccaccatgcccagctgatttttgtatttttagtagagacggggtttcaccatgttggccaggatggtctcggtctcttgacctcttgatccgcccacctcgacctcccaaagtgctgggattagaggcgtgagccactgtgcctggctgagggagtatatttgaaaatcacatatctgataaaggactcagctaaattgtatcaagtgctttcaaaactgaatgttaggccaggcatgggggatcacgaggtcaggggtttgagaccagcctgggcagcatggtgaaaccccatctctactaaaaatacaaaaactagctgggcatggtggtgggcacctgtaatcctagctactcaggggactgagaaaggagaatcacttgaacctgggaggtggaggttgcagcgagccgagatcgcaccactgcactccagcgtgggcaacagagtgagactctgtctaaaaacaaaaacaaccctgatgttaaaacaagcagtccaattaggaaatgggcaaaatacatgaacagatatttcactgaagaggatatatggatggcaaataagcacatgaaaccatgtttaatatcaccagccattagggaaatgcaatgaagaccatgctgagatattactgtgcacctattagaagatctaaaatcaaaattagtgacgataccaaatgctggcaaagatatagaaaaaccggatctttcatatattgctggtgggaatataaaatggtacagcagccactctggaaaatagtttggcaatttctttcagaactaaacatacatttaccaattcagcagttgaactcttgggcctttatcctagagaaatgaaaacttatatctgcacaaaaaccagtacacgattgtcgatagcagttttatgtggaatagccccaaactggaaacaaccaaaaatgtctgtcaatcggtgaatggttaaacaaaatggtatagccattaccatggaatgctacttagtaataaaaaggaatataatattgatatgcacaacaacttggatggttctcaagggcgttatgctgagtgaaaaaagccgatctcaaatgatcacataaagtgtgatttcatttatataacatcctcaaacttaaaaggtcatatatagagatggaaaacacaagtggttgcctgggctttgggctgggggagcaggtgggagtgagtctaaaggggtctcttgagatagatctttgtggcaatgggacagttctggtgggataatctgttggctgcagttgtggttacacaaatatgtgcatgtgctgaaatgacatagaactatgcacacatattacaccaacaccaatttcctagttttgctattatactataatgcaagatgtgaccattgaggggaactgggtgaagagcacatgggacctcgctgtactatttttgcaacttcctgtaaatttataatcatttcaaaataaaggccgggcgcggaggctcaggcctgtaaacccagcactttgggaggccgaagtgggcatattacctaaggtcaggagttcaagaccagcctggccaacatggcgaaaacccgtctctactaaaaatacaaaaattagttgagcacggtggcgtacacctgtaatcccagctacttgggaggctgaggcaggagaatcgcttgtacctgggaggcagaggttgcagtgacccaagatctcaccactgcattccagcctgggcaacagagtgagacggtctccaataaaataaaataaaataaaattaaattaaaaaacaaaattaaagaaatgaaaatgtgtgttacacgtgacaatgctgtagagaaaaataaaataacagtggagggtggtaaggaaggctgggatgggggtggttagagaaggccttactgagaaggtaacattttaatgaagtcttaaaggaggtgtgagagtgagttgtgagtatctggggatagagtgtgctaagcagagggcacagcctatgcaaacaccctaagacaggtgtgtacctggcatgttcatggaatatgtaagaggccattgtgatgggaaccttggtcatgagggagagaagagaagatggagtccaagacataatagggagagaggggcagatcacattggaccgtatgccactgtaaggactttagcttttacactgaatgaaatgggggctcttgagcagaggagtgacatgtctaacatgtcagctgctctgaaagtagatgcagggggtgagaatggaagcagggagacaggaggctattgcagaaatcccggtgagatgccagtggcttgaaagagggtggtaagaagtgggggtgaggagaagtggcttgaattttgatagatttttgaaggtagtgcctacaggattttctgaagggttggaaaaggagtgtgagagaaagaaaggagttgatgccagcagtttttggcccgagccactggaaggaaagtgtaacccatagctgagacagggaaagctatagaaggagcaggtctggggatgggggagcgtgttaactctgagagctctattagacatttggggagaaaagtggaattggtagctgcatatatgagtctggattcaggggagggacaacatagctggagctagagacataaaggggagagtcaccagcatgtggatcgtatttaacactgtgagtctggatgataccggtatgggagtgaggtaggtagaaaagaggaggttgggcagaatagctaggaaagaagtctgtaaaaaaaaaaaaaaaaaagccaaataaagaatttcaaggcagtgggagtgggcaactgggtcaaattatgttgagagttagggagaattgtctattgggtttggcccaggggacatccatggggacagtgaagagtaaagtcagatactgggatagtggtgatcacctgtaaaagtaagcccttttgttctcccccactccaggaacactccatcaaagtactcgaactgatctccaccatctgggacacggaactgcacattgcgggcctcagactcctcaacaaccttccactgcccgactatgtgcatccacagctgcgacgggtgatgcctgccttgatggagatcctgcagtcagactacatcctggcacaggtgcctgaggaccatggccaaggccctgccttgctgaccagccctagcacagtacttagagggaggagcagaggtttatatcttccttgctgaggcccagactcacctgccttctcatgctttactctttcctttattcaggtgcaagccgtacgactgctgagctacctggcacagaagaatgaccttctctatgacattctcaactgccaggtgagaaagaaattgaagaggggctgatgaatgccaactcaggtatagggggagggaagaatcatggcatctccagacagatttacccctgatgaattgttttagtatcttcctgcctctgcactaaatgcactgaaaatcatgcctcttctgttccccccagtagaaggagactccattttattgggagggggatccccctttgaggcatttcctgaactctgagagttaggaacacaggagacaaaacaaaagttaatgtaggtattttaatattggggggaaattactatggcaaagagcattattagggatagaaaaggttactctgtgataatcagtggttcagttcaccagaacagtagggcaactctaaacttgtatgcacctaataacatagtctcaaaatatatacgacaaaaattgaaaggagaaattaacaaatataccactacagtgggagatttggaatattttaaccattcttgcagcaactgatagattaaaaagccaaaattagtgaggatatactcttagtgaataacacaaataagcttgagccattagacatactcagaacagtctacaaggattaaatgcacagtcctctcaagcacacacacaatacttaagaaaattagtcacacactaagccttaaaatttgtctcaacaaaatttccagaatgaatattatcatatcactcatgttttatgatcacaaggcaattaaattagaggataataataaaagaaaaactaaaaaattactatatactcgagtctgaaatttaggtatatttgggagtttaggcaataggaatatacaagaacaagaattttgtaacttgcctaggagtttattcccattctttctctattcccatcacaggttcactccaacttcctaaacctgttccagcccacacagtcagggagtctcctgtatgaggtactggtgtttgctgagcggctgagtgagggccggaacgcaccccactaccacgtggtgaaatggcattacaacgaacagtccctgcatgaatccctctttggggaagagtcccgactggcagaccgactacttgccctggtcatccaccctgaggaagatgttcagatccaggcctgcaaggtcattgtcagcctgcagtatccccaggacttgagagcccggccctcctcctgccagcccagtcgttcctactttaaaaacacggaataaaattaaggagagccaataaatgagtataggagagaaacttgaagtttcttgaagctcgaatgtctgttggtggccttccagggctgggtggagatttcattcagcataacctctgctccagagtgtggtacagcatgggcttatctctcaaaacacatccccacttctatgtttgggggactagctcccctcttctcttgctgcttttctttctttttttttttttgagatggagtcttgctctgttgcctaggctggagtgcaatggcacaatcttggctcactgcaacctgcgcctccctggttcacgccattctcttgcctcagcctcccgagtagctgggactacaggcgcccgccaccacgcccagctaatttttgtatttttagtagaggtggggttcggcatgttggccaggctggctcttgctgcttttcaaatcaatgtggagccattgctttcagggggttggaagaaggcaggcttggggattgaagccaaagataatcaacaggacgcagtatagcattagattagttaggatgggccaggctatcccacagtaacaacactcacacctcagtggcttaaacatggcaaagggggccaggcgcggtggctcacgcctgtaatcctagcactttgggaggccgaggcgggcagatcacgaggtcaggagatcgagaccatcctggctaaaacggtgaaatcccgtctctactaaaaatacaaaaaattagccgggcgtggtagcaggcgcctgtagtcccagctactcaggaggctgaggcaggagaatggcgtgaacccaggaggcggagcttgcagtgaaccgagattgcgccactgcactccagcctgggcgacaaagcgagactccgtctcaagaaaaaaaaaacatggcaaatgttaattcttgtttacactgcatgcccattgcagatcagcggtgggggtggaagggcaggcctctactccacaacatcctcacacagagacccaggttgagggaggcttcctcattgtgtttctacaactattacagaaggacagggaatgtggtagtgataaatgtcatcacttctgctcacatctcattagccaaaggggatgaggaagatcattctttccacgtgtccaaggaagaactgttgatccttggtgacagcatgaatgacagagatctgcaggcatactgggtcagaaagggagctctggaatcagagtgctcgcttccagtcccagctctgtcacttactgtgtgacctcaggggagcagttaaccctatttgagcttcaggcccctcatctataaaatgcatataataatagtactgatttcatgacgctgttgggaaaatgaaagggggattatatgagttaacgaacgtaagccacagtgttctgcatgcattcctcaaagatgggctctgaggagctatgaaatcatcactgagaaagccgggcagagtggctcacgcctgtaatcccagcactttgggaggctgaggcgggaggatcacccgaggtcgggagttcgagaccagcctgaccaacacggagaaaccccgtctctactaaaaatacaaaactagccagatgtggtggcgggcacctgtaatcccagctacttgggaagctgaggcaggagaattgcttgaacccgggaggcagaggttgcggtgagctgagatcacgctattgcactccagcctcagagacagaggtgcgagactccatctcaaaaaaaaaaagaaatcatcactgagaaaacaaaagatcatcactggggaggtccttggagagtgttgcctccagcatttctccagtctcttcaggttatgggcactggggagtcctagagtcctctatgaagcgtgctgaaaagtcattgaaacttagctttggaaaccagaacaatggtgtgagtaatataacaccataaccatgaagtttccagaaacaagaagactgtcaaaccaaatatggtcatccattttccaattccccattcatttgcgtttcccagttgttccttcattgttttttttgtttttttgagacggagtctcgctctgtcgccaggctggagtacagtggtacaatctcagctcactgcatcctctgcctcccgggttcaagcaattctcctgcctcagcctcccgagtagctgggactacaggagcgcgccacaacacccagctaattttttgtattttttagtagagaaggggtttcaccatgttggccaggatggtctcgatctcctgacctcgtgatccccccaccttggcctcccaaagtgctagggttacaggtgtgagccaccacgcccagccctcattcactgttttatctgtgaatccttgctgggaaacagtaaggattgctaacggtttaagaaaatgctacgggagagaaacctaatgttggagctattcccagcctgagactgctcgatctaggacaaagaacctggtccagccacgggctcccggtgttcttcagaagcaggatttgaaaactagtctcgtccaggaccaaccctggcattttcctgaaaggaaaacaaacccaaaatggaaaagtgacttgctcaaggtcacatgactggtctagggcagaaataggattagaacctcctactactgagcttttcttttgccctcacattcttcggtccaagccccgtaagagtgggtcatggattctaagcccaaacctatggaaactgaggaggatcttgatgcttctggattttagaggccagtttaggactgaagtacttaaaggaaatctgtccccacttaatccctggcccaaggtcatatcactcaggtggaagagggagggtgtttcttgatgaggatgggctgatgagaaagagccagagcctatagagaggccaaccccgtcactgtctcccagaatgagtgggcagtcactaccagatctgaatcagcatcccttgtttccctcctgagttcaggcctgaggctgctccttcttgctgctgaatacactgcagccaccccagtggaacttgtcaaatgccgacgtttcctttcgaccagctccatgtgtgcccatgtcaccaacaaggtgttgggcatcactttcaaattctcctccccaccacatccacctagttcccccatttccactgctactgccctgtcctccacatcaggacttgcctacttctttctttctttctttttttttttttttgagacagggtctcactctgtctcccaggctaaagtgcagtggagcaaacacagctcactgcagcctcgacctcccaggctcacgtggtccttccacgtcagcctccttgggtagctgggactacaggagtgtgccaccgcgcccagctaatcttttgtattttttttgtaaagacgaggttttgcatgtttcccaggctggtctcaaactcctgagctcaagcaatccaccttcctcagcctcccaaagtgttgggattacaggtgtgagccaccacactgggcctgacttttcctcctcctggtttccatcctctccagccctacgcactccaggctaattttataatcacacatggcaccattctcaaaaaccttcaggggctccccattgccatggtgaaatctttctcggcatcaaagcaaagtcacgtgatctgacaggtataaatgtattctcagcaaaaggttgagttttgtcctcaaagatgtggtcactggaccccttttttacatgacgaaaccaaatgaattagctttgcattcaaggctcttcacagtgtgatcctcttgcctgccacaagcctactgtgccacatctctgctccagccaaactggagcaaactagtcattgctgccctaatcataccatgtgtactcttgctccaaacatgttttctttttttttctttaaattactattataaagagaagatgcctccaaacattttttttttttcctttttttgagacggagttttgctcgttgcccaggttggagtgcaagggcgcgatatctcggctcaccgcaacctccacctcctgggttcaagcgattctcctgcctcagtctcccaagtagctgggattacaggcatgcgccaccaccatgcctggctaattttgtatttttagtagagacggggtttttccatgttgcccaggatggtctcaaactcccgacctcaggtgatctgcccacctcggcctccagagtgctgggattacaggcatgagccaccgcacctggcttacttttgatacaactttcctgctgcctagaatgctagaatggccttccctcttcttccaactgggttgtgccttctagtgtcatcaaagttgacgtcccactgcagcctagatcttttttcaagcatactagcctctggtgcaccctgcagcacttctcatctgaacctctcacttggcatttggcaaattaaagcttgaatcttatataccttgttcttttattcttttttgcagtaggacatatgttttttgttctttgtggtttttttcttttgagatggagtctcactctgtcgcctaggctggagtgcagtggcatgatcttggttcactgcaacctctgcatccccaggttcaggagattctcctgcctcagcctcctgagtaactaggattataggtgcccaccaccatgcccagctaattttttttttgagacggagtcttgctctattgtccaggctggagtgcagtggcacgatcttggctcactgcaacctctgcctcccaggttcaagcgattctcctgcctcagcctcccgagtagctgggattatggacacgcaccatcatgcctggctaaattttgtatttttagtagagaccaagtttcgccatgttggccaggctggtctcgaactcctgacctcaagcgatctgcctgcctcggcctcacaaagtgctgggtttataggtttgagtcactgtgcctggcctgcctgcagtaggacatatctgactgcttaccaaagccttgaagagccgggcgtggtggctcatgccctgcactttgggaggccgagacgggcggatcacgagttcaggagatggagaccatcctggctaacgtggtgaaaccccatctctactaaaaataaaatacaaaaaattagctggatgtggtggcgggcgcctatagtcccaagctactcgggaggctgaggcaggagaatggtgtgaacccagtaggcagagcttgcagtgagcggagatcgcgccactgcatgccagcctgggcgacagagccagacaccatctcaaaaaaaacaaaaacagaaacaaaaacaaaaaaaaccttgaaggaagagcctgctcagggcaggcacatgataatggcaattggctgatggtaatgaaaggaattggcagtgggaagatcagatgggagtggtgtattatctgctgccatgtaacaaattatgagaaaacttgtgtatcagcttgggtctgatcaagagagaaacctcacagtaatttaacaggaaattttaatatgattattaaaacaggggattggagtaacaaagaattgtttagtaaggagttatgagaaccctatggaataatgaatagctgacatgaggagcagcccctacctcccaagatacagcacccaagaaagagataccctctccccacccagggctgagatccagaccttgttgagtagagcacagcccacagctcactaggtggcagaaaagtcactgtactgtcatgccagtggaacttgccagaaatatgccctctaggatgccagggaaagctctttcccaaggaggtgtggaaccagagactttcgactacagaactaactgagtggggtgtgcaggggaagctgcttcccactgggtgctgctggccttcatgtgctgtgggaggcggcactggagtacctgtgggtgctgcaggagcctgatgcggcagaagccacatgcacgcaggtggtatgtgaggcagaagttggaggtattctgcttacactacagcccaaggtggacagtgccaggagaagctgctagccactgggtgttgctggttactctgggaactgggcactgaaagctgtttgcagagcaggagcctgtcaatcaagcacactagaaccaggaagcaaaaacctcttcctcccaaaatgtctctccagctcccttcctcttagtcatttaaatatcaataaacatatgttacttctcacaggaatttgagagcatcttgactgggtggttctggctcagtcaagctgtggttacagtcacgcttttgccaaggactgttgttatttgaaggcttgactggggctggaggatccccttccaagacagcgcacttatgggactgacaagttggtgccagctgttggcaggaggcctcagtctttctacacgtgggcatctccacaggggtgtttgagagtcttcatgacatagcagctggcttcccttatagtaaatcgtccaggagagaacagagcagacgctgcaatgccttttctgacctcacctcagaagtcatacactgtcacttctgccacattctattcattagaagtcagtctagcccccattcaaaggaaggcagttaggctctacctattaaagggaagaatatcaaggaatgtgtgagcatttaaaaaccactacagggacactgtcaacaaagactaattggacacctactgtgtgctcagcagctagatgcatctgtatccccacagagacaatccctgccaagaagaagagaaattttataaccagtagttgacactccatcctttccctctgtctttttttccagctgtttagcttgttttctcaactacaggcctctttgaccctcaggcaattctatttacaaagaaacatctcttctcatcttctcatttaattctaaggtttcagagaagaggagtggcttgaattggatctccagagaggagagagaagagctctccaggttgggatagttggactttacaggaagggaaaccaatcagagtttccctctgatgggattgtgatggggtagggtgctggtagatgattttggccaggcagatggccagttacttctctaactgattacctgaaggagatgtatgagagacagacacaaagggaactccagccccactgcatggcttccagtaggacctcaacacagggttctcaagcaaaacttggctggagtccccaggtgtgtcttaaaacttaaagcaggggccgggtacctgtaatcccagtgctttgggaggacaggcagggggatcacttgaggccaggagttccagaccaacctgggcaacatagcaagacccccatttcttttcttttctttttttttttgagaaggagtttcactcttgttgcccagcctggagtgcaacagcgcgatctgggctcaccgcaacctccgcctctcgtgttcaagcaattctcttgtgtctcagcctcctgagtagctgggattacaagcgcccaccactacgcctggctaatttttggtatttttagtagagacgggggtttcaccatgttggccaggctggtctcgaacccctgacctgacctcaggtgatccacctgccttggcctcccaaagtgttgggattacaggcgtgagccaccatgcaagacccccatttctttttttgttttttgttttttgttttgagacggagtctcactctgtcacccaggctggagtggcacgatctcggctcactgcaagctctgcctccctgatttcacgccattctcctgcctcagcctccgagtagctggcactacaggcgcccgccacaatgcccagctaattttttgtatttttagtagagacggggtttcactgtattagccaggatggtctcgatctcctgaccttgtgatccgcccaccttgggctcccaaagtgctgggattacaggcatgagccaccacgcccggccgagattggtttcatttttatgaaacaggaattttttttatcatcatcaaatacaacctttatacatctctgataataataaatggcaaatgtggtaggcagccttctaaaactatcccagtgacccccacttcttaaatatgtcctgtttaatttgctgcccttgaatctgagctggacctagtaatttgcttctaatctagaatatggcaaagtgagagcatgttccttttttcttttttttttgagatggagtctcgctctgtcgaccaggctgaagtgcagtggcacaatctcagctcactgcaacctccgcctccgaggttcaagcaattctcctgcctcagcctcccaagtagctgggattacaggtgcctgccaccatgcccagctaatttttttaaatttttaatagagacgaggttttgctatgttggccaggctggtctcgaacttctgatctctggtgatccgcctgcatcggcctcccaaagtgttgggattacaggcgtgagccactgcgcccgggccgcatgttacttttgaaattaaattacaaaagactgtgattcctcttgttcccattctctcttgccctttcacatgctcatgctgataaaggcagctgccaagttgtgagcttccttgtagacaggcctacatggtaaggaacccgggaaggacccaggccaacagactctgcagagccaaagttgtcaatccaacagcttgtaaggacccaaaacctgccaacaacctctcgaataagcctggaagcaaatgcaccccccagtggaaactgaagatgactgcaaccgcagccagtgtgagaaactcagagccagactacatggctaagctgtgatagattcctgacacacagaaaccatgagataaaaaataatgagttaagccactgatatggtttggctgtgtgtccccacccaaacctcctgtcgaactgtaattcccaatgttgggggagggacctggtgggaggtgattggatcatgggggcagatccccgcttgctgttctcatgaaagtgactgagttctcaatgagatccgatggtttaaaagtgtgcgacacttccccctctgctctctctgccatggtaagatgcgcctgcttcccctttgccttccgccatgattgtaagtttcctgatgcctcagccatgcttcctgtacaggctgtggaagtgtgaatcgacaaacctcttttcttcataaattaccatctcaggtagttctttatagcagtgtgagaacagactaatacagccactaaactttgggggaattcgtttatgcaagaaggtaatcaatacaacaggtgattgttccaagggtccaggcactgggtcagttctcttcttccactcaaggatgggaagaagaatactcaatgctacattccagtgtgagcctttaatgactgtgactcctccccacaagtaactatggccatctgtgtgtcctggaacatgacatggattcctttgagagaagcaggaagggcatggagggagcttccccctctacaacacctgctccccctgagcccaagaataaaccaaaaccccagcctgggaggccccctttcctctccaatgtcttcctttcctcaaaatccccttattgcccccgagttgctcagtcattgccaccttagaatgttctttcccatgagctgggccaaggagtcctacagtcaaaactaagtgatggccagggacagtggctcatgcctgtaatcccagcactttgggaggctgaggtgggcagattgcttgagctcaggagtttgagaatagcctggaaacatggcaaaaccccacctctaccaaaaaaaaaaaaaaaagaaaaaagagagaaaaattagccaggcatgatggcacacgcctgtaatcccagctactagggaggctgaggtaggaggatgggttgagccaggaggtcgaggctgcggtaagccatgattgtgccactgcactctagctggggagacagagtgagattctgtcacaaacaaacaaaca

SEQ ID NO: 244 - DNA, 362320 bp, Homo sapiens
ttgctcttcagaagttctttcatttacttagatcccatttgtcaatgttgtcttttgtggcaattgtttctggtgttttaatcatgaagtctttgcccttgcctgaatgttattgcctaggttttattctagggtttttatggttttagttcttacatttaaatctttaatccatcttgagttaatttttgttaaggtgtaaggaaggggtccagtttcagttttctgcatatggccatccagttttcccaacaccatttattaaatggggaatcctttccccattgctagtttttgtcaggttttcaaagatcagatggttatagatgcatggtgcaatttctgaggcctctgttctgttccattggtctatatatctgatttggtgccagaaccgtgctgttttggttactgtagacttgtagcacagtttgaagtcaggtagtgtgatgcctccagctttgttctttttgattaggattgtcttggctatatgggctcttttttggttccatatcaaatttaaagtagttttttataattctgtgaagaaagtcagttgtagcttgatgggaatagaattgaatctataaattactttgggctgtatggccatttttatgatatttattcttcctatccatgagcatggaatgtttttccatttgtttgtttcccctcttatttccttgagcagtggtttgtagttctccttgaagaggtccttcacatcccttgtaagttgtgttcctaggtatttattctctttgtggcaattgtgaatgggactttgctcatgatttggctctctgtttgtctattattgctggataggaatgcttgtgatttttgcacattgattttgtatcctgagactgctgaagttgcttatgagcttaaggatttagggggctgagatgatgggcttttctaaatatacaataatgttatctgcaaacaggtaatttgacttcctctcttcctatttgaatatcctttatttctttctctcccctgattgccctggccagaacttccaatactatgttgaataggagttatgtgagagggcatccttttcttgtgccagttttcaaagggaatgattccagcttttgcccattcaggatgatattggctgtgggtcataaatagttcttattactttgagatacattccttcaatacctagtttattgagtgtttatagcatgaagcgttgttgaattatatcgaagggcttttctgcatctattgagataatcatgtggttttgtgggggtttttgtttgtttgttttttggagacagagttgtactcttgtcgcccaggctggagtgcaatggcactatcgtggctcactgcaacctctgcctcccagtttcaagcatttctcctgcctcagcctcccaagtatctggaattacaggcacctgccaccacgcctggctaaattttttgtatttttagtagagatggggttacaccatgttggccaggctggtcttgaactcctcacttcaggtgatctgcccaccttggcctcccaaaatgctgggattacaggcttaagccaccacgtccagccagaagttagttttttaaggatgtgtcaataaatatttcttacacctaatagtgttcatgtcattggtaacatattctgaagtgtgtatattatatgtatatataacccataaaaattagccattgagaatatggggaataacatgaaatgaggtaaatcatcaacactctattatgttccagttatagatttagggtatttctaaaatagctttttggtttagtaatgtagacataaaatataacttcaaagattgcccgtgtactttagttattgagaaccttttattcctgtacttccttaaggcttttgtaataataaatggttgagacatctaagggtttgcatttatcttacagagtcacttttagaggcatgagtttaagttctattcttggctggaaagcttccctttgtaactattgggacaaaagtcataatcttacaaggaaattgggaaatatagcataagaaaaagagatttaaaaattggtactgactcatgaactttaaagagatgtttgaaagcaaaaggaataaatatagaaaaagatcatgtaaacattttatgtataaactatttgtactagaaccatgaaaacggtagagtgaaaaaaatttaatataaaatatcagttattttgctatgtataattcagtatttataaagtgagaaaacagggaaaataagtaattatatagattactgaaatctcaaaatacacacaaaaagtaggtaaaatcttacaataaagttctgtttcacctctttggaaacaaagtatttattttatagaggaaattaatggtattttattattattattattattattattattattattattattattttgagacagagagtctcactctgtcagccaggctggagtgcagtggcacaatctcagttcactgcaacctccacttttcacattcaagcaattctcctgtctcagccacccaagtagttgggattacaggtgcccgccaccacgcctggctaatttttgtatttttagtagatatgaggtttcaccatattggtcagggtggaaatattccatgttcttaagacagcatttcatagccaaaattactttcattgtgcttgtttgtgttgcacatattgtaagtaatttacacatatgataaattgacctcattctatgcaattatcaatgggtagccaacgctgaactattttatatacattatcatattaaatcataggaaaagatgtgttcagaaattgtaatacagtttacccttgaacaacatgggggttagggccactgactccccaccacagtcaaaaattcaaggaaaactcctaactccccaataatttaactaccaatagcctgctgttgactggaagccttattgataacataaagtgtgaattcacacatattttgtatatgtatcatgtactgtattcttaaagtaagctagagtttggaaaatgttatgaagagaatcataaagaggagaaaatatatttactcttcattaagtggaggtggatcattataggatctgaatcctcatcttcttcacattgattaggctgaaaaggaggaggaaaagaaggaactggttattctatctcagggatggcagaggcaggagaaaatttgcttgtaagtggactcatgcagttcaaatctgtattgctcacgggtcaactgtacctaaaacaggaaaacatccaagttttacttaaatatttaaaacatgttaacagttttttactatcaaaaatttcaaacacatacaaaaacaggaagaaaatatactaaacattgtacatcccaaaattattatgaaatggttttcacaagtgtttaattttgtaaaaaaaaaacaaaaaacaagacttaaaaaatatagtcacagtactcttattatcccatgtaaatattaacaataatttcctaacactatgaagtatctaatgttcaactcaagatccactgtagtctacacatgataattaattgatgtgtcttttaggtttctcctctaactggtattttctgccgtgaaatttatttgctaaaggaaccaaatggcaaaattgtgtgtcatttctcacattcattattttactcatggcctcatttgactattttttttgtcccctgtatttgttggactttggaagttcaatgtagagacatagtgctatccagttttcattattttgaaaaaattcttcctttgtggtgttgtgtccatcgctgaggaggaatataatatctggtagattcccttttactgatattacctgaatggtaatcattgcctaaatatgagtatttgctaaaattgcagaatggtgactttctaattcttttatttcctctttgtttagtagctggagtatttctattaagagttatttccatccatccaatatttggctatgtaactccatagcaagtgtttctttctaaaacattttaaaccatttttacacttttttcctagtatgatatttgtgtgattaagaaaaaataaaaactagtgaaataaattaaattctcactttttcaagtctttgaattctaatgaggcttagaagaaaatctagtacttagacaatgttaggtgatagttaagaaagatgctattttaataagtttcatgtgattagtgaaaaaatgtgtttaactttgtgtttgatgattaaagaaagaaaacaaaaagaggagaaaaggtaggcagttatctagccctctacagcagatattttaatttctgtgtcttaaaagacagtaataatgtactatctgataaattagatgtagtagaatttccccttttcaaatcagtgttatttcaatcataaaggaataaaaatcattggtttgttgattaacattgctgtgttatataatagctaatggttactacatttcgacgcagtagattttaaaatatatatattcagaagtgtgttttttctctgtaaattcaccactgaagtgctttgtattctaaaaatggcattcctcttctctgaagcacagttttgttacatgagtgatctcattgttttcactgtatttattctgggaagtagtggcaatgccattattttaataatttgtagtgtgtactataagtgtaacttttcatatatgaaaactttatactgcacagcatcttccaatggcaatgttttgttttgctgcaaatacatttgaatcaagggaaacatctaatatatctgaatatgaagttgttatgggatctttggggtgtcgtttttctggtcagaaatttctgtggctggtggcacctttcctgtgttttcctcaggcctgctgggctcatttcactcacttggcctggcaggatgcactcggctcacactactggcctgggtctcatgactgccaagggcgagtgaggtgtggaatggtgaggggtgtatgtgtgagatggggtccagacactgtgcacagtcagacatgccaggtgctccagcagggcgggcagctccaggtgccggcatgggcaccagctctccgtgaggctgcagctggaccaggtgcactgcaagaagcttccacagctggcaccgggaaccaaggtagtgcctggaagcttggagactctaggaactgcagggccccaaagtgggagccacagccctggaatggggtgctcccaggtcttggctccccgaagggccacagctcttcttttcttgtcttctcccacaatgtggcaagcaaggagcatgtctcagctctgtttctgttacagctcttttagcctcatttgttgggtactgaattcttgctccacacccaggaagaatgagacatgcagaaacatggagggtgagcaagttgaggaggagctttattgagcaacaataggtcagaggaggccctggagtgggtagttcctgtctacgggcaggttgtcacatagagtgttcacctctcagcaaggaagaggctctggagtgagtagctcctttctgcagctcgtcttcctgacctccgcagctctcagcagagaggaagccctgaagtgggtagctcctctctgcagctggttatcctgatgtctgctactcctagcagagaggagaccctggagtgggtagctcctctctgcagctggttatcctggtgtctgctactcttagcagagaggagaccctggagtgggtagctcctctctgcagctgttggaatggcagtggctgctccacatggactgccactgccatcaaaatcatagatgtcaggaatctctgtctctttaaaaaatctaagctctaactctattgcctcctcttttaagaaagaattgtcccttatctataaatttttgcttaggaggaaggataacagacacaaggcccaaatcaaaatatttcaataaaattctacataatcttaaaatacaaagatccatagtgctttagctctccctgcataaataccagtaatgtccttgctaactatttacaaaatgtttccttgacgaataactttctaacaaacacttctaaaggcaccagtaaatccagtaagctctatattacccatatattgcaaataatgttaaaaatatatgacccttgtgttatgacagtaaatgttaaaataagaagccagaataaaagaatagcaaaaatgtgactagtcatatcagtcttgagacgggtgaaatttatctaatctcttctgagaatgccttcataccctactaatagtccctgaattccatttcaagaaatgcattttaagagtccctaaatctttgagaaaatattagacagagatacatcttccaaatagccagacaagtgtctaatttaaaactgattaaacaaatcagtaacctagtcaattatatttgtactttatgattatttgtactgatgttttttcagataaactttattaatataatgactaacattcactaacccttcagcatttctacataaatagctatggtaattattttatcattcacatgatttttcctcacatatatatacgtgttttcacaaacttatgtaaaatcatgtgaaatcaatattataattctcaccatttacaattttaatattataacgaacaatctctgaaaaaagtagtatgaataattgtgttatagtaacaatttgctgcttttattataaagacaaaaaatggtgtcatatctaaaacttttctctggtcaaagtatctttaattctgttctgtttattttatctataaacagttaaaattgcatttttaagataattttcggtcacttggggtggtgtgcaatgtgcactttacaattgacttctaattggactatgctgacaatggaaaatcttacaagtattgaacatgacattcatgacagtattcctgtcatcttggcttcttttattgaatatgcagagaattataattgagctaacaagcctgatagcctggcctctttccaattatattaacctagtctagtattagctgccggcatacagaaacaggcatagagcttttgtttttctttctattctatgttggtacctgcccaacaatcaaaggataaaatcctctgtcttcatacaatgtttgagaattgtcagtaacttatctccaatccactgataaatgtaaagattagctttatccatcattatttcactaatttatgataaaatgatttcttataaaagattggttgtatctgttacatgttagatgctaattaattattattgttccaaaactttataaggttttggcatgttttctttgaattcatgctaaaatttttcaagtgatgaatttgagtttgaagcaaatttgttcttcaaatgaacaagtcaatttattgatgcattgtaatctttcctttgaaattgagacaaacattattttagcataatctaaaaataactcagtcttaaaaacaaacaatacacacaaaaaataactaaataaaaaaggaaaataattttaaattattttcacttaaaatccactaacattttaccaaggaatccaattaaaacaaatagtaggtaaagttaaataaaccaatttatgattttaaagatatgaagaatttgtagtgtatcagttgtttgaaatagtagattctgtgctttactttctctcttcctttttttctcttgttttagtgatctcttattttagaatatgtaatatacttgcacactttctctccaaatatttccaactcttccattttcaatatttaagtcttcatctttatccaggattttctgagtagaaatgtgaagacaacctggaaatttatgtcctgaagaaataaagcactacaacagtgcctaagagatatgccataaagatgcatgttgcaaaactgttgttagcaaaaaaaaaacagaatacagcaagatgctcccaaaccacaaacctgttgataatacaaaatagttccatacttcatataaactacataaaaatatgcaactattaaaatgaataagttagcactccgtgttttaacctggaaatgtgggaaaagcagactgcaaattaatgtgtatagtaaaatcttcttctggaaacaaaatgcacactttttttttaggtttttataagaactgcaaattttattttttatcgttaagaaattgctggcattgattatctcagttgctgacattggaaaggaagaggggatattgtttactttgctatattacctgtaatttttgatatatatcaattttgtacttaaacaattaagccaaaacattcattaaaggaatgtagatttttgatgaaattgaattttaaaacttaagttttgatattaaatattttagtgggctttaaattttatgaattattgcatcataagtagtaaatatatcaaagaacagataatagttacactttgaattttaagttactttaaaaaaaatcttcacaataatattgtaagtagtctaccactttgtctatgtccatttgagagctgtgaaataaaagagtttgaatgggtcaaggacttaatccagatttcctaaaataactttgtttttagttaagatgtttttgtctggtaaaaattttattattttaaaactaggatgttcattttaaaataaactagtagcatatatatgcaaatagtaaggcagtttttgttattgtagatgaaaacaaaaattatctgtaagtagcctggtatgtacacagactttctaaattttttttagctccaggcaacttgaaagaatgaagtcgaaattagaacttttcatgtgtagttcataattactagatctaaaatctatgttaaattttactaaaggtcagtccaccaaacaagactgcacatttcccaattaggagatggactatttcctccttaacatcatttagaaagccagaacccattcctgcttttgtctatcttcatttttcaatagtaagtcaaagtagactatatcacttcagaagtatttagaggtatctaattacgcattttgaacagaagttttcctttgagtaagggactgtcctgtaggactgttctaattttcttgttaacttgacttctgctttaaacaatgtttaccactagatataagcttatacttcagcttattaatggaaataatgccatttaaagtaatacagttttctagtctcatgtttatgtgtcaaccaagtaccaaaattgctggagtttagtgaatcatataatttttatttggctttgtagaactgatgcttgcaatttagtggatcaatcagttccttaaataccaatagcttaaggtaatattttacagcacagattctggagtcagatacacctagaatcaaatcccaaatctgctttccagatgtgtcatcttcagcaagtaatttgacctttctcattcccagtttccacatctatgaggaagggcaacaaaacttacttctcacagttgtcattattaagtggtagatgtatggaaagtcagtctctggcatttagaaagcactcaaatgatggaagtggcctgcttttctagttactcaaatatcatggggttacaatctgattgttaaatagtattaagtatatttaaactatatataattttaattgattattaaataaaatttagagttaagaagaacttaaagttatacattccattaaaggaatatggtgacttgtagtgtttggaatgtgtagtacatggctcctgtctgctcttactttgtcttactcaaggatcttactcataacactaactaaatgtaacaatagtcattttgtttcttaggctgttgatcatgaaatcacaaatgtactctttagactttaatagcaataacatctctgctttcttactagagaatctgtctaatatctaatatgtttgttctcttcttgtgcaacctttccttggtaccagcggctgcttcaaagaataaagttaaaggtgagctcctgtttattctgcatgagtcatcatcattcatttttctgctcaatcttctaagttctcttaaatgatagaaccaattcggttggtgataatactatttcagtgtatagatattgttcataaattcctacaaatacaaatatcaattatttcagttatccaatttctgagacatgtttgcatgaatgtttgtgagtttgttttcttgtttcacttctcactttattcctaagtatttcaaagtgcaataaagtgctttttttgcactaacattttgcatgcgtaccttagtttccttgataaaattgagaattgggcaaaatacagcataaaataaaactgatggaaagtctcaaaaatgagtatgcttttatagaattatgtgaaaataaaatttaatcttctaaaaactgaatattataagctatcgatttctatttatgattattttttcatttttagttgcattgtttgactttgctagaaacctaaaaatgtgttttcatgataaaagatgcacatgtccaacgctgaaaataaagaaaaagtattttggctccatgtgtcccagtttttatgggtttgaaaaattcaaatacatgtatgatactgtatcatagacctatcatttatgtatttcaatttcattctgtttagagcagtctacatatttaaaaatcttttttgcttttgcttcttaaatagcaaaagaaatttttttctctttcagttccaggttctagttttacagctagttttaatactatgacatacgctcatctttgaagtgttaactattccctatttataaagtcaagcctttatcatacaactaatattgtcatagcaatgtatttgcttatagaatatgaaatatttaaaggaggagatggcaaatttattgtcacctttcttatagctcacctagccttgtttcctgttccagtaagtgttgtggaaaatcagccaatccttgccacagtaattttctgtctggctgtgaacaaaataaatacattcacagcaattcagaaattatttgataatgaatacatgtctataaatgtataagcacaatatgtttatataatgaaaggatgagaagtgtagttttaggaatgaggaattacaaactatacacactgcaccagctccagggtacagcatatgagtgtaaagggaaccagggggagatgcatatcagcactggaatcatcagagaccactttatgtaggaggtggagctggaagtggctcttgaaggatggataggatgtacatagaaaacaagtagtgtatttaaaaaaataattagaaaggctaactaaaggtctggaaacaggagtgaatacagtctagtgtggtgagaaaatcttttgaatgaaacctggtacttttataagaaagtgtagaaaaataaattctaagatgatgcaatagacaatggagtgattatgagtcattacagtatttgatcacataaaacctctagtaatcaattactctccaaaacaatggaaaataatttgaattataatacgcaggctgctaagtattaaatatggaaaagccatttcatcattggagaattatagtcataaattatattacaggtatctgtcaagtcatttcaggactcaagctgactagaattttataatgcaagcatatttctgtatccaatttagtgccttccacacttccatccccagtgttccacacttagccattttatttgactctcctctttttacttgtatactagcctgtaggggccttaacacatagctttccgcatgcttatatttttgcatctacaaggcaagcaatgacacgttcaaaaattaattgtgcctcaagtggaaactgaaattttatttctaaccattgctgaagaaagatatatattatgtagagataatagaaagaattactcagtgattttttggtccaatttctatatgaaggcaaatggtcttcaaacagaaaaaaaaaagtggataagaggaaaataaaacccaagataatataagagcagatggttgcttcagaatagttcatttctcctggcccagaaaaagtacttaccagggaaccgagagaaattttaaagaagattatatctcatttatctatccttatggaatcacgcaaatgtggaaagtttctggaatattggagagaggaatgtgttctgattttttgtaaggagtaatgatttcatttccagaaaccataaactggtcattttgacatcaatttcccagtaagatttttaaacactcttaaaacaacagttggtgggtatttaggttaaaacagagttcattgagaatcagtcagaaattattagtaatagcataggaaattacaccttctttttttaaatgtgagttactataccagtataggagggcagtagcatagacataatatacctgaattttatcaaataatgtagcaactagctctttgcttatttctgtagaaacttattctgaagatcactaattattctccaatggccaaatccaagggtggtttctcaatcctcatattgctatttttttcctgatgaacatattatattcttttgaatttacatttcctttggtttcagtggcactgtacatacttcattttttaaaacttctctttgcctctttctttctctctccatttatatcttgttctgaaatacaggttttattcaggttgtctttgattcttgaaaagatcaactattgtagtgtaggttcagctttccacactgcctttgagagataaacttcacttcctacaaaataaagaatggggccattttctagacaattgtgtacctgcaaccaacctgtctcactattgttgcctgtcaagaggaacataaatgacccagtcgagttgcttctcagaaaacttataactgggaaagggctagagagagagagagggaaaagtcaaggaggtaagacaaagaaacagagatggttgatcagttctgttactcttcacgcgtaaattttgtatgtagatttaataaaatgaattaaggttgacaaatgccacaagaaggaaggaggactctatgaagagtgagagattgagagagtactctgctggtgcactagcttcttggtctaacgtattgctaaggctctattttatctttactctctgggtctatgacacagatgtcttttaataaaaatttctagataggtttctcttgcttagaatcaaaagagaaataatatgaatgttttctttctaagggttttttcattgactttgttacacttttctgaacttgacttaactgttaagcttttgtctgatattttcatcaccctgctgaatatttccactttaatattagaaaccgatattcttatttatttacttattttgtaactaagaaccctctgggtttgctatatgttctcatgacatgaatattagtccaattttctaagtttaaaagatttgaaatacctttaacttctctttcttaatggccctctcatccaattaattatcaaattgtcctaattttatccctatagtgtcttttgcatgaatccttattctttgaatctctcattcctggccgggtgcagtggctcatgcctgtaatcccagcactttgggaggtcaaggcaggtggatcacttgaggtcaggaatttgagatcagcctggccaacatggtgaaaccccatctctactaaaaatacaaaaaataggcaggtgtggtgatggtcccctgtaatcccagctactcaggaggctgaggcaggagaatctcttgacccagggaggcggagcctgcagtgagctgagattctgccactgcactccagcctgggtaacagaggcagactctgtctaaataaaataaaataaaataaaataaaataaaataaaatataaaaaatctcattcttcagagcttgcctgaaatagtttctaacttgtctcctgattcaattctcaacatgctacatttgatatacaagtctatcctacatttgtatatcatgctgaattttaacaagatcatcactgctttgccacttagaggagaaaggtactttaaagtagtcttaaaatttctttgtataaaataattttatttcactctgttatgcatgtataaaaataggctaaatgtatcttaatgactgctccaaaatgttacaattttttaaatagctttaacccagaaaaaatatttttagtctttaatcctgatttgggggctttatttttaagcaaaatttggcaactatagttctatgctatttctagaatgccagcttttagatattattttcaaagcgaatgtcttaaatctcaacaatcatgtaatcattattcagtgctcaaataaaaattaacataattattctgactttgcttaagaattaagataatgcagagcccttagctatctaaattgagatatatatggttcaaaggagaatcagtatttcaatttgctgagtttgttaagtaatagtcatacataatattatcacataaatgatttattcataggagaatattataaatctgctataaagccaaaatatgacatttggaatcccaggctacccatcatatgaaaaattttggaggttaattgaaaggcatgtaagaggctgaagttgagacattgcttcaaactattttgagatttttatcttaagtcaggtgcctatattttaatttgtatcatgtagtatttcttatatattaagacttacattttgtagtcagacaggaatatgttgaatctttgttttgcaactcgctagatttgagcacctggacaaattttcattaaagttcacacaacattcagttgtgacaattttattggataaagcacacaaaaaaggattgacatagggaatggaacacagtgagcacttagtaaattgtacctattattattattactatcacaatttaaattatatctgtgggaaaaatgaacaaacacaaaaacatgtagtcctaggtaagtcccaaaactaaaacttttctgtaagtttcactatatttcctcttcataatggcattcatatgtttatattcattataagactaaaataaacacatacagtataagatgtgaatgatccactaggtatatgtttttctttcatcacctttaatattaaaaaacaaagtacataaatgatattattaaataatttcaaccacaagtgaaataaaaaatttgagaaaattatgacaaagagaggcttatataatacttaaaatgtaaaaatatcctgcttttattatcagtgaagaaattaagtaatgaggccataatatattttttttgaaaatatcacttaactacttttttaaagctatttttagattgtaattttaaaagtgggccgggtgtgatggctcacacctgtgatcccagcagttttggaggccaaggcaagtggatcacttgaggtcatgagatcaagaccaggctggccaacatggtgaaaacccatctctactaagaataccaaaaaaaaaaaaaaaaaaaaattgctgagcgtggcacacgcctgtaatcccagctacttcagaggctgaggcaggagaatcacttgaacctgggaggcggagtttgcagtgaaccgaaatcacaccattgcactccagcctgggcgacagagggagactctgtctcaaaaaaaaaagaaaaaaagtgtaagacacaattcaaattcttgcataacagctacaaaatcttcataaaaaacgaatcaggagtcaattattgaagtttatgcttattctacacaagactgatctaaggaaatatgtgtcaggggcgttagacatatagaagggaatttaaaagcatattgtatttctgtaacacatatttcatttagggattcaggtggaagaccccgagctagtacctttaggaagattgccttctaaatctaccttctagttcacctcacttctctaagaaaattgctgaagacactgctatataatagtgcaataatgtttattaagatatattactgcagcttttttctaacttttaaaaaagtaagtaacaatgataattataacagctaatatttcttaaatgttaccatgtgtgagacattgtgctaagcattcgtaggtgttttctctttcaatccatacaaaaccctctgagataggtaccattttatcgtcattttcaaaatgtggaaaatgaagcagagttaagaaatttaagttcacaaaatgagtaagaggcagggcaaaaattctaagccagacatattaactcctgaattcaagcttttaatctattaaatcctctaaagagatcagattaatcaatattacaacttacctgaatctcattcatttaaatgcatttacatatataccacccacccagatgggagtagggttgggagtagggataatatagcctgatgagtagctagcaagaatatattggaccagcttagttgggtccactggccagaaaaatattctccaggtaaatctggcatttctcattcttttaaaactctccttcttctaggtctgtcattcacttaccttatgttaacctcacttattccctcttgggaaagtgagaaggtaattagtttctcaataagatgagtaaggttctagaaaagcttcaggcacagctaatgtgaagtgctgaactcagaagaaacaaacagaggtaaggagtgtgctcataaaaattttattgtaagatgacccagtgggtcaaaatataagtaattttagttgtttctaaagtgcagcttcattcgatgtggtttctgtttcttatttctcactgtatagggatattgacatgcatttgctctatggattatctcattactttctgttgcataactgtcccctttcatgttgcaaagtacaaactagtctgggtcacaatggagagagagtgttatatattccatttgcaagtctaaaataatattatttccaattgatttaatggaggtgcattttctccatctctctttgtttcttgaaatgcaaaaataggtttgagcttcactgtgcacatgtggataaatacaactcatttgccatgaaaacaaggctcaattttgtatagcaattagaaatcagtttaagcattgctactttaagtttgtatcctcatttctacaataaataaatcattataatacttttttattctgtctaaacacatctcatctgaaaggcaagatcttctgggactcaattcattcagttggttcatgtcattctattatgctaataaaattggtatttgcttattctacagcttctgtgtgggggtttagaaagtctgtaattaaattcccaagatttgtggcttcttacaggttttgaaacagaaaaaagtctgtaataaggagaaacagaatgatcaatgtgtagcagttagtgggacatttttaaaacaatgctacaacaccaaaatttaagttacactaaaaataaatgtaatttactgtatttcaaatttgatggaattatggttacatatttttaatgaaaaaaattaatttatcctgatatataatggttatcactggcaaagtgtacaattaaaaagctttggggaaagttatcagaattcctgggttctagggtctgttcaattattgatttgatcttcaatcaagcatcactctttggggacactaagaccctgctgctttgctcatggtcaggaaattcaatgcccaaataggagaagtcatgtaatatcctatataattcctaagagatatttccaaatgagaacacatggcactctcaatgcagggagactgtatatgaatcctgccttacccccagtgtggtctattttggaggtacacaaacatttacatgtagcactatgataagatacaatggagattatatatatataatttgacacatacacacatacacacacatacatatatatatacatatatgattatatataatttgacacatatacacatacacatatatatacatacatatatgtatatatacataactcaccatatctctctctttttctgccttttttctttttaaatataatatgtatattttaaatataatatatatattttaaatataatgtgtatatctttttaaatataatatgtatacatacatatatgtatatatacatatacataactcaccatatgtctctttctttttctgccttttttctttttaaatataatagacacgttaagggaatccaagttttaaaaactcttagtcattttcaggagatttcttaaaacaacccacaacatagtaagagatatagtaaaagagcatttcttatcatctttatttgttctattttaaaatgtagcaactagaaatatatatatgtgtgtgtgtgtgtgtgtgtatgtgtgtgtgttgtgaatatgttctttattttttactgcatggagctgtcattcactcaataattcaatcatttctttacccaaaatttccagggactcctggaaatacatcagtttaagaaaaaaacttacatactgtcgtatgttacaatgtagtatccattatgaagaataaagtggaagaatgagttaggaatacttgggcagagtagaaaagacagtggttctaattttgagtcggtagaccaggaaaagtggacatttgaacagaaaattgatggcgaggaagcaagccatgccaatggaaacaatccaagaagaggaaacagcaaagacaaaggccttaaggcagaaagtggcctaacttatttgagcaatattcaacagccctgtaagaatagaaaagcatgagcctgggacagtatgttagagagagggtcatagagggaatggagacacaggtcatgtaaggatttttggtatccttcaagtgaagtagagagccatgggaagtttcagcagaagagaaatgtgcactgacttagttttaagaggatcaatttggttgctctggtgaaaaaagactgcaatgagagttgtttggatgcttttccaagaatccagtggaaaatgtgattataataggatgagaatcatagcactggaggtaaagttatatctagtagaatttgctggctggaagtaggacatgatatagagaatggagtgtagatgttttgtttgttttgtgtgtgtgtttggttttacttgaaaactggaaggacaaagttacatttacaagatcgaaaagacaggactaacacaacaaaataacgacagctcagttttcatcatgtaaagttgaagagacctattaagcattcatgtgaagatgataagtaacaattgggttaataaatgtgaaatttagaagaaagttctacactttagataaactatctgaaaatcatgtggacagtcaataaaaacatgagactgaatgagctcatcaaatgcatgagtatagctagagaagaaagcaaaaatgttaggacttgtggtctcacatactccagccttaaagagatcaatcagatgatgacatacaagcaaaggtgtcagagaaaaagaagaaaataaaaaagaaaataaaataaaacgaaagaaaatgtatttaaaaaggaagtggtgttcaactggggcaaatgctcttcataagtcaagatagatacaaatggatttagcaatgtggaaacaagcaatgtaaccttggtaattgccaattactatacgatatataaattaatcatataatcacctgaagaaatgtaaatttgctactgcaaaacaatggtacaataagattcaactacaggaaaattcaccatagtgaaagaaggctaggaagatttcttagagaaaatgatggtcagaaaaatgctgaataactagtgagcattaactgggcaacagagggaagaactgcccaagtcaagggaatgtcagcaggggactaaaagacagcaagtagagtttctggagaacatcaaagggaacgagggttaaaattagaggggatagataggcagcccatgcagtgccttgatatttacagggttttcttttttctgttgggttttttttcaattattattatttccttgtttgcttttttcttattctaagaacaatgggaagccattaagtggttttaaaagggaatggggtagagataggggtggtggaatattcttacattcacactttgaaaaagatcactggctgctcatgaaaaaacagattagtagagactactatagatgacaaagagaaaaggtgaattgcctggaaacttacagtagtccagggagaaataatggtagattggcccagagtggtcagtggtaatgtcagagagaaattggcagattcacgagaatagaaattcctttcaagaatacagttgaaacagcagtcagaaaaaattaactgaacttgaattaaataagtgcccttaaatatttgtgaattatttaaaacattttgttattcttcatttatcttcattgccatcagtactggagaccaacaagcagacacctagaatgacagtcctgatcttgtcctcatgttagcccacaggaaagtacatttatggtgtactgtgtaagacaagtgaaagtgaagggaaaaccataaattttattactggaataataagataagaagataagatcttctttacctaaagtagttcttgtctgtattactgattctcgtaatcgaaaatttcatacatataaacaatttaggtgggaggaaactttatattaaaaataacttgtcaagaatgacatgccaaacaaagctcatgtaaaaactgcacacctaaattgtatattctagttgtttctattttgaacagggcagatgaaaagttacttgtacatttgattcttgattatcatgcaatacaaggttattttaatgacatccaagcagcaacaatatatctggcctaaacttcgaaagagtcattaatttaattcattcttttctttctttttttttttttgagacggagtttctctctgtcacccaggctggagtgcagtggtgccatctcggctcactgcaacctccctctcccaggttcatggcattctcctgcctcagcctcccgagtagctgggactacaggcgcccaccaccatgcctggctaagttttttgtatttttaggagagacggggtttcactgtgttagctaggattgtctcgatctcctgacctcgtgatctgcccgccgctgcctcccaaactgctggggttacaggcgtgagccactgtgccaggcctaatttaactcactctttatgtgttttcccatcttggccaagcaaaaattacctaccagcagaacaggatttcaaaacgtttccgtgtaatctgttttctctaagatgggttaatcatctgatgggcactgagttcacttaataagcatgctgtctagagacaaggcaggaatgctatttggcctgaacaatcaccaaatagttcctgaagtcattaccttacacctcagccagaagttatcttgggaaagacaatcaaatctcttggctgcttacccagagtttgagaatcccagtaacgtatattcacaatgattcacaatggcataggattgtgatagcaaattcaaatggaaactaggaaatagagagcaaatatctgtgtatattagacacagcttcccctagaaataaagatagatgctcctatgtaatctgatgtttgattcattgaagacctgaattctgattgtcagcaaataaaacatcacttttcatgcatgaaatattttttccttataaaactgagggattaatttagatttaggtaaaatatagctgagatacaagataggttttcaaactctttacaagccttttgggaagtgttaacaaatgctttgggatttttcacactcaaatgttatttaacacatctggcacaacaggtggcatggccagtaggtcatttcagcatgataatttgacttcatatttattagagcaaaatatgtgtttaatgagtatttcttttatcactatttcaatcatcataactcaccatatctctctttctttttctgccttttttctttttaaatataacagacaggttaagggaatgcaagttttaaaaagtcttagtcattttcaggagatttcttaaaacaaacaacccacagcatagtaagagatatactaaaagagcatttcttatcatctttatttgttctattttaaaatgtagcaactagaaatgtatttagtgacacaacaactcattcacatttaattattcatctattcattacccaaatatttgttgagtttatgtgtaaggccctagtcaaaagtagttgtaatatacagtttatattttaaaattgattccaccacttaacagatatatcaatctcaatgatttaaaataaagtatgtatagtaccaaacatgaatatatgtttaaaatttaattttggcaaaaaattaccccaggaaaataaacatcaccattttgccctacatgatgacatttatcattggcttcctaaaacataatggaaaggaagtttgcattatcactttatatattctattattaaactttcacttatactgatttccatacccaaataaatcttgacagaatagagtcatactgctttgttgttcaaaagttctctgcagccttaaaggtaactgtcatcttgtaagcaatgtttcaaagtagattagagtctgaacattaagttttagatgtcaattatctttataacttataaaactgatagagatgaatacatttagatacattctatgttattaaagtttaaacaaattaatcaggatctgttttcttttaaaattatataactgccttagctctattgatatttgtaaaaatataaatgcagaattcagaattaaccctgcataattagagaagaggaaaaagtaacttaaggggaataataatgttgctgagaaatgaataggatgacaatacaatgattaaaaattcatataaaatgcaagttgcatcaattataaggaacacagtgtgaaagggtgttcctatgttgaaagataataaaaactattttaattttaaatatcaaagcatttatagttacaggtgaggaagcactgaaaatagataaaatttaaccatctaaatatcagaaaatatatcagctatctcatataacataagctattattggtaactttaaaaacaacaaaagaatgtcaagaaatcaaaaattttaaatgtgaatccttattatcaaagcttgtgatagtgatgcccaagtgtgcattcaaaacaattactttttttccagctatttagagtaatatgcaaagtgcaaatgggagatgaaatatttaattcttattctcgcaactggattcagcttaatcagttttaccttagaaagagatctgttatgagtaacagtattagatgttaaaagtagtcacatgcagttaatgtcagggtgaaacaactgaaatcaaaggaggaaattaattacatagacattctagttggaatccagttggcatgcatgatcaagtgggtcacattttgttttctaaggaatttggtaaacaagtctgtgtcttttgatatctgtacacagagtgtactattgctactcatttgatcttacagaatactatagtcttccataggttaactgattgtatgccctatctgtatgccttattccagtgagccctgtaatagcacttggtccaacagcttcagtaataaagataatgaactcttcctggcactgtggaggtcaaatgattcataattttcaatactaattccaaagacttgctaatgtgaccactatttcaacctaattgactattctttaggtttgttatttggaaggccttaatttttgctctatgttggtatttatcattattatttgcaccgtctgtcttgtttattctccctctttttttgcttctttttttcttttcttgcaactataaagaatatgaggccataatcattctctttttgtatctatgcagtttaccaccagatcctgcaggttttaaaattatgtaagaattcacattgatatttaagagtttcaagtcccgaaacatcagctggctcccttcaattaattgctctttttctgcacaaggaatctgcccacacaacttaccttgatgtacttggagccaatttcttctgactcactgtagcagttctgtagctttccggctgtgattaattctcacatctgatattaatttatatgctcactcttaagtcatatactcttcatttagatcttggttctatactcacctgatctagcagctttatccagaatagtccaaataagcctaggtaatcctagttcaggacaacaattctctttctttctccaaatgaacaggcacttttatgtttccaagtgccactgaagcatcaatttactgagatacatagcagttaacataattaaattgaatcacacaatgagctttgttgaggtctgaaggaattaatagaactccaggcaaagaagaggttaaaatttttgaaccattttagctaagcatctgagatgtttagatatcatcttctatttcagtataaggagatctaatttcagccaatcgctgccctgtttatattttggaaacttctccaaataattggaaaatgcattagtgcaaagtcactcactcctgtctttgatgatttatttcccctcaagagaaaaaaaaaatacaatgacatgttatttagttgccaaataaaaagttgtctcagcctggcgtggtggctcacgtctctattcccagcactttggaaggccggggcggggggatcacaaggtcaggagttcgagacaatcctagccaacatggtgaaaccccgtctctactaaaaatacaaaaattagctgggcatggtggtgcatgcctgcaatcccagctactcaagaggcagaggcaggagaatcacttgaacccgggaggcagaggttgcagtgagccgagatcgtgccattgcactccagcctgggcgacaggcaagactctgtctcagaaaaaatagttgtctcacatatggaaaattccatatctgttccactaccacctttattattcaaactgagatttaaaaatcaaatatacttgttactccacccatttaattttgtattctcctctttcattcacttaaaaaataaaattggaacttatttattttccttaaaaaatcattctatacttcacagagactattggaaactacatttcataaatcagttgaattataaggaatcatgcagtgaattcctaaaccccaaacactctttttttatagcttttacttctttagaacttctagacggatataagttacttgtttgtccagtaacttgactgcttattacatgtttaccactgctgtagcagctagatttgaaaataaaggacgttttccagcagtacctaacgcttatggtcacattatagaatacaaaagcacacactgactttttcaggagttttaaaataagtatattgttattttattttcctctttagaggcttagacattggtcagaaatagcactgtggcagtcatctagtggttcctatgccaggttgcaggcattggcctgagaggtattctgttacattcagtgggtgaattcacctgatgaagcatgttatagatgttatacatacatgtctttctacctatgttaaccttccctgagaccttgtgtgggaaagccactataaagacatattctaaataggtcactcactgtcatgatctggttgtgtctgtctctccattatgtctctctattatccgcaagtacatgatggacccttaagataataaattaagttagattggtattttaaaatttaactatcagaggcttaaattataaatgaggtataaattgctgttttaattaatattatttgatagagtagttatttcagagcaaaaattaaaaaaattggagaaatcatgaaatataattttgcaaaacagatactttgaagctatgttggcaattacagcatgcctgaaatctatctaaaatttatcttttccacattaaaatatttttaactattaatatgatcttagcatttcaggtggcaatcctgtgacattcttcatatccaaagacaaaagccatctctaggacacaaataaaactttccagtggagcttgctggagcacttctcgaattcctatccagcaccgtcattctacaatctgttttctttcaaagggaatatatttcaactgagatttttcctctttgactgcatgttatataagtacttcactgatttagttctttctactaggtgatcacattttcctttttctgagtctaccgatttctgcaatttatggactgagcatctcacactactctctgggtggtttatgtaaataacaataataaaagcccctgaagctgcatccctgttcccagtggtttcccactgacctctttcagcttgaaaaggttctatctattgctgatttttttttccttcctactggcaattttcagcctactgtgcttcttcatctcatttcttgactctttcttgacttaagaattaattattgaaatgtatcagatgcactctgaaaatgtcagtgtatttagttggatttacaaaaaagcacagcttttcagccaacatgatattggaagtgaatatcaagtagcacctttctccacacatccttttcacaggcaacagaaaaacataaggcagatgatctataccatctctgaaaaggtttgtgctgcataaggacatttgtctctatcgctttaaagcataatgtttacctttgcattttagtgccttttttcccattgaaactttaacaaacactttgtatagaactacaagagactcacagaagctgtccatctatcctcctgcctcctaaccagcctggggctaatttaatctatccaattcagacagttattgatcccagtaaaaaaaagaattcactacctcccttgtattgggtagaatattctacaaacctgtcctcacaaatccagatacaggaattcatacactgaatagcgcaaagaggcagctttcaagtgaaaacaatttaaactcaaaggttaaaatcacctcaaaagagattctaaagtatttattaaaacatctcaggtatagatttaggaagaaaagagacattgtaagtcataagagaaaattttaaaagatatttaaataaatatatatttaagtagttaagatttcatccatattaaattgtaaaataattattaggcaagttctactttaggtacttctgttcaatggtgtatacaaataacaaaagagacaaaatccctagcctcatagagcatatactccagagggggaagacaaacaacaataatagcaagatgagtagacattctagtcatgtttaaaggtgattagtactatgaagaaaacacaaggaagggatctgagacatgcctagtggtagggcaactgctacttaaactggagtaatggaactcatggagagtacaatgatggttaccagaggctaggaaaggtagtgggggatttaggggatgggacaaggaatgactaatgggtacaaataaatagttacaaagaatgaataagattgaatatttgatagcacaatggggtaactaaattcaataataaatttaattgtacatttttaaataatcaagagtatacttggattctttgtaacactatggataaatgcttgaggtgaaggagatcgcatttactctgaagtaattattacacattgtgtatctgtatcaaaatatctcatataacccataaacatatacatctgccatgtacccacaaaaaataaaaaaatataaagataaataataaataaataaataaataagtaaatgaaatactcggggtaaggtcttaatgagaagacgatgtttggacagaatgaaggtggggagggagcagccatgaggctattgggggatgagcactatgagttaagtataagatcagagcaagggccccaaggcaggagtatgcttgccatgcttaaggagcaaggggtctggaatgggtgaagaagatggaggccaggatcaaaaggaagtcaggaggagagaagagtggatgaaattggtggggtaacaggacctggttgcatggggacaagtaggccagctcaagggctcaacttttactctgagtgcaatggcaaagcattggcagggcagcggaagaatggcatgctctgccttatgaatttaaatggaaattatggttgctttgttggtgagggttcaagatgttattgtaatactatagggaagagttaatggtggtttttattatgtgctagtgtggcgttggtgagaagaaattgcatttaatttaaaattatagccaggagacttttctggaagtttggaggcagaatgcagagaaaggaaagagtcaagggtgtctctaaggctttggctgattgttaaaagcccaagcaatttctacctcagtggcttttgatgttattactggattgccataaaataattgttcataatgaggttctagttgctctttggggaaattttaaattgaagttgttaaaaataaaaaatctccatgcttttaaaaagtactagtaatcattcaacatttttattttgttggataatggtattttcctgactgtgtgtcttcttttatttcctagttgaccataagtgttgttgaacttttcattgtgttggaagggggaaggctaaagttgggggtagactttgattctgacacaacaaataaatggatcatggagaaaataaaaaaaacaggcaaaagagagattaacaaggaaggagtctcagaaagaaaacagtcaacacgattcagaagtaagatgtaactttatataaagagtgttacgtgggctgggtgtggtggctcacgccggtaatcccaacactttgggaggtgaaggtgggaaaatcacttgagaccaagagttcaagaccagcctatgcaacattgcgataccccatctctacaaaaaattaaaaattattcaggcatagtggtgcatgcctgtagtcccagctactcaggaggctgaggtggcaggatggcttgagctgttgaatgaaattatgaagttacatcttacttctgaatcgtgttgaatattttctttctgagattccttccttgttaatttctcttttgcctatgttttttttcttgttttctccatggtccatttattttttgtgtcagaatgaaagcctacccccaactttagccttccccactccaatacaatgaaaagatcaacaacacttatggtcaaccaggaaataaaagaagatacatagtcagaaaaataccattatccaacataataaaaacgtttaatgtttactagtactttttaaaaggatggagttttttatttttaattttaacaacttcaatttaaaatttccccaaagagcaactagaacctcattatgaacaattattttatggcaatccagtaataacatcaaaagccactgaggtaaaaattgcttgggcttttaacaagcattgcagctatgcaagattccttcttgctcatttctgatttctagaaacatacctgttgatcattagcactgttatcttattacataaatagaactgatggatgtatatttggaaaagccctgtgtgtttttctccacctactcattgaaaacaaaggctttagaaggaaaaatatggagaatttgtattgtaacatcgatattctaagcacaaaaacaagtgtaccatataactgcatttttctaaattcaacaaaatggtattttgtgccatcatttcatatgtgcctgccctcctccttttctttttctctttctctttcattgtcagtattttcctcatatctttcatccctgtgactccatcctgcagctcctgaataaaagtctctttctctacacttaatgtctcatgtctgctttagagtcttatcccagtcctaagatcttctgaggaaaaatttctcaggaatccctctgaaccatctagagctcacattgtcttcccgtgactcagggggtaactctccccaagctgcccttccaatttctcttctactcattgatttttcttcatgttgtcagagatagatgtgtcttatctccccacctccatcatgtcttttcaaatcttttgttaagtccaagttttttctctgagggctgaggcttttaaaatcaaaaagctaggaaagagttcgttttcctctaatttttgaatttacattttccctgttgtcaggatactgaataacctgacttctgcctgatttcagaaggtaaaacaggatgaagagaagaccaaagcagatctggaaatataagaaaaatatgtaataatatttcaaaaatattaacattgactaccagaaatactacagataacatcctgtactcgcttgactcttaaattgcttgtttaccaattcaccaacaccaagcaatttcatttacattttggagaattatgtatcctgttttcaatattttcttttactcatgcattcttcatctatgaagcttccatcttacgagatggaaattaaataatttcttaaaattagaaattaatttgttttatgatcacctatgaatagttaacacattacttaaacacagatcttcatattatgtgacaaacaattttctacttaacacttccttgtatgtttgtatattaatataaataaattgtctgccctccaattagaaggaaagagtaaataagatacttgtagtacatgatgagagattattaggatacaggagaaagtgaaggcaacatcaatgggagaaaaagaatgagaggcagagaatcaacccatcttggctgagctgcttcaagaatggtaaaacctttattcttctatgatgttctggtgccttataaagaggatactaaatgggtatgacagcagaaatacagtaaagactataaatgtaatatgcaggctgtttcagtgtttaaaatagaatgaaaaatttggaaatttatgaacatttagaatctcattagtttcataaataaccacagtctcaatgagatcatcaaaactgctagcataatcaggtttatactgatttactttttaatattactcattttgacaatgaggagcagtttctgaatgaattatgtgctgtaggatgacactgtatggaaaggagaactagagtgggcctcatatgaggaggcgtactaattgatacagtaaaactttttgatataaaggagtttcctctataagctgctatggcatttaatgcaaagaaatatggttcatttttaacattttattataatataaaacatcctttcaatatgtttttaaaaatgcatgtgtgtgaaattgttttataaattgagaacttttccccctgttgaaccataatctccattagtagaaaaagaagattatgtagatttttttctctatcaaactctcaggaacattcctcttccagacatcaaagcctttctctcatcatactgctcttaataggcctcaatattgttagcttttaaaatgaaagtattgagaagttcatttatattcttcttataatcaactttatcttatttatgtctagacatccatttaaaaaaaaaataagcagacagcattgccaaaagaaacgaagcaggcgaaatagcctaaattgtccttatgtctcctttctagtcaatttatttctctacccaggtttctgatgggtatctgtgtttgtgcaggaactctgactgtatctacttcagctgaacgctcacttatctgagtctaataatgtcagggccctagatgcaaataggatggagaagactggaagagagattgtgttagtcacatcacgcatttctcagtttcacatcatctgaaaaactttccctgcctggtttcctcagtctttccacagctgccctcatcctaatcccatttaggggggtttcctttatgcacttttatggtggcctgtatttgcctctctcaggtgtttaccacatgtttttgtctttattgatatgttcttttatctttctaaactgtaaggaactttactagttcttaatatagcaactagtcatctgtaagtattcaatgttgtctggtggataaatgaattaattataaaagtattcaaacagtgtacatcaaagaaggcagctcaagacatgctgtaaatatgagataataataacttttgatattaagttgaaagctacaagatatcaacagtgtctttagataagttcaataagcttttcagagtatagcttcaactgtgcttatgattcatatctaatgcagaataacaagagaaattcatgggaaaaaatatgccacctacaaggaacagatttgcacaatactccttatcattagtaaacagaaaatgtcagaacaggtgtatacttttgaaacaaaagaattcaataccatatacaaaacaaacaatggcaagaacaacaacaaaaaactgatatcaaatgtatccccaatttgttactaattactaattacttagtaattagtaatactaagtgcagatgcttttctaaacactttttactcattttcttacttcatctgtattgcaaccctagaagaaatagttatatgagtttcatttttataaaaataattagcgtgataattattcttcagttatctttactttcacagcataacccattttttcctacttatcattacattattaaatgctttaatgaagtacaaatcaattttgttagaaattgccaatctaaaaagaaaaagattacttgctctaaattgatacaacccgggatatatctgtatcttggaacattttgtggtataaataaattttaaaaatgctgacagagaaatctctacagcaaactatagacaagttttgtgtatttgtgttgtgtgactgtgcatagagaggaagaaatatgtggtagtaacatgacaatcactaagcccagaatattttcatatgcagaggttcatgaatttccttgggattaaagtaaatgtgttgtgaattctaccattccttttgttttattttcaagtgctaacatttgcctatccctaaatagtttttgtttgtttgtttagttgggagaatttgggtatacaatttatatcagtatttttgttgttattgttgctatttgggtgctttgtgtatggtattagattcctttgttttaagagtatatacctcttctgatattatctgtttagtaatgatcacgtgtatggtcaactcttctccttttaggtgatgtaaaatttttccatgaattactctttgtcattctgcgttagatataaatcttaacaatttttaaagctatagtctgagaagtttattgaactcatcttaagacttttttgtatcccatatctttctgtttaatatcaaaagttcaacctttgatcatgcatttttactttcagaagatgtgtagtaattttctcaccaactccacatcttttgagatgtgttttcatcatgaatgagtttattttgacatccagatagcatttgctgaaatgtgaatggtgtgttctctgctacttaattttctaaggtcatccctccagctttctaaaatttgtcatttattcatctgtctttaagcttgcaattggaaatttgggaacaaagtggaattgtacaagcagcaggactgaaaatacaaatattcttcctcttgttccttgtcatattggaaatattctatgattcaatgaagaacactttgagatacagaataaggggttatggtaaatatagtgaatattcaatcattgtgttctttaaatgtatttataatacatacaaaaatacaacaaagaaaatattttattatttccctttctcatggtaagaacagctagattctttagtggggcatttttattaaaatgagtaagaaatatatcaagtgccatggtacagaatatttactatcttggatgtctgatgttgctctggcactaagataaaaagaattagagcatttttttttattgactagtttcctaagctagggtcctccatgctatcagtgtgcatactcagggaacaaatgtaatttcatatgtgacaccatttaccgtatgttataatttgacaagcttagtgagaacttggttcatgaaaagcaaacattcataactttctttcttggaagcctcattacaaaattacatataatataggcattagatttagaatttaaataagagaggaatttaatatcaactaaaacaagcataaaagaacattttgaaaagtaattacccagaaatcttgaaactggaaaagaaagaatgtaggtcaaaattggaggtcctaatgtacagtgagtcattcagctgggaagaaacccgagaggtgaggcaaaaactgggtaggggcaatggtggtggaggtgatagaaaagaacctaagataaaaatctagtcaaggggtctaacattcattgagaaactatgtgtagtgaggaaaggaactacctatgtctgaacatgaagcaaaccagttgtaggttgagcttcatttttctcaacggcaaacagttttcatttgttttcaggattgaagagtaaaactcttaaggatatccttggtattattagatgtcatcttacaatatttatcatcttaatgacatgtttaaataagtatgttttataaaatatatttgttgagaaatagaattttatttctatgttcctatttcatggaaaggttattcagaattctcatatacatctttggcatcagagacttgtcatcaatacacccatgtgttgagtcatttaacatgtgtttctcagagcacgtcttcacatccatttaggttctttgagacgctgcagcactctcacatttgtctatgatgcaaattttaatgcaaacccaaagtacccatttgctttgcatggtcttcaccagacagtcagttaatatatttcttaaaggatcttttaaaaactcgacaaccaacacttgcaattatccaggcatatgcttatgactaagcccatgttaaattctgtttgcttttattttatgtttgtaaagatcatctcaaatgacctttataaatatcagaactatcactagaggatgtcattaggtaaatgtctcttctgacaatagtagtatgagagccttcgtaaggactaatacctatggtaatttttcttagaaatgattttagatgaaatgaatcaaaaagggccctagcacaaaacactcaactttaagataatttaaatagaatttaacaaagagatgtttaacaaagaagtggatagtgtataggaaaagaaacagtgcactaccccatggttggtaacagggcagctaccaccaatactcaacctgaagatgcaaaaggagataatgatttccaagataagaaagagagaatagtgtagagagagccactttcaaagatgaggcctagccagcatgatgcaaccctgctgggatatgagattctgacctttttctttcctttttctgatctgctgaaagagttctgcacttgtctaacttaatcagaagcctcccagggcagaaacaggtagagaaggatcaggggtgtgtggtgtagatctaggcagtcaaatataagatatgcagcccaggaagaactttaacatctctcctcccttctcttttcttctctcccttctccttatgtctcatatgtgtgcgtgcacacacacacacacacacacacacacactaagttgacttaagcttttccaaagtccatcagcaggtcagcatgtgggatttggattctgactatatgaaaggattaaacttttgcattgttacccaggaagaaagaagacaaattatctgaaaacaaaaatagccattctgatgcctcctgtctcattgtctagtaagtcatcctaaagttattgcccaaatgcaaacattaatgtccagattgccccactcgtggaaagaaaaaaatcatggatttttttttctgcaagtaaatacaaaagtttcaacacataaatagagtgaaggtaacacaaatagttttcagatgaatttaatcattcagatgctgaatataaatgacaatccaaaaaacattggccaattaagaaaataaaggaaaagagtacaaaagcagaggctggaaaacaaagcaccttaaaaaatactaaggaggcttcccaggtttgccatggtgaattttttccttactcagtaggtacaaatagaaaatgttcacagaaatatttttgtcatgcagctgcaaaggtaggcagatctgctttctatgattgatgatatcgtttttccttttaacatgacagaatttgttaaaaaaagaaaaacaactgtgctcccagggatattgggagctgtgctgtagacagcagatgtatggttcgtatctaatatccaaatacattaaatatatatttttttcaaatgctatggcattattagaaaagcggaaagacagtcctggctttgatgaagcaagaaagaaaggacattataaaggaacgctggaagaggcaaaaagaagaaagaggaaggggaaagaaaggtaaaagaaaataagtatcagaaaatgatgtggagagagtgtaaacgtagaaacaggaaaaaaaatgtgattgcaagaagaaataggcagacaccagaaccctgatatgtgacatttgtacatataaatttagtgaaagacagttgcagtttctcctgtcataatagccaatgggttaaacactgacatacacacacactgtacacaacctttgtacctgttggcatcacataagaagtcggtctacttctagtctaccttctcaagtacagctctatgcctcttcatgggaggtgatctggtgctagctaagaatgactaggaacaacatgagcagacaatataggaactagaacaggtgagtacaaagcgtgcagtaagggtagagaaaattatgacacctgttctgatatgactcctattgttagtggccgcgaactcgtatgcgtctgcagcaacctcaattcttgctgccagagaagaaagaattcaagggaggggcaaaaggcagagtgagagactgagacaagttttagagcaggaaggaaagtaaagtaaacttggaagagggtcaagtgggcaacctgagagattcaagtgtgtggcttgacctttgacttggggttttataggttggcgttcttgcagggtctgattttcttctccctggactcttcctttgaggtgggctgtctgcatacgcagtggcctgccagcccttgggaggggtgcacgtgtcgtgtgtttactggagatgtatgcgtgctcacttgaggtgttcttcccttgccagtctaatgtttctagaagtcatataccagttaaatgtggccattttgtctcttaatgtgcacacttgagcccacttgcccaggtcctgaaatcttactggaaagctgctgatcaccagcttcaggtgtttctatctattgggagactgccattccctgacaccaggtgcaaccaattattcttttagacagtgaaacaaccacctgaccatcacctgatggttgcctgacagtcctggtggggggccctctcctgctctgatcatgtctaactagctacctactctaacactctaacactaaggattcacagatttttaaatcactatctcatatggaactcaccgtaagcctagaaaggtatttgagtagctttttacttgtcttctataatgtaccctagttattttatgaattttcgtatgctttacctacagatcactggttattagaaccaagcaaccatgggtctgcactttgtttgatttgccagtttcaacatttatttaatttgatcacaaaatagtgctaatcaaattctccaaacaagttttgtgagaatgtaaaaacaaaaagaaaacaataataataaaagccattactgattatttcaaatttcttcaataaaacaaacattaacattgtcatgactgtctcaatttttttaaaaagaaactaacattttaacaaaaaaacaaacaaacaaaaaaataccaccatagagtattgacatttttttaaaagcagcgtgcaactcaaaaggatcttggcttatagaaaaatgaaatagaaatatccttagaaggtaaaacgtattgatttaaattaacagtaaattagtcagattcttttcagttgcaagttacagaaacccagttctaataacttaaccatatttgatgttttttacaaaaactctctggcaccaactggacgtcctacaatttaactcaattctgatatattatctagagttagtgcagtcccacaaattaggagtcagttgcacaagaccatccccaattccattgtcagccaaagttatggtatcctcaagttacccatacttgacctggctgacccaaaatgtgggggttccctcaagcctttcctctcctccccctccaggttggaaaatgtgttagaacaatttacagaactcaggaaagcactaccattatatttttattataaagaatacaacccaggaatagccaaatggaaaagatgctttaaaatggtatgtgggagtgggtgggtagcccagagcttcctgccctctccagacatgccaccctgtcagcaaactgttgtgttcaacaacctgaaacctccccaacctcattgttcaagtttttactgagacacttcattacttggacactgtattagtagtccattcttgcactactataaagatttggcaattaataaagaaaaaagtttaattggttcactattccatgggctgtacaggaagcatggctgggtaagcctcaggaaactcaatcatggtggaaggtgaaggggaagcaggcatattttacagggctggagcaggaggaagtgagagaagggggaggtgctacacacttttaaacagccagatctcctgagaactcactatcatgaaaacagcaagaggggaatccacccccatgatccaatcacccctcaccaggtccctcctccaacaccagggattataatttcacatgagatttgggtggtgacacaaatcagaaccatatcagatatgactgattaaatcatggccacttgattaaactcaacatgtagcaacttccctcttctccaggaagttgggagatggggctgaaagttccaaacctctaatcacttggcaagcccctcccttgacactctctaagaggccaccatgacacaccttgttagcataaactcaagtatggttgaaaggggctcatgatgaataacaaaagacatgcctatggctcagaaaattctaagggtgtttgaatctcttgtgacaggagtctaggacaaagaccaatttttttttttaattacaccacagcataaaaagagatttaatggtctatatgtctggaaagttcagggtgacctttagacatgactgaacgcaagggctcgaataatgtcatcatcatgtctttttctcacaaacttcttttctccactttcttctaactcaagtttattcttagatggtcttggaccaaattaggcaatgattaattctgattattgaatccagattgctccagatccttatctacatatatacatgatcattggctctcccaatgtttgaagacattgcatattgaatacacatataattaaattttatttgacattgtcagttatgctagttttactgcatggtacaatgggatttgtaaaagaagatcatgtagtaactgcttgatattgtaacctgtgatattatatgaactgtatttattcttacatacggacatcatattaaatatatagcctacatatgtaaataccatattaaatatgtaacctatttatgaggttaatgtcaaaatattagttttctttcaaattatctcagcatagatattaagattatattactaactttttagtctttttaatccaatttgaacagtatcgaatagttttttgtgtgacagaaaataaattattttatttttgaatcaactctatgattttaagaaatattgatcgggttatttcccaaagctgaaaatttaggacagacagagacgttttatataattggatctcctgcacagtagaaggagtgaaataggcaagatggtttaataaaaatatcatttgacttttcacaacagtgaagtgattcattgatctccacttgggttgtcagagctcaggagacgaagtttatcagaagtgaaagttgatgaatattggctgtttatggctttataaaataatattggctgtttatggccttataaaatattaatattaagtaaaggaatgttttaactaatgaaatttactataagcctagacttagataccacaatgacaacttggagaagaaattaacatttgcaatgatattagaagactataagaaaaggactaaagataagagtttggcttgaagacgcgtatttgttcatgctttaacttatttaacattcaaatattttaattgaacacctacattacgaaagacaaatattaagttcttggtttagagaaataaagaaacatggctcatgtacttaaggagcttgcaattgaggagtcccaatactttaatttttgtttcaagaagcatgtaacctggtcacagaaatagacgagtaaatggataatttagagtgtgataaatgttaggtatatagatagtagatgatacagaaacatgagatggagcatttaaaaaaaactggaataggcactaaaatacgaggagtgataaaggctaaaatttcaaagcttaatagaagttgagccagatactgaagggatgggctactgcacatgattaatgattaatgcagttgagaagaaacatagtattgtagattctagggacttcaagttttttatgacttagtatataatgcaagaataaagtgattggagatgaggctggagagtgagagatgattgagatactaaaggaggcatttgattataatctttgtgatctattgaaaaatctttaatgattgacattcaaatgtatgtttgaaaagattcctctgagttttagtagagtgggttactttatcctaggctgactgaacttaataatcaaatggaagttttatagatttcgccagggtgtgcagaggatgtaaagtaccacagaccaacagatggaaaagtgtaaagttacgttgctttatttgttttttaattactccggatatattattgacgtggcagtgctcactaagagacaaagggaggtagaaaaacaataatggacagggatatatataagctgggaaatgttttggtggtagcacagagttccgtaaattagcaccaggttggtactgtcacataatttgttggtaggagcacaacagagcagcttgtaagaacagatgagccagggcacaaataaagcaatgaacattaatcagcaaaacttaatttagcattggacatctagatggcactcagtgatgctgatcattattaccatactgccatgcacagagggactcaaaaaatattagttgatggtaattataaactcaatgagaaacatgactagcattccccacccccatttaggctatcctttccagaaaacattttcatgtttatgaccactagtaaaagacaccttgtggagaaatactttgaccattatctaggcctaaagatactcttaattttatgtgtttctttataaaacacagacaaatttattcatacactgtattctatttccagtaaaatgttttatctatttatgttcctgatgactcaatatttagtttggttttatttgagtcagaggtttaagtatgtaatccattaaacttaaagacaaatattactaaatatgactgggatgttcaatgtagcagtaatctcacccaaggtgaatcttattggctattatattgccaatttcacttgaagtagttgatctcacattaatgagtcttttttggtactagaagtatcagtgttctggcttgactgtttaaaagcttgtctgcatgtttcttaattttgtcccaaagacagaaaaattatgaatataaattttaatatatattgctgagcatgagaaggggtaaagtgggggtggggacacagaacttaaaataactaattcaaatatgatgtactcatacctaataaagtccaaatgataataagaaataatgctattgcacatgtaggtccagctattatttggaacagtttatcatttactatacagagagggaatcaaacagaggctgatttcatttattaattttttaaaataataaatgtatggatatatgattaatgctctctcatcttcctttttatcatgcttagaatatcttaccagagaataaaagacattgcttgagatcctctgctatggttctttattcctgcctagttctcttctgcattacccaattttcctcaaatatatccactttaagcacttaaatttcaagcatagaatgaaaaggtaacacaatatcaaaatgttatgttttaacacacgaatatggtctactatataagcattttacttctgatgaaatacagtataacgcaatgcaacacaaacacaataaaataatgtatgatattgcataagcaataaagatcactcctacctgggcgtttaaaattactgttctctagaatttgtctggtctctatgccatcatcattctagatggcaacatcttttatttcaagcttagcatggagaaaggaataggtaagaaaggaaaggggtttaaattctgtttattcataagctgccacataatactttgctttatatttcactgactgtaacttagttagattgctacatctagctgcaagagattctggaaatatagtctttattctggaagtcacctgcccacataaaattatgggataggagaacagatactgggaaatcattaacagtctctgccatactggggaccttggggacattacgttgtgtcctttctctactttgatgtttgtttgctagctttcaagcaacagaattacaaaactctttttccatacactttctccaaattctactataaatatcttctatgacaataaaaaacttctgataaataaatttatcatggtaaacatatagactttaagtacataaatttatggtaaagagacccctccagtacttcttttcttaatgtcttatagtttcatcaagtattagaaggaccttttgtgatctctacttgaatgtttttctaatttcacttttataaaagaaacatccacatataatgtcagatttgctagatatatgaagttttctgaaatctcactgctctgaaagaaatgtttttctaaaaatcaaatgtacacattgggaaaatgttcaaatcaatgtactagttgttatgttcaaaattccattactgttaaagagatttgcaggcgtaacttgcacagcaagttactctgaaatttttcccagctgtgtccttgaaagatggatacttctttttttttttcgtttaagaaaatcattttatctgagcagttgcttttcaatttatccttttgtacgttgatgacatttattctacacaaaatgttggacttacatgtaaaggaaaaaataaggtatttgtccactgcatctgtatgagtcataaacaactcatcgacatgaactttagcaccttaacatagttctagtatggaacttctgcataattcatcataaaagaacataaggcattcagaagtcagtgttcattcaaagatgtgctgcagtattagcagcacaggaaatatgccttctctatacagaatttacacaaggtagctgataagttttatggttcataatggagttattttgatccctttttagttgtttgagaatatcttgaaagtaatacattaagataaattatattgaaatcaattttcttaacacattatatatttgtatacatttccttggaaggttagttaatagcaattttattcaaatttctttaaaatattgtttgaaaaataggtaataaattaacattcaaagaacaaaatggtagaaaggtatacaccctttaaatattgtgaacatgatttttattgctacatgataagaaatagaaaactgatttatatcacgcatgagtcctactgttagtattttatagtattagagttaatgccttggccattttctttagttcaactctcgctaaggcaggagacgaagtccctatcaggattacctgcaggaacatttgcaaaacactcctgaacaccactatctaccaaaactgtgccttactgagccacagagtattatctttgattggactattttgtgtccttctgtttgggacataaatagggatggaaacccgttttctagacactctaacacacataaggtttccatttttaaaagtaattatcagttctttaaagcaaaaatatgtatatatttattgatcaacctaagtaaaagcaataatggtatgaataaaaactgttgatatacaacacaaaactttttttttttttttttttttttggagacagaatctcactctgtctccaggctggagtgcattcagtggcatgatctcggctcgctgcaacctgcacctcccgggttcaagcaactgtcttacctcagcctcccgagtagctgggactacaggcgtgtgccaccatgcccagctaatttttgtatttttaatagagatggggtttcaccatgttggccaggatggtctcaatctcttgacctcgtgatccacccacctcagcctcccaaagttctgggattacaggcgtgagccaccacgcctggccacaaaacttattttaatagatactgactttacactagtaataggataaggatttcaaccattgggaaaagagatgatctcattcttgtgtgtttgttagtagcattgtgctgtctttcatataaagcaggcttagagtgcttatgaattctgccctcaaagagcttacaatatttcatcaatttctttgactaagaacaatttatgaaggcagctcagctgagggtcgtccaacaggtagggaaatgagagcctctggcctgaagtggaatgtgagtggtacacaccaacagccactccttgttttgttttaagttagggattttatgtatggctaatctgagttttgtggaaatactaaatgaaaggaggaagaataatttattggggttagaaagatttttcaaatcactaggtcaaacttgaaacaaacaaacacgggaaatcctttacataactaagtgtagaagaaaagttacagtgcaatcagaaacccccttacttaagggagataggagagtttgtgacaaatgaacttaagcatttatagaaaatctgttaatagtgacacaatagtcccccttgagactctttgccgtgtgtacctacctatcttctccagtgttatttcttttggcataactcccagtttgtttgtttgttcatttgtttgtttgtttgtttgttttactactcaacatttactggaatcaacattaatttcacaaatttgagatatttctcatgctgtttttccacctcccctttctctgtttcaagtcctcccattcttaatgttccatttcaatccccattctctgccaagccttccctagttacctacacctccagttccctcccctcttgaaacacttccctacattgttttggcaatttacagcgtgagccactgcactactcctctctctctctctctctctctctctctgtctctgttattttatttatcctattaaagtttttgttcttttcatttttaccataaaggcataaataatgtactatatatatgtatatactatatacacacatacactgcctataaaatatgtactatatagcatccatatatatgtataatatattattaattatatgccaaaatatccctgtactttgatatttgcttttccccagttatcatgacaccttatgaaatttatggacaaatttagatataaatttagatttggacaaatttagtttattcactttaactgtatataccattttattatatattttaaaattttattttatttgctaatatctctgatgatagttctttgggttgtttctaatttctcattattacaacaaagctataacacacattcctggacattattgacaatatttattagagcttcctgataagacaatgagttccttaaaggaagaagtgctttttaaaatttcccacttgaaaactagcatacaactgactgcatcattgcaatactctgctgacagtttggatggagagcaatgaacctggatccagaagcaggagcctctgttctatatataaaaagaaactactgggcaggaagggattccaactatgattatttggtatcccatgctaacttctcataatacaggttctatcaactaagattgtgttgcattctcctttacttctgtaagactcaccctgatttattttatttcactgttgtatggcactttactgatatattcagaatgctgaagtcctttggaaataacaccatcttcacccatacaaaggtagctttatattcatttcccttctggtggttcatttatagaagcacatgatttattgccaccttaacaaattattctgagtgaagaaagtatctcttcattcaactgtgctttcttagaaacatttcttacagcatttaagtgggttggtgatgtggccatctctcattttgaccactgcacaactcctccttggtcttcctgctaaacgttatccatcctctaatcaattgccagtctgcagctgacaaaatgatccttttctccaattgctttgactgtaattcttttctcatttctttcctcccatagctgcataatctagtcattaggctggagaatatcagctctcatcccacagcttttcatcaaagagtgttagatttgttttctctgtccttacccataccctctttactgatattgcctggcagtcttaccacatccctttttacattcagcctacttgcctccttttctcttcagagcattctctgccttggcttacaagaactttgtcttctttcattacacttttaatagaaatttggtacgattttataatttataaaatgaacagagggaaatgggaaaaagaaataagaacataatgttatcaactcagtatatgtactatcgtagtgttagtatatttcttttcttccgcattatattaaaaaattcagtatcaagtttatatctaatttgtatcttttttctaagtactatattataaggattttataaatataaaacatttttgtatgaacagcaatttcccagaggaaaataacagtacatggtgatacactataaagtattccatttaatgatatagttaaaaataaaattaataatgtgactgaattattctggcaattaaaaagaattatcaattatcagcaatagatggagtcatccagagatgggaagatgaaatctttttaaataagacaatgtcatgagtagacatgctctgtataagaaacaaatgcataaagaatctggtaaaaagctagactggaggaaacagaatactcgtatacacataggaaggaagcagatattttatgttcaaagtcaagtctttagcaccaaggagtatttgttgttatataaccaaacctaaaattagcatttgaaagacttaacaaggaatattttctcatgtaaaatgttattcagttccaaattccttatgtattaagagatgcatcagcatatcaagagtggggtcatttcaagaaaggactgtggaaataacctttgttactcctaaagaaattgcaagttcctagatgattaataataattgtttatattactatagcaaaagtgttataaggtcacttttgtattaattatctccttttatgttctcaacagagttgtaaagtaggttttataatcatcctatttataaatggataaaccaaggtcggggaagttaagtgatttactgaagatggtgaagttagtaatgggtatacaaacctggactactgatttattctgtttttttgtttgttttttgtttttttctaaagtgctgctttttctaataattttagggaggtaggctttgggaagaatgtcagagaatgtaaagagctcaactttgaatttttaatattattcccttcttggttgtttgatatgtgtccagctatgtagaaagtatgttttctaagctttcgcaaagaaacgcttcagtgaatatgaaatgtcttctcagccttacagctattattctgatgtcctctggcaattacttttgtaaagaagacagaagccctttgcttcttttgaaaattatcaacctggatgcttctaagattttaaaatagattcttaaaatattaaacctttcgaactcctgcttaattgaggattcattaatgttgtctgtgaggtggtgagaatgtgtaatcctcatattaagtacatttttcatttcaaaatttatttttagttattacagccagaattatgcttgattttccctctaacattcccaaggtcaatcctcaactccaatctatcatatatgtcatcttctttcccagtgttttaattcagatgtcatagtatctccctatttcctgggagcttttcaatttcctctaattcctttatatgggttctaatatcagagatgctctttatttctaactcagattttagctattcaatcacatttttaatttccttgcatttcttttttacttcatacatttttatcatgtatttcttatttattatttttacttgattttttcatttctctcctcctatttcattgagtccacctatcttgtatcttattgagtatatgactaagaaaatgtcctgtgtagggtaattagtatgtatggcaaagccctatctatgtttttgttttgtttactcatccacgaatgaggaaattttatccaatgtttgtgttttccaacagagtgctcagatcacatttgattccactttctggcagcatgaatgttgaataaatgcccctcatatgcaaatgaaagggaggaaaatgtgcatatttcctgaaccagttcctggtgtctaaatggcatgcaactactatagacctgttagaatacgatgcagttttctattctcaccatcttttggcctgatagtctgaatagaggaagtacatagaagagagtaatacctaatttttacaagggcaatgcctgtattaattgtgtctattttactttaaagtgttcaaatttccttcctgacactgcaagcaagtgccaattctccatataacaaggtgtataatgtacctagagtatatgtgctctaggtaagataaacatacaagttattgtccataaaaggaaaaattgagaatgaaagagctctctattaatagttatgtcagggccccagaacatactaggattgtccctggcaaactgggaagtatgctcacctaaattctaaaactgttcagatggataaagaagaggttcttagatctaaaaattcgttggctaaagaataatattctgctccttgaaaacatagccactatgtggtagaaggatggacactaagttttcaagtgagtggcacatgccttgcacatttggagcaaccaagagactcctgtacacattttagttttgtgatgctggaattttgctcttgcaattgcataggaagggaaaataaataattctttacgtcagtttagttatgttggtcttgtagttcagatatattttcctgaaatgcttctgatatgttgatgagtcccattgtccaattttatcatgagctttcattttttttctgtctccataattatattgttgaatagcaggagaaagtaaatcaggccatgctagcaatatgtcatttgaatttctgtttctatttcattcaacttgataatatatgttcttaatcatgtgctgaaatctacttcacattaactctttatgtattgtgtttaataaatatatgttcagtttttgccatcactttttgtcatagattagcagctcccacagggtatgaaacaacaaattgactcaataaaaatttatgttgattatctactattgtaccatattttttaacttacttgaaatatattcaatacactttacccaaatgaatagatgtcaaatattttactgctagtaacaaagtatgtaccataaagtgaaacattcctaattgtcttatttagttttattagtgaccaccttaaagttcactctagtgatttaaatatattaccgggtttaccatgatgcacacctaacctcttaatggctgactgtgtcaatattgggcataagccagaaggatactgctcccaatgtacaaataagccggcggctgcttcgaaggcatgtaatgaaatgataaagtgtgcttaagcagaagagatttcaaaatgtaaaattgtgttttcaccctcatgatctagttttaagtaatatattacttctctattatatgcaaccttggctattttattgataagaagaaattaaatttgcagagtagtcacttactagtgcaaatttaatacatgaagttttcttctcactaaatttcttgtggctggttggattatcgtgatcttttattctatcacccaatatccagtctgctgtgcagtagatgtcagtcatgagagtgctgccacctccaaccacgaccttctggcacttccacatcccaaaatgctaaatgtggcattacagaaacaatttaaattttcagatccaaaattccatatgcaccaaaaaaacaaagggtctggccacattaaaaagtgggttacagaaggacaatatgatgcacatacctccatctctattccagaagtgctcatcagaaataaaattataaaagatgctggtagagctacctgtttaataagtgattgaaaccgactgtaatttagcatcttaaacttacgtatgtatctaaccttttgcatctgttgtacaacagatttattaaaatctatacaacaaagatagtaaattatcatatctgttttgttgattataactgattattgttcagacgataatgtatctttttaagttcttctttcttacatagattagcttcaatggtaattatttgatggtctcatattaattcctttaccataagttcattaacaaatggttttcaggttacatggatatttatttaaaatatattttactggccgggcgcagtggctcacgcctgtaatcccagcactttgagaggcagaggcaggcgttttgcctgagctcaggagttcattaccagcctgggcaacacagtgaaaccccatctctactaaaatagaaaaattagccgggtctggtggtgggcacctgcagtcccagctacttgggaggctgaggcaggagaatcacgtgaacccaggaagcagaggttgcagtgatcccagatcgcaccattgcactccaaactgggctacagtgcgagactccatctcaaaataaataaataaataaataaataataaataaataaataaatttaaaatacttttttttttatctaactgggaaaaataatatgaacaaaacttcttggctaaattgataagtctacacaatagcaatcactgttaaaactctaacattcatagtaaaaaatcataatttacttcccagtttgaaaattatttttagatatctacatgctactgatggaatctgaatatatatatacacatatatagtataaatatacacatatacacacatatagtatatatacacatatatacacatatatacatatatagtatatatacacatatatacatatatagtatatatacacatatatacatatatagtatatatacacatatatacatatatagtatatatacacatatatacatatatagtatatatacacatatatacatatatagtatatatacacatatatacatatatagtatatatacacatatatacatatatagtatatatacacatatatacatatatagtatatatacacatatatacatatatagtatatatacacatatatacatatatagtatatatacacatatatacatatatagtatatatacacatatatacatatatagtatatatacacatatatacatatatgtatatatacacatatatacatatatagtatatatacacatatatacatatatagtatatatacacatatatacatatatagtatatatacacatatatacatatatagtatatatacacacatatacacatatatacatatatagtatatatacacatatatacatatatacatatatagtatatatacacgtatatacatatatacatatatagtatatatacacgtatatacatatatacatatatagtatatatatacacgtatatacatatatacatatatagtatatatatacacgtatatacatatatacatatatagtatatatacacgtatatacatatatacatatatagtatatatacacgtatatacatatatacatatatgtatatatacacgtatatacatatatgtatatatacacgtatatacatatatgtatatatacacgtatatacatatatacatatatagtatatacacatatatacatatatacatatatagtatatatatacacatatatacatatatacatatatagtatatatatacacatatatacatatatatgatttgttctatatattttgcataccaatttgatacttcacatattaaaaacttcctctacttcattttaacagatgacaatgcttggttttgcgtgattttgacctataagtagaaaatatagtattttgtgacatctacatttcagtgtcaagatatcaatgagaaaaaaagggaaaacaaagcagcaactaagttcatttagtgttttgatgctagaacataaaacagtgatggctcaaataaaaatatgtgttcaaatgcaatgtacttgcatgttgcaaatttatatatgattcaaaaaacaaacaaaaaaaacagcatttcttcagcctctttcaataagatatagaaatagcactggattgggaaacagaaaacctgattcctcagacaactctacgggtaactaactgtgctatggtggcagttgcttcaactttctaggcttcagtgttcttatctgaaagataataaagtaaaatattatagtcatcgatgtcatttctagaccaaaaccccaattctatgtgcttatttgagagggagtctaaaatttcaagaatcctcacatggctgtaaaaaccactaaaaatgaagcacaggtaatgacatatcaattttttgttgttgtttgagatagggcctcgctctgtcacctgggctggagtgcagcggcaccctcatggctcactgcagccttgacattatgggctcaagcaatcctgatccttccacctcagcctcccaagtagctgagactaaaggcatgcactaccaccactagctgttttattattattattatttgtagataaagtgtctcactacgttgctcaggctagtctgaaactcctgggctcaagtgatcctcccatctctgccttccaaagtgccaaatatccaaatgcaatgatgttatatgatagggagattaaatatgaagattgctttttgattttgattctagaaatatgtgagaattttgtctagatgaaagcagcaagtgtatagcagataataggaaacatcaagccatggcactgtaattgtctgggctatcccttcaaatttgttaactaacttcctttctcgttcatgcacctatttaaggccacaaaaggagttttctggtcttaaattactttctacttctctaaatccagacatgattttccatatactttgataattttcaaagggcagatatacaatagtcttaactttttaagttagcaatgtaataaattagtgtctggacttcgtcgtctgtgatacatgtcatgatacatgtcacttatcctgtgtctcatgataggtgtaatttaaactgtgcccctcgttggctctggcaactcctttctcatatggattaagacagtcctcttatttttaagaattagaaaacaataactcttccaacaaatttatgtgagccctgaaagtaagcactttatcaatctaaattagaccataagtgttgtgtttagtgaagcataggttacagttcattgggtcagtaacattaaataattatcatattagaataacaggatttcctgaacttcttaaacccattggtcaattcacaaatcaatccatatctttctttagggaaattaaatacaaattaatgttcctatggttgcattaatgtaatgcttatttactattttaagttgaataaactgaaaagtttctcaagagtctagaattcagtatttttctactatttgcatggggaaaacaaagcttgcttataaagtatcataagttatttgagcaaaatatatatctccctgatattattcgtactatacttaatattttgaaattagttttagcttttgaatctagacttacatattacatgcttttaaacagatactaaacatttgacggaaatactagaaaaatgtatccatagaagccgctaggtaggaatgaacaaaggaatttctaaaagggtctaaaaagggtctctctttgcaggtaaataatcaaaaagaaatggagaacaggtcagacatttatgacacattgatagaattatttctgaaaaggatttttctttccaaaatgaaatatgtttttcttcaagttccatctctctagatggccgatctataatgagctgaagaagggattttgctctttcccaaaagtgttttctgaatgatcagaaagaactagttccatttctttccaagttgagccagaatgtcacaaatcaagaaaggtgaagtttttcagcaaaagggatagtaaatgcactgaactttcacaagctgctgtagtattgtattttttctttctttcttttttttttttttttttttggtacgtgtataaaatgtattgataaaagaatctgtgcacctctgacactattggaagcaaatgaaaatatcgtggggagaaaataaagttgaggttagcaagatcagtcctaaccatagcatttatgaaacataaaacaagttggaccagctttaaaactgtgcaggataagacactcacatgcatccaactggaaaaagataattttcataatattaactggtcattaactgacttttttctttttactaaaactaactcttcctagttacgtttagctttggaatttctgcattcgaatattggaattttctttgacttacttagatctgttcttatgtgtatgtatgcagaaaacgtgtgcattgtcattttatctgtgtgtatgtgtccatctaagtagaatttatggaatatctaagttcttgaatataagccttgaattaagatacagacaaattctcagaaacaaacaaaaatgtatatatttctaactcaatttcacttcttttggcactggtgatcaataaaaagtatagagttgattatagaatttcaaagtgttaattaataattagtaataagcagggaatgttaacctccctctttttcagcagccaggaaactggcattcagagattaaccaagaagttcagtttagaggaggaggatattttgcaaaccttaaaatacaaaatgccactgacagtcaagaagcatctatctctatttaactcccatcacagtctagaacagaagctatgttttcttttttttttttccctcacagctgctgagagcagccttaggtgtacagtaactcagatctcctttttgtctgctttcatttccagtttttttttttttcttttcctcatccattttcattcttttttttgattctagctaaaaatgtgatcattttgctgtatgattccctgtgataaatatattagttaggtaaagctagctcctataacagatagatcccagttgcataattgattaagcagctgagatacacatattttttcttgttcgcatattgatcccaagagtgggcctcttccccaaagaaattcaggaaaacaggctgacaaacaagagccttgtcatcttcttaaaacacaaaacaaaataaaaaagacctgtcaaaatgtcatagtcagccagaagaagaagaaaacatagcagagtggtgtgaaactttttaatggctcaaccccaggaaataaacagccccttttccttacgttcctttgtcatttagccacacagtcacacttaatggaagagtaagatgggcaatgcagaccagctgtaaagataggtactggaggaaaagtgttttcatagctagcagtctctgcacaaggaacttaacattaaatgctactcttagtccatttaaccctgtcacaaaaacatctatatccccaaatctgtattttcagatgacagaaatggccaacataaaaagtctttcacttatttgtataatcaatataccaatttttaaactttgtcaaataagcatttgtatgattacttgtttaggagttcattagttggattatcacttttccatacaatggtattgctttcaggcacatttacatctgaaataatcaacaacataggatatctttcagagaaagactagagattgatgcttattggtttaatgtccttgatttctcatactttaagttccgtgagtgctggggttcgtgccaatcttgatcattcctgatcctcagtattaaaaatgatgcagttttcatggaaagtattactaaataaatatgtacaagtgtgtggtgaatgaatacagaaatactagaaattgatgtaattttatcttaatagacaaaattttaatatcgatagactatttccttttcaaagggacatattttacctatccaggaaagcataatcttgtttttggaggctgatactttttgctttgaaagttgtatttgaaaaattgttttcattaaccttggcacgtagcttttgtacttttcattagatcctttatctacatttttaaagcctcatacctctatttcctcttcatttttttttaactaaagaacaggaatattgtgtttctaactgaaaataactaaaaggaatctaagaacaaatacggtaaatgtctctcaacaaacagttgtacagtctcctggtttagatggacaggagaaaataatattcggatgatttccacatgcatatcggtgttcttaaatttaatgttgatagcctacagatattttatgcagtattatttatggtagaatttcttaacataagaaaaaggcaattaatcacagaaaggcaataattttcagcagtttaaagaggaagattctgtagtcaccatatgccaagcagaatgcacaaggaaatgttttaatatgtagatagtccagaagtggttttcatctgtaaaaattatgatgcatcttatttaatgctaaattttattaccttttttgcaaaaatattatcctcatgaaacatttttattagtctcttgcaaccagaaatattgctactgtttatcttccctagttttttttttaatcctaagaatagctctggaattagaaaaattgtggttttctttaaaacttcaattttaatctttattttactgaaagattatgaagtctgctctcataataggtcacctaaattaagttagacataacattatgggccacaattattttgaataattttggtagttattgttaggattgggaagcctatgaaaacactcggaaagtagcagagtggtagagttgaattatatttcaacaccgatagaaccactaggttcagtgtaattaaattttcatgatacacatgtatatagttaaatcattgctagtcagttaaatctagaaaatacacatacatgcacacacataatttcagatagatatatatgtgtacttacatatgcacacacacacacccttatataatcatgaagataagccctttactatagcacttttatcatgtgattttcataaacctacatcaaaaataaggagtgaacaaaattcaacattagaaataaatggaatatttaacatacttaaggtgaccatactgagcatctgtgtagagcagtaaggatttttagtatctaatgcaagttaaaacccaaatttctaaagcatactcaataggtttgtctcatgacatttacaattctttcaaatctttaaatgggagtccatttacatttctgcaaaacaatttaatttatcctactttcaaagctttgtgccctattatagtataataatattactactgatatcatcagttgtattaatgcaggaattaatactataatcactatattggtgattggttcaggtcttaaagacatagttcaacaaatttgcatagcattcaacagattgtgatgactatattgtagctttataaacttgaaaatcaaaatccactcggaatgatttattaagataatcgtttgtactcagaattttataaactgctttttaaaaatttgcctatgctgaattttcttgtttttcttaggaattttgcttcctccaaattcagctctataaaatagatttggtgctatactaagtgcatttctgttttacaagattactagaggttgatcttccattatttcagttatatacaatctgatacaataaacttactgatatgaaaaaggaattatactctcatttatgagaaaactatgctccaacccagagattctattcagataaatccactcatgtccacatgttattaggtactaaattacctttaaaataattcagtaatttgaaaagtagaagatttttattaaaggatttttagagcaaaagaagaaacataattttagtacaggcaactatttctaacacgaattcattgatctagaaaattactttaatgcacatatcaatatacaagccagttgcttttatttcagcaattaaaaatatctgtgaatttctcttgggggttataatgagaatatataagaaattttcatagtaaaaccataattatactttcattattgttatactagtaaaatgaagttttaattaataaaatgttgaaaacagggaaaacaaatcactcattctaggcttattatagtcttcattgagaaaaatacatctttaagtttttttaaatgataaaacagacttagtagccaaatagtttaagaattgaaaattaaaacattgtaaatcttaaggaaaatatgacacacaaactctcttacacacacacacacacacacacacacacagagtgaaagagagagaaagataatgttatttttatgtctccaatttgtgaatactactgaagtcaaatcaccattttcatttttaatattatttaaaaacccatacctgtcatgtctggcataggaacttaataacttattatttgaatgaacagttgaatagaacatcatttaatgtaagatctagtttgaaattcccatcttgccattctctagctgtttacttttagatgtattacttatctttatttatgttgttgacaataacatacaccttgaaattatttctgctctttaattgtgagagaatatatttttgtgcaccacagaaatgtaatatttcaatataagtgttaaggcatttttgataaaatattagatttctaatgccttacataagtaaatactcagtgctaattgtttttacttcccaatcctggtgattatatatattttttgtaaatattaccaagtcaaaagagaaaaatgaatcccagttacctctaggtatatggtatttgcaaaacagaatagatgtctgacacgcctgaaagttctgctaaataatatgacttaatttgatatggtctttgaatcacaatttaatgcattcctgtgtatttgttcccctagtataaatcaggttatacattatttattcatgtttccttttaaaccgtttcaaattcattgcttgttatatttccagaatgtacataaatatgcatagtatttctttctcttactttcatctacttatgcaaatttttcattttgtatttcagcattatcattttcataaataaattttttatgacattctcatggtattctaatatatctacttgtacagaaaacatttgctatggtttttaaaaaattattattattattattattattattttgaggtggaatctcactctgttgcccaggctggagtgtcgtggcgtgatctcagctcactgcagcctccgcctcccgggttcaagcaattctcttgcctcagcctctggagtagctggaactacaggcacatgccaccatgcctggctaatttttttgttttagtagagatggggtttctactcatttgccaggctggtctccaactcctaacttcaggtgatcagcccgccttgggctcccaaagtgctgggattaaagcatgagccactgcacctggcctgctatattttaaactcaggttttcatggttggttcttctgctctcatgttttcctatattcctctactattctttttacctcttactctttctcatttcaatacacctgatttaaagtaaaattcggtttatgaagagatcttccacactggcattatttaatagaagcatgtaaactcagtcttcaataagtactttctctcaaattgtctaacatgtaggcaaaccaatttaaagaaaagctttttatgtgttccagtatagagcagtgataaaagccggtctgtaccatcagaaataatgaacaattttcgtgaagcaaactctaatgtcaaagtggatgaactcacagatattacccttatctcattttaatatgcataggtatacaaaatatgcatacgtaggtgttatattgtcttcaacacctcgaccagtgaacagtacaatcatccattatgacttctgtgtgagggcaaagagaggcgacctaggatattcatatgggctgagcctaatttggctcctgccctaaataatggtagcatgaggaaaacatttggaaatgtttagggggaataaagataaaagcaacattattagtctgtttatattattttggtgttcaaaaaattcgcctgttgaaaagcattatttacaaatgatgccattgtgtttcctgtttctcaggaagataaagaagaatccatatgtgtatatgtggatatacacacacatatacacaattttaaataaaaatgctcattttaaaaaattattctgaatataacttacatggtttggctccgtgtccccacccaaatttcaccttgaattgtaatccccataatccccgcatgtcaggggaaggaccacatggaggtaattgaatcatcatgggagcagtttctcccgtgatgttctcgtgataatgcacgagatctgatggatttataaacatttggcatttcccctgcttgcactcactccatcctgccactctgtgaagaaggtttctcctttgccttccaccatgattgtaagtttcctgaggcctctcaaccatgcagaactgtgagtcaattaaacctctttcctttataaatctcccagtcttgggtatttcttcatagaaatgtgagaatggaataacacaataatcaacttatcttttatgtatatgaggtcacacacctcctcctgttactttgctaacttgtcaccctctcacttagcctcactctccctttctcctaacactgctttagtttccttttacttctctattatctcctctgaccaaaaaatctttgcataaattttaaagacacactcttcatacactttatcttcattgtgcaacacacaaagatctattggacttcagcaataaacaaagaaatccatcctgccaaatgtaagtgacagcatatgctttcttttaagacaaggagacttaggacttgattagatttaattgatgttaaatctaggggtgaaattttgctttaagccattgtccaaatacaagagagtactttacagtataatacttaaggataattctaagtattttagggccatgagtctctatggggcatatttttggtcaaaggagaacttgcattctcctgagttaatgatttttttttttaatcaatgcaatgactgttgcagtcagtagtcaataaaataaagtttatttttacacaactttatatttgtaaagctactctttaaaacaatcttaccatgcctaaagcctctgcagttttgcgctgagcatcttttattatttcttattttattattctgttctcatgctgctaataaacacatgcatgagactatgtcatttataaaggaaagaggtttaattgactcacagttcagcatggtcgggaggcctcaggaaacttactatcatgccagaatgggaagaaaacacatccttcttcacatagcaacaacaaggagaagtgcagagtgaagagaggaatgccccttacaaaaccatcagatcttgtgagaactcactatcatgtgggcagcatgggggtaaccaaccccatgattaaactacctcccaccaggttcatcccacaatacgtggggattatgggaactacaattcaagatgagatttgggtggggacacaaccaagccatatcacctatattttaaacatttacagatactatattcccatcatatgtgtatcacaaatcaggatgggaactgcatatttgctaagattattattcaatgaaaaactgagtttttatttgtttatgtttttattaggtgcctttatctacttagttattttaaatacgaaaggagctaggtaggtagtacaacaggcaggctcacaatgattgaactggtgaagatatagatacgaaggactaagtaacatctagtggtccaattggagttgatcaatatgataaagaaaaaataaatatttcttaagcttccataacacttaagtaatgaataataatttcagaataaagaccacaattatttaagtgaaatctgaaatgcgagttaaagtgtacacttgtttaactctcataatagtttttatttttattttcatttgctttgttaatgctgccatcagaaaaataagggtgtgactagtaggccgacatgtacattcaaaaagggctgtgcgtactggacaggcaatgatactactgaccttaaaatagtgtacttattcagagatgcttttcctgaagtgagaaaacactggagctagttcttcccactcttgtcctcaatctttctgttgaatcaaagcaaacattcatgaaataattgtctatagaacagagaaaagtctactgggtcacaatgaactttatacaacaccattgatactaacttatatgtcataaacaataaaacaagaaaaagatttaaaccctcttaaataccttttcttaaatcctcttatggacaaatttcttgaaaactgttggttacgcttagtatcttcatttgatcacttcccaaaacattgccttctgctttctcttttcattttttcagttagcaaagtccctcaggcatatgttgatcagtcctcctggatatgcttctgatcttttataaaccttattttcctgcaacatttgagctgtgaaaataatcttaatttttttcttgcctttagatatgtgattccctctaataatcaactacttcagtgtccttctccaatagctgctattttgatcatgtatccctgtatctgttccctcaggtagtctctttccatacagactttgggcttaaccttgtgacttgtttcggccaatgagacaataacaaacataaagcaagagggaattggaaagtgcttgttccttggaccatgctcttgggacccaggagccatgaaatcaagcctagtcaccacctgtcaccccagctgacggccagcctatccccagaagccaagtccccaaaagcagatggctggcaactaactgtagatgcattaagaagcacagccaagatcacaagaactggccaatgaagcccagtttaaattgctacctatgaacttttccttttgtgtcggtacttgcaactaattaagatggcatccccatctattctatcacgtagctggaaaaccaaggtcatgctcaatggtttcctttccattctgtccttcatgtaattggcctttaagtcttactgctatttttaaacttgaaattgttttagtactgaactattttatgaacttagcatatatttgtcattatctgatatgaatttaggtactctctttccttcctttaggttctatattctactttctctttcataacaccctatttctgattgtctacatggtgcaagttatgcaccaggccatgaacacaatggagagtctatttcaaatactttattttatttgttacctaaagtcttctgaaagcctttcatagtccttcttctaagagagaatgtagaaaatgagaaaatagtctatttttgagggatttttaattataaaaattaaatcaggaattatatctgtggttgtttaactgagatgtaaaacctccatcatcttgattctttgtttaaccaaagactgtttgcacagcttgcaaataatacttctgtaggaaattaaatctttataatgcctctgtctcagggccatgttttgccagtgttttggagaccagactttctattttctttcacaaagctaagtaatacccacagaatccttgaagaaatttaaaattaacaattagaatacaagaaagaaaaactgtaaaatgtttggcattggaaatttatgtgagtgagtgtcttttctaaacacacctactgtaaatgttatgcacaggaagcattttgaaatactgccaacattttttagccacttatgctttgctactttgctcaaaacgacatgccctttccaaagtaatcatggaaacaaatgaaaacatggcttttgcccagcagccacttagtgtagcttttggagttgattgagtatataatagaacattcttaatgctgactttattaaaacaacttctatcaattattatactatgttatttgtgcttatgcactttgctatttcttttcatttgaatttaatgtggtttactcataggaggtgttcaataaataatgttagaataaatggaaattaacaaacattatatgatctctgttcattttttctgtaactttttaactcttttgtaaacaggaaatatatctactctgctataatgaatgaaggaaatatatagtttcagaggctaagaaatacactccatttcttgccgagtgagatggctcatgcctataatctcagcactttgggaggctgaggcgggcggatcacgaggtcaggagatcgagaccatcctggctaacacagtgaaaccccatctctactaaaaatacaaaaattagcctgtagtcccagctactttggaggctgaggcaggagaatcgcttgaacccaggaggtggaggtttcagtgagccaagatcgtgccactgtactccagcctgggcgacagaatgagactcagtctcaaaaaaaaaaaagaaaaaaaaaagaaaaaagaaatatactccatttctttcgaatctttctttctctccttaaattaatgtattgcttagaggagaaaacttgcttagaaacaatacagaactttagaatactgaatttggatacaggtaataaaaccaagtcttagaaaagtgatagccactcccctgtgtcaacgtaatcgagggtagggagattaaagaagagagaaggaacagctacatttaatttaatcatattgcattcttccaaaagtacatttaaaactcaactcagcaaaaatgagattcagtaaacagtgcaaaacttaagttttaagttatttttgtcttagaaatttttatcaaaacagggcccaatattagtacataaacaaaatgtaaatttactctggtaatatgccagttgatgattaggtagtttttctattcatataagaagataagtaagaaataaccagttttcttacttcatatattcagacacttttttgtttttatcttgaaacaaccagcataaccaaggattagatttatatacttaagataaaactcttatgtaagaacagcagagtttataagatttggttaaatgaagtagcaaatgcacaaaaataagccattaaaatagcttaacagtcaactcaaaccactgatgagcactatttacagataagtgtatgccttacttctcaccaacacttctgcttcttatttggcatatgtccaagtttctgctgtggtaacatttgctcctgggaggagatgaaggaaaaagggtccataaggttcccattggtccagacagtagaaacatctgctggattcatcagcagcttgctggcccaagtcagtagggagagttgacgcttatcaaccctgccatatgagtccatatttcctgtgtcctggagctacacaagctaattcaagaaaaaaacgaaagaagtgcattacatgccaaaatttcctcattacataagcattatatatttttaagtagctatcatggtattataaattatgagtttggtactgatgaaattcaaactgtaacaaacagcagagtttactggattatcttatcattaattaggtcgttttgattaatgatggattctaagcatttagaactttgcttagagatatttgaccctcaaacttgagaagttggttattgtttctctttggtgagaaaacatttgtcagaaaaatatgcaccacttttttttaaagtacgatcatctttgtaggtcactttaagattagctggtcaatgactttaacaatgggacttgaaattacagcctcaaatgtgagcttaataaattgttactaaatataactattgatctctctctcacacacacacacatgcgtgcatgcacgctatctcacacacactgcacgcacacacatttgtcatttcaaaagtaatagttgtattcaaaagtgtatctttattcccatcttgctcccaataaccagaacacttggaatttcctgcagttgtcctctgtatctttggctaattctattcaatgcccttaatttgaaaaatctgtagcttccgatgatttatttattaaagtttttagtaacaactaagtcactggaagaaaatatggatcaatttttaaaattataaacaagggattgctatgaagcaataaggctaattttttattataacttctttgaaagaggaattttagtaatgacaatgcagttgaaattttttaatggactgattttagaaatacaacactcagtttatatctaaatttgagtaataagaatcaggtattattaatatgacagtgtagctgagaagaaagaaagagatctaaatatatttatctatctatctatctatctatctatctatctatctatctatctatctaacacgtttggtttcacatctgttaaagcatatgagactagcacattgaaatgaaaatctattgttgcacaaagtgtacacagaattcatgtcataacttatttagttctaatccgatatggatttttgcatctatgttcatcagagatattagcctgtagtttttgcctttgtgtgtgtgtttctgcctggttttggtatcagggtaatactggtctcataggatgagtttggaagtattccctcctccttgatttttttgaaacagtttaaatagaattggcattagttctttaaatatttgtagaatttgacagtgaagccgtcaggctctgggtttttcttctacaggagactttttattgaggcttctatcttgttactttttattaatcttttcagattttgtatttcttcatgattcaatcttggtaggttgtaggtgtctaggaatctgtccatttcttctgcgttttccaatttattggcatatagttaacataataaactctaatgattctttgaatttctgtagtattagttgtaatgtatcatttttcatctctgatttcatttacttgggtcttttttctgttttcctcaatctggctaaaggttggtcaattttatcttttcaaaaatccaactttacattttgttcatcttttatattttttagtgtcagattcatttatttctgctccgatctttattatttcttttatgcactaattttgggttcagtttgtacttgcttttctacttctttaggaaataagacaaataagtacaattttaagcatgaatactgagactaatctgttattggaattattagaatagcctgaacctcagcagatatactaagcagaaatttgattttgtgttaatctgaatattgtagttgcggtgcccactttgctagcatagtagcacaattctaggtttcatggatacaataatatccatgaaacacaccaagctttatccaataccaagtttacctgaaagtcatataagacaggtgatacaacagaatgtcaccagctagcagaggccctgggactccttgaaatgcttctgaatgtgcataatagccatttgtactaaagattagactgagttagcatgagcaacctcagctcagggaagcttccatctttggagtctatttaagcatttttgtcttgctagtgacaccggctattcgaaattcttccatcagcttccattttcttgtacaactaaatctaatcaatactgataatttattatgcaataaacaatctcaacaatagcctgcaggcacttagcctagtacatagcaacttcctcagttctcatttattttggatccagtacaaatctatgaatgatttgaattgcaaagatgattcaaccaagaggaaactgctcaggagttccggatactagaggaaaggtcaatgattcgttattagccctttcctcccaatatgatagtgaagtgaccattggctttgctgtgaatgtattttttccaggtatcattttgcaactattctccagaatctgcattcataaatttaaataattaaagatttttacactttcaccttaatttttattgaagtttaataatttaaattaaaaacacttcattataattttctaatgaacagattaaaaatgtagtaatcccaaaaaaggatacaaaaaaagtattaattctcagtttgctttatcagaagtataatttctttagcaaatttatctgtagaaatctatacaaagtaccaagtttcattttaatatgttcccacaacagtttccactaaactctcatagggtaatgttcccctagatctaatgtggcactacaaagggcttgaacatcaaagcatgcaaacatggacaagatgggtgaaatcaacattaatgaaatctttgtgcattcaaaaatgatcaaacagtggaaaatacatccttttaaccactgtgttattttacattgtttttaaaaaagatagtttgttcgttagggaatattccaagtttatttctatgttactacatattgatcaacacttaaataattaaggtactatcatttgaacacaatgtttatgtgttcaaaaatatgtgcccaccatgtctaaggcagtatcttatgtctgtcagagaatgaaatattatgtatatgtatacctctgctatcaagagctttatacgtctcacattcatatatcaatggttaccttggcgataaaaactctggttttggaaaagaaaattatttctatgatattagtcaaaggagaagttgtatttataaagtttatatttcacaggggaaaaacttaaattttgtgttactgcatttttgtagtctgctgggaacttgttcatttgaaagcatagtattgttattcactcaaagaaatatatatttgaaaaagaaaactgttttaaatataatatttacacccataggtggattaccagaaatattttcttttctcccaaaaaaatattgcagtttataagccagcaataaaataaatgaccagcatcattaataacaaggaacttaccaagccaatgccattttagagtggaagtaaaggacacatttttcatcaaagagtgaggaggatgtgagcatatagataacaatcctgttttatacaaactcaagctagtaaaagatgggtctccatttaataggaagtattttgcagtgtaaaaattaaaatcacgaaattgttacctctgtaaatcaattatcccaggatttaatggattctttaatattttctcaatgaggtacttgattgtaaacacaatttttacaatgattcatcttcaaggttaaaaatgcttgacttagggatcatgattaagtcattccttggtgttggacaaggggtattggttccagaaccctgactataccaaaatccaggcatactcaagtcccacagttggctccgtgaaacctgcttatattaaaagttggccttccatatatgtgggtttctcatcctgcaagtaccatatgttcagcctgtatttgtttgaaacatatgcctatataaatgatcctgcacagttcaaacccatcttgttcaagggtcagcaaattagaaaacagcattttctgataatgtaaatgagtcatatcacttctttcaatgtcttgccgttgtgtgtagaataagtgtaagctccttattataacctaacaagtcctgcatgatctggccttgaacttcttttctgcctcatcttgggctataccattgttgtctgttgtgtgccagtcctattgatatttttcagttctttcaacagctaacctatttcctgcctctagctcaggacttttgcattagctgatttactttttggaatactggccctggtgtctaacattcttgacctcaggctatttttaaatggctgactgtttctcgccatttaactaagtctttatttatgtgtgcttttttgttttactttccttaggctgttagttctggtgggcaagaatcatttctagctgttcacagttgttttcccaacacatactatgggaatcctgttctggtataaaacatacatttgttgaataaactaatgtcattgaggtatattttatcagtaaaatccactaaaaatgtaaaagcaatttcaggaaacattgttatatttatagttcatatcaataatataaactgaaattatacactattaagtgacatatgcatatgttggatatcactttctcttacacatattttatatctatgccattttgaaatttcttattacattccgtaatttaacgagttagaatccaaacatctatgtagctattttacataaataactttatttagtgcaccaatgcaattattttaattttttacagagaagaatacagaaaaagaatattaatgtagaagcaatttagataataatcaatataattttatgcttccagagtatgcatataacaggtgcaatccaaaataaaaataacgtcaaaatatacatacagtaagtcaaataactagcaacaataagtcaggaaacaattgatttgagtttgaataatttttttttttcatttggaattaggaaaaaccagcatgaaaaccagactgaagtcctagtatcttctcaattcataactttccttataatctttatcgtatttggctagtcatattttctatattcacatatttgaaaaaattctgtatttgaaataaggtttttaatgatacttgcctttcatagatttttgtcatttcatttgcttctagaaatgttattaggaatttcaatttttattgaacttatgtaatttttaaaatatattataattcagtattattagtgactttctttactatatcaaccttctaagacctactggatgaaataaatatatacacacatcatttcccttttttgagcctcagattgaagtttttcccagggacttcaattttaaacagttatgtcccacccagtcaattgcctccagaaaattgattattgtatgctcagcactatattcctcaccctctctccagaagagtcctaccatctgtgtgttcctttgcaggatatttcctccagtttgacatctcaatttagaatttagtaacatgattgagcttcactatgaaccagactgtgattgtggtcataaatttcttttctctggaaggctgcctctcaaatgttcatcagttagcaagtaaagctagtcagttctagatcttactcattcaacctgaaaataatattctagaaagataaaataactttatgtatacataataattaccatgtaagcctgttttaaaatcacagaaatcattttaaaaccctcttattcttttatattgccttgagagacatacaattttcttttcattttgaaattctttcatttgctttggattctttcacattacaatatttgaagatacatttgtagaggaacaaaagtagcctggtgaatataaatgagaacaactcatcaagttcactttttccttgaaaaatcatgtgttcattgaataaactatggtttgaatttttgagaaaacactgaacattttatggagtgaattaaatatggataaattaataaaaacaaaatatattttaaagtcttcattacaaaaatctatttttgttatgaagccatatattcgtatttattctatttgactaattgcatggtgtgtaaacaagtttgtgttcattttgcattttggcagggtaataagcagaaaagctaagaatagaaagaattgactttgtacacatacaagtcaaaaaagtgttgagaactttaaaaatctgataatgttttaagacatgctaaagcaatgcagccactgggtaagaacataaagcatcctttaaataaagtttcctaggattttctaagtgctctctgaagtttgggatattgtaaattaagaaaaactttagtgatatggccgagtaaaacaaaactaatgggagaaattagaaaaatgtattttatatagaaataataactgtgctgggaatattaaagaaagctgagatatcacaatcatgcaaaacatttttgaaatggaggggaagacaatgatgttatgtttcacctacattacaaatttctccacagctggctttgatcctgataatcaagaatttattccaaatataagtcctgtcatagacacagcacatggtagctagttctggtataatgttatgtgttatctgggtcacctactcacaggtactgtataggtaaactggaaacaatccaggggttatcccataagttccctggtctgctatgagcagcctagaaaactattatcacattctggaaaaaagagaggtaaaatttctacaggagaattataattctctgggtcaggagctgtgggagccactgtaaatctgaaggagccttttgtcatggatcagaagccaacaaagaactagggccaagctttgggtacacaagagtttctgctcccagagttggtagcagaatgggctgctcacaatggccatagtgaacgctaggattcggtctacgggattgtaagggctgaagctgccaatctggcactgttacactctgatatcaggaggcgaaagcccttccaaccttttctggccttgcaagacccagctgccagccagctttgtttcttccctgccttggtctggcagttgcaatggaatacaggtctccaaagtacttcctgtctctgtggaaactggcaagcggcaccagactgatggccatgctccacagtggctgggcagaatggtggcacagaaggtggataccaggtgttgtactctaaaaggcaggctgaattcaaatggatgaggtagaatcaaagaaaaataaaatattatgtggttgcctaggacagcagacaacttaaagtctttcagacaaacctaaaagctgcaataaaatgatttttaaaaatgactacagaattctaagtatttgaaagaacagaggggcattccaaaagtggaaacattttgcacttagttatcagtcttagtttttcctctaatttcctatctcacatgatagagcattcattgcacttctctggagaattataagccggccttaatgacatttgtgcttttcagtccagtaggctttagaatgcaatatgtgcttcagtccacacaactactgagccacaactttcacattagaaggttatttgtttagaatgccttcagtaatttagtggaagtaatagcatgctatgtgtgcatttagatatatttttagactctaatttaggcaacaagaatgatcttgaactttctaagacacaggttctttgtataaataccccttaccagttgatggaacagatgacggagagaggggtggggagggagagagagagagagagagagaaagagagagagagagagagagagagagagaaaagaaagagagacagagagagagaaaacaaaaaaaaactgaaaatagttgaggggaaaaacttaaagaatagtaggctagcattgtacttcatttaaacatgtgttgcctctttcatcattccttgttgagtttttgttgttgttgtttgtttgtttgtttgtttttgagacagactctcactttgtcacccaggctggagtacagtggcacgaacttggctcactgcaagctccacctcctgggttcacgccattctcctgcctcagcctcccgagtagctgggactacaggcgccctccacacacctggctaattttttctactttttagtagatacagggtttcaccatgttagccaggatggtctcgatctcctgaccttgtgatccgcccacctcggcctcccaaagtgctgggattacaggcataagccaccgcgcctggccagttgagtgttatgtttaagaattgttaacttattttgtatctcctgatccatttagcatttgtgttttcacaaccaagttataagaggaccttaatataagaacagtatttttgttaaatgaggttcttgagagaacaaaaaaatattttaaaaacaaccaaaacatgatgtatgctatttgattcaggtgtctatgtctctgttgaattaactaattttgtagattaagttgacagttttcactaaggacaaatatatgccaaaatgaagggtcaaaatacttgatattgtttatcttatgagacttttatactttattattgaaaaattgtgtcttaaatattcttaacatcttgttttttgtttgttcctcttcactgttttaaatctggttcttccttcaaaaaagttttgcttatttttaggaactaaagaatagtgagaggacttaagttcctcttaaatagctcacaaaatttgatcattgaccctccaaaactaccaactaactcacttcctctcaaacatgcaaagcctcaacctctgcctgtctctctaggtatatctcgggtgattattgctcttagagagcaagcactcatgtgcagtgtgcactgatccactgctatggccacatttaatctttagcacaggaagagagatggagaaaaccattgccaccactcatcatccaatcaagagatagcaaggcttgaatgatgttattttcgaaagcagagtgatgctttgggatcagtgttaaaacatgcatcatcctagtctctttcaacaatacttatttcaaagatctctctttactacttcgcttattgcttttatgctctaaggttacatcatagcctatcacagaggtaagagtggccataattttagaattttcttctttatgtcctatgtgatagtgtgctggattcttggtggttagacagtgaaggcaccatggaacatttgagggagggacagctcttaactaactgaggtcaacaggagtcaagactcagttcacttgattctgaacttgataattcctaatgtattcaaaaaaggtttgaccattctttctctaagtatatgacagatggcaacattgaaggaataatggcaactgctcagtctgctatttaaagataggaccaggagagttattttttcaggatattgaatcattgctcttcattaaaatgtatttcatggcaataaattaagaacattatttctgcataactcctgaaactaacttagatggttttcaaccactggtgttagttagagagaactaaacttggcagccaaagaaaaactagcaattcaagatcactgttcacagagtagaggaaaaaagggagcctatttgaaggatttttattggaagaattgtgggtacgaatggggaaaaagctaaaaatacgcacagaagcaccaaaaagagatatcaaggatgggtttcagaggtgtgctgtaaatgtttaccaacatgctctatggagaaaatcattgagctgtggtgtttgccaacttccctagttaaaatacaccctctgtggtcagtttcaagctgccaacctatgtcactgagcatgaattgagacgagtttcacctacttgatgctctggagctggtgtgagccaactccagcacattaagcttttacttggatttcaaatgttcattctcttattaaaaataggtgtaaaaggtctaaatgcatctttgacatgtttgactataaactatgttttgcttttatcacagttgtttagtcagaattgaatttaccttattttcctggccactgaaaagtctctattaaaatggatgttgatgcaagatttattggacaaggaagaaaaggtaaaatactttcaaaatcacagaactgcatctacctaaaaaggcttaggtagggcttatacttaatattcaaaaaatgttaattatatgcctatttttccctttaaggtgcataaatatggcatagtcctgtcatttcaggtcttattttaggggtttaatagtcagatatatctgttctggatcaccatctgttttatcttcatacatataatccttatgtattttacttataattttaaaaagtcttaagatgtgatactaatatatctttaaggtttttatgatttaaattttccatatattttctcagtgaagaattagtctttctttttggccttccatcttgaccatgaacaaatgcatgagacttaagttaccttggtcattctactgtcaaaagggcccctgcaaatgccagccattgttttaagatggtgcatttactttagatgatgaacaccttttgagagcttctatttactatccaatatggtaaacagtgtagctgattaaaagataagtaagatgtctcagttactataaccttaattggattagaatcaagtaagggagagagatatttacacaaatgataagaggaagtaaacactagaaggagaggaagaaaataataaatgtaacttgcttggaaaagtagccagcttctaagattcccaactgaaagttttgtttcttttaaatcctgtcatatgcttgtttgataagaatgactcctctgaaatctaggatggtggtgagcttagccagacccagtgttattttaaaataagctctcgatgatatgaccaatgtatattaaaaatccttgtagatggtaaacaagatccatactgtaccatctgggctgttttcttcctggtcattacactctctcctaaagtatctaattactttgcggactccttagtaagcttctctttctttacccatccttcagatgttgattcatacaaagcaaggcacatagtaggttctctatatagtaggtcatctatgtaattattgaattaaggccaagatttttaaattttaaaaaatatattttaattgacaaataataattttgcatgtttttggggtacaatgtgattttttgatctatgcaaacattacaaaaatattccatcaagctaattagcatattcatcacctcaccaacttaaccattatttttgtggtaagaacattaaaaatctattattttggtaattctgaaatacacaacatattattattaattatggttacctggtagcatactaattttgctaatttgaaaaattagtaacttctttggaaagactctaagattgaatggagaccttgaaccatgaagagttaaaagataaagtagcagctaactcatgctctcttcaggttaaaatcagaagtaaaaggcaattcatagctttgagacttttgactatctacaacaaagcttttgaattgattttggaaaccacatatcccaagggcatttaggattaggagattctccacagaagcttgctctgtattgggaaaaactaagttatttgactgcagggattttaggctgcgggtcctagagaactaaaatcatacttcaaagtcagaatacatgtggggagaagatggagggaagctattctaatctccaacctggaagaacgaggtataggtaaactagtgtatattaaatatctggcatgtagaggactctaacaaacattagtttctttcttctatggtccagtaagaaaaaataaattataaaagtaaggtatcaataagataagatatttagggacagttagttatcaaaaatacgttatcaagaggataagatatttaagaacagttagtattgacatcttaaatttccaatttaaagtttcaaatggtgactcatttgttttcattgttgtctaatttacatttaaacaaacagggataaagcctttgtgaatagataagaatgaaaatgttgaactttcagaacaaactccaaatggttcattgactttgtttcaccatggaaaaatcacttcacctcccagtgtcagtttgcccatctgtgaaatgagaaggatgatattttcttatgggaatgttttgaaaattgttttgtaaatgtagtggatgagattttcgcaagcatcactgctctttttccacttatttaaagaagcaaacagtcttatttatgtactggttgatcatcaaaatgtcatctgggctgaaccatgtatatttttattagcaattgcgtgctttttattgcttaaagaataactccctgattgctcaatttatgcattatatcaatatcagggacccaagaaaagtgttttgaaaccatttggagcttcatatttctgagctcctaatctctggtaattatttcttctttctgtcttacatcatgttttctctgatgtggtttttcgcctcacctcacttcacaagattgatagttctccatgtcgccttgctagaggtcacctctgagctgaaggcaaaacacatcccactgtggctcctgttgactttcaagtcaactatccaggaatttattccagacattttctaacctcaatttaaaaactccaccctaaaaattacagggcgatggcaactctgagaggttggcattgaggagacaaagcctctgatatcagattttttacttgataggcttaattttgtaaggtgatcacgaacctctatgcttgtgtcatttaggtgtggaaagaaattttccccttcagaatcttctgtctcttatggtgccaatcaacacacttctgggtaataagatttttttttccagtgggggaacagcgcttatcaagcattttatttattgagccacaaatagcctgtatttgcacaataagaaaattacttctctggccagttgtggtggctcatgcctgtaatcccagcactttaagaggccaagatgggcttatcacgaggtcaagagatcaagaccatcctggccaacatggtgaaatcctgtctctactaaaaatgcaaaaattaactgggtgtggtgacacgcacctgcagttccagctactcgggaggctgagcaggagaatcacttgaactcaggaggcggaggttgcagtgagccaagattacgccactgcactccagcctggcaagagagcaagaatccatttaaaaaaaaaaaaagaaaaagaaaaaaaaaaagaaaattacctgtccaaagcagaagtgcccagttttaggaaaatctttttgttacatagcaataaacattctcttctataaagttaggtggaaacttgttattttttggatagaaaccatctgagttttagaactttataattttttttttaacttcaagttctggcatacacgtgcagaacgtgcaggtttgttccataggtatacatgtgccatggtggtttgctgcacctatcaacccatcatctacattaagtatttctccaaatgctatccctccccttaccccactaccccaacaggccctggtgtgtgatgttcctctccttgtatccatatatatgttccattgttcaactcccacttatgagtgagaacatgcggtgtttggttttgtgtttctgtgttagtttgctgagaatgacggtttccagattcatccatatccctgcaaaggacatgaactcatcctttttttatggctgcatagtattccatggtgtatatgtgccacattttctttatccagtctaacattggtgggcatttgggttggttccaagtctttgctattgtgaatacagctgcaataaacatgtgtgtgcatgtgtctttatagcataatgatttataatcctttgggtatatacccagtagtgggattgctgggtcaaatggtatttctagttctagatccttgaggaattaccacactgccttccacaatggttgagctaatttctactcccaccaacagtgaaaaagcgtgcctgtatctccacatcctttccagcatctgttgtttcctgactttttaatgagtgccattctaacaggcatgagatagtatctcattgtggttttgatttgcatttctctaatgaccagtgatgatgaactttttttttcatatgtttattggatgcataaatgtcttcttttgagaagtgtctgttcatatcctttgcccactttttgatggggtcgtttgtttgtttgtttgttttgtaaatttgtttaagttcctggtagattcaggatattagacctttgtcagatggatagattgcaaaaattttctcccattccttaggttgcctattcactctgatgatagtttctttcgctgtgtagaagttctttagtttaagtagatctcatttgttaattttggcttttgttgcaattgctttggtgttttagtcatgaagtctttgcccatgcctatgtcctgaatgataacatctaggttttcatctagggtttttacggtttcagatcttaatgtttaaatctttaatccatcttgagttaatttttgtataaggtgtaaggaaggggtccagtttcagttttctgcatatggctagccaattttcccaacaccatttattaaatagggaatcctttccccattgcttctttttgtcacgtttgtcaaagatcagatggttgtagatgtgtggcattatttctgaggactctgttcttttccattgctctatatttctgttttggtgccagtaccatgctgttttggttactgcagccttgtgatatagttttaagtcagttagtgtgatgcctccagctttgttctttttgcttaggattgtcttggccatatgggctcttttttggttccatatgaaatttaaagtagttttttttctaattctgtgaagcaagtcaatggtagcttgatggggatggcattgaatctataaattactttggaaattatggccattttcacaatattgattcttcctatccatgagcatagaatgtttttccatttgtttttgtcccctcttatttttttgagcagtggtttgtagttctctttgaagaggtccttcacatcccttgtaagttgtatttctaggtgttttattctctttgtagcaattgtgaatgggagtttgctcattatttggctctctgtttgtctgttattgtgtgtaggaatgcctgtgatttttgcacattgattttgtatcctgagactttgttgaagttgcttatcagcttaaggagtttttgggcttagacgatggggtgttctaaatatacaatcatgtcatctgcaaacagagataatttgacttcctctcttcctatttgaataccctttatttctttctctcgcctgattgttctggctagaatttccaatactatgttgaataggagtggtgagagagggcatccttgtcttgtgccagttttcaaagggaatgcttccagcttttgcccattcattatgatattggctgtgggtttgccataagtagctcttattattttgaaatatgttccatcaatacctagtttattgagtgtttttagcatgaaggggtgttgaatttcgtcaaaggccttttctttatctattgagataatcatgtggtttttgtcattggttctgtttatgtgatggattacatttattgatttgagtatgttgaaccagacttgcatccccaggatgaaatgacttgatcgtggtggataaggtttttaatgtgctgctggattttgctggtggttcactccagaccctgtttgcctgggtattaccagcggaggctgcagaacagcaaagattgctgcctgctccttcctgtagaagcttcatcccagagtggcacctgccagatgccagctggagctctcctgtatgaggtgtctgtcaaccactgctgggaggtgtctccacctcaggaggcatgggtatcagggacccacttgaggaggcaatctgtcccttagcagagttcgagcattgtgctggaagatcagctgctatcttcagagctagcaggcaggaacatttaagtctgttgaagctgcacccacagccgtccctttccccaagggctctgtctcaggaagatggaagtttcatctataagcccctgactacggctgctgcctttcttttagggatgccctgctcagagaggaggaatctagagaggcagtgtggaaacagaggatttttgtcgctgcagtgggctccacctagtctgaacttcctggaggctttgtttacattgtgaggggcaaactgcctactcaagcctcagtaatagcagacacccctccctctacgaagctcgagtatcccaggttgacttcagactgctctgctggcagcaagaatttcaagccagtggattttagcttgctgggctccatggtggtgggatccactgagaagacctcttggctccctggcttcagccgtctttccattggagtgaacagttctgtcttgctggagttccaggcactactgggataccaaaaacaaacaaacaaacaaacaaacaaaactcctgcagctagctcagtgtctgcccaaatggctgcccagttttgtgcttgagacttagggcccttgtggtataggcacccgaggtaatctcctggtctgtgggttgcaaagaccatgggaaaagcatagtatctgggccagatagcaccatcccttacagcacaggacctcatggcttctcttatttaggggagggagttccctgaccccttgcacttcctgggtgaagtgacacaccaccctacttctgctcgccctccatgggctgcacccactgtctaaccagtcccattgagatgaactgggtacctctgttggaaatgcagaaatcacccaccttctgccttggtctcactgggagctgcagactggagctgttcctatttggccatctggccggggaatccctggtaataagattcttacgccaatagttccagcataacctcaagtggtgcttgtagtaattattgaatcattacaaaactaaagaagaaaaggaaatatatttcatggatgtgattaagtcattatagtgttcttgcatatgtaaattatccttgacttaatgaactcccttgcttacataataatattttaacctggttctagaaagtcattcttacccatgttaatcatggttatcagacttagcagagtttatcttcagatcatcttgctgaagagaaatttatgtattatgtatccgtgtgcataaattttgattaaactattagaagtgcacttattaagtaaatttattacatgaattactttaacaaattagtaaaatgcttaagaagagcaaaaccttgattacatactgatgatatccaaattaacaagggtcatttaaaaatatgtatttttctgattataaaagaaatatgtattacttggagaaaatcgagaaactacagaaaggaacaaagaagagtattaacctatatcacctaggattaataatttagagtttgaatggatattctacactttttaaagagtactcccactgttttacacaatacattttgtatttctaaaaagagctaaatctacaagaaaacctagttaagtgggattcattttttatttcctttatcagaaattgaatctaaagtttgagtatccatatttcaaaaactttattcaggattataaaagctaccagggaaatattttatgtttcctctactgctttagagagttcaactcatccaaaattatttcagtgctttatcttcaacaatgaccaagtttagtaccgtattaactaatgcaaagcctagggaaagtaataaatataatattactatttgaatataaatctttatgtatgcctaggacaaaaaaagtttcctagaacatgtagggagtacaaaggagtcttaattatatgtcaatgctgttgttctctgaggattttcaattatttttctgtcttttgtaatatacagttttgtcgttgtttggttgttttaaattttattttgcatgagaagttaaggccagtgtagatcttaggcagttaatcattttatgactttcatttaatcaacattttctttaatccccttttaggcagccaagggcagtttccactaacacagaatgtaaccgttgttgaaggtggaactgcaattttgacctgcagggttgatcaaaatgataacacctccctccagtggtcaaatccagctcaacagactctgtactttgacgacaagaaaggtgaatacattttctttcaaatgttttaatcgtattctaaaatatcctaattacaataaatttatttttctgagatgattcaaactattccttttgattaccaaactgctgctgcttgtatttaaacatgttaaatattaaatactttagtttgcaagtcataaacaccaaagataacctatgtcaactttttaataaaataaacactcataattctgtttcgaaaatagttttatgccttctcttaacaaccatttcctgtctaggtaccatattttctcactcttgtagctatgttgtgtatagtttgagtttttttctttctcctgataatataatatgatttttatggaaattaggtttatatatttggaagatgcaatatgattttgaaaagtttaatgattttattttcatgactttgctccgaaactaagaattgtaaaaatgattcacagaatgttgaagtatttcatgtttccaaaataaactgaaattaagtaagaagctgtagtttttaaagttgaattggacttcattaactaatttcaacttcttactggataatagattttgattaaacattccagagaaaaaaggaaattcatcttacgtaatccaagcaaacaactaaaaatgcacacaaatgtctaagctttcatccattattagatgaaaaagtgaatccataactgtaatgaaaatatgagactgttgcttaagatacatgtatattatataggatataaataactatttatatattagctattcttattcttaaaattaactattagtcttaatatattttttaatgaatctgtataggtaattgtaagataacttcaaatcagctccatttaaacaattaaaatatcacatacagtctaataaatgtgctcagtccacctttaatatgtattcattatattttgttcattgttacaatttttcttctttgatgtcctctagatttaaaatgaaatctttagtttgttttaaatattaaatatataatgaaggagtgatgaagcatctaattcatttatttgataaatatttattgagagtccctttgtaccaggcattaaaattagggagcaggaagttcatagtgtctgcctttttagggaatacagtgtagtggaggagacagacaataaagaaacatgcaaatgaaatacattatatcatacattaaaaggggacaagtgctatgcagaagaatgaaccagggataaaggaactgttaggggcctccagggagacaaaatgaagaaacagacagatagatagatagataaatagatagatagatagatagatagatagatagatcaattgatcgatatttattttaataaattggctcaagtaattttggggtctggcaagtttgaaaaatgcagggcaggctggtaggctggagacccaaagagattctgttgcagctcatgtccagaggcagtgtcagggagaatttcttcttccttagggtacttagaggacttcagactttctcataaggccttccactgattgagtgtctcctgtccacattatggagaataatctgctttactcaaagtctactattttaaatgttaaactcatctaaaaaaataccttcacagaaacatctagatgattgtttaaccaaacatctgggaacagtggcccagtcatattgacatttaatataaaattattgacatattgacagttaatataaaatttactgtcatggacagttaatacctaatactcaagtagaactttattatttagaaagagatttaatttgcagtttcagttttctttccaacaaatgaagttctactagttaaaaaaattaaatgcatacacaaagtcactcatagagattaaacaatctctttttgcttttcgtattaattggttacaaatattagtaaataaatatttaaagtgtatgctcaaatataaggtggtgccaattttaaggacatgtctcatttgcttgaaactatgatgcaaaagaaaatgttctggaaaaaaatagacttctggaaatgttcattacgaaactaaatatattattatattagttaatttgtcaacttggttatacatacatatttaaagtaatatggaaaaatattaatttataaatactacttttttccatccctgtgtttaatgaagcaatcttgcttattagcagtttttgaaagtgtagcacactatcaacaacaaatttgtcccaagcagcaactataaacttttataacattagaacattttttgttgttgttcattcatcccacaggtgtataatgacaatctccactttataacaacacttgtactgctttttaaggagatttttaagagtcatgtttacagtgacatctccaatcgtgaggtcaaatcctcaggcacaaagacaaaatctatatgaaatgcccttgcctccacttttagtgattctataagttatcctctaaaaaacatctaaaactagaaaactagaattgatttgggatatttcaagctaatgtatctttcctggagaaaacagagagcaacttgccataaaagatttgcaaagacttgaatataaggcagcctccttttttctgagggataattatgaggagaaaaaaagtcatgccatatttgggaaatatggtaatatattcctgcatctttacactgccttgaaataataaatacaccagttctatgaattgttgaagtatgcactttttttttggttttgttttgggacagggtctcattttgttgctcagggagttcagtggcacgatcttggctcactgcatcctccgcttcctcggctccagcaattctcctgcctcagcctcctgattagctgggagtacaggcatgtgccaccatgcccagctaattttttttgtattttttgtgtagactgggtttcaccatgttatccaggctaggctgcaactcctgagctcaagcaatcctcctgccttggcctctcaaagttctgggattacaggcatgagccaccgtgccgggccaggactgactttacttaattttccgttcccagatgctgtaatagcttagttagattggagaaaagcctatgtatgtgtttgtgtttgtagtatgataggtttctgtttttgatactatgctttttctaactctattgtggttctaaacgtcagttgcagtaaaacaacagagagcattgaagaaagaaatcctttggcaatctaacatacctattccctcatatgtcagtgcttcaatttccttcttctttttttttcttttctcgtcctcactatctgttcccaagagtggttcaatttctatgtgatatcttagttgaagggattcttggacagtaatacctatcaaatgcaagagtttgaaattgaaagcattttaaaagattccatattacaattttccacacatcatcttttaatctgcaattacctaactctcaccaattttaaggcttgtcttgagcaagcaagcattccaagttgtaccagagcctaagtgaagaaggtgagcatgagttagactagagtaacgcatacttgttttactagtgaagactgcacatgagagcaagagagaaaagggaaggaatgggttgtctgtgtcattgattataccatctcctgcaggtggctgctactgttaaagcttcatctatagcctcactcttctttctgtctcagattgtgcttccagtggttcttagccgtagctacacagtaaaatcacttaggggattttcaaacacagtcttccagcggtatgcagtatcagaatattttaattatatctcaaatgattagaaaatgcagctgtgattgagacacttgggtttaggcaagtcaactctctgaagagttctgcatccctgagcttggatttctgtattgataaatgttactgagcatggaaggaagaaaagaagcgagggagggagggagggagggaggaaggaaggaaggaaagaaggaaggaaggaaggaaggatttctgtattgataaatgttactgagcatggaaggaagaaaagaatggaagggagggagggaggaaggacaaactgctcagaaaaagaacaagtgctgatcactgcctcacaaccattactactgctactatgagctccgagaggcatcccgtagcatttcatgctacctggaggtgtaagtttccaagggtcctggctatgaacgagaaattcaggatggcagcccacatgtcatgttagagttggaaaagccttgtttacatgaatttattaactgaataaaaacatgctgtgagtggtcagttgaatcaagtaaaggagaattaggctgaaccccctttcctaggggtctctgtcagtgactttaaatgtgaatattcatgtaatcctagccacttgggaggctgaggcatgagcattgcttgaacccaggaaccggaggttgcagtgagctgagatcgcgctactgcactccagcctgggtgatagagtgaggctctgtctcaaaaacaaaacaaaacaaaacaaacaaacaaaacaaacaaaaagtgaatattcgggaatctcttccccggggagataggagtctagtgggggaattggctaaggtgaatctaatactgtcatatttctcactgaggtaaaataaagacgaaggcagcaaattcaagcttttacaacttttttgccatgtttaatgtgatcagtagcttgtgtccattgataaatggaaaaaataagacctaacaatcaaggatatttcttcacagacattcagctaatgtctggtagtgaagaactttgaatccaggtgtagcttttgccttgattttaactgaaatattcctgaaagcaatggcatttggacgccatgtcattttaaatgtaacctgggcagcctctgccattgatcttggcagcttacttttgttaaagagcagcatgtcatttcaaactattgaagatatacatagattaagacagaagggccaggcatggtagctcacacctgtaatcccagcactttgggaggctgtggcaggcggatcacctgaggtcaggagtttgagaccagcctggccaacgtgacgaaaaaccatctctactaaaaatacaaaaattatctgggcatggtggcggatgccaataaccccagctacttgggagactgaggcaggagaatcacttgagctgtggaggcagaggttgcagtgaactgagattgtaccattgctctccagcctaggcatcgagagtgaaactccgtctcaaaaaaaaaaaaaaaaaaagacaaaaagacagaagaatatattataatcagcattgtccacgagaacattccatgatgatgggaatattccatatctgggctgagctgaacaattcagttgtcatgtgtagatatttaaatttaaattaataaaaatagagtaaaatttaaaaatttggtttctgccacactagacatatttcaagtactcaatatcctcccatgcccagcacttactgttttggaaagcacaattctagatgctgattcactcatcagatgtcataatataccttgtccagttccagccttggctagtagaatatgttatttttaactgagaaaacccttaggctatcataaaaacatgcatcaaatattcaataaatgatttttttttaccatttaaattgtacagctttcagggggacattgtggcacaggagacagagagtcagatctgaatttaaattctgcctttgacaccagccagcagggtaataaaaggtgttcattgacaccccattactggtggttggaccagaattgtattttaacgagttccctgtctgccttgtgtgcacccaaaaatcagaaatcattagcctacaaagtcgaaattcaattacaattccacttcatttctgtacagcctaagtatgaagtctttttctataatacttaagaatctgcaaaaactaaatagaaaataagaatcaagaggaaaatttatagatccttatgggtcagagagacctagaatagatgtagctaaggcaacattcacttgttataatcctcttctctttctttttacataaatcttagcacctctgttataaatagttgataagcatttggaatagagtgggtatagggagacagagcaagtggggagtagaggtcattgaaacaccacataaatgctgtgtggtattggcaatggaaaaaaaaatcaattagatcgtagtgtctgtttctctgcaggtgcagaaggaaaaaaacaattgaagtagcacaatctgatcagttaatgctcaggaaagaacacttcaattccttcctattattgacaaaaatactttgaacaagcatctccaggagcccataacacacacattcaacagatacatctctgtgagcttgtatgtgtttttatataaaaatgtaaaatacatgacttttttgtgattttcttctcaatatttcaacttttaaatttttttaataatccttaaaaatttcctaaagaaatcaaaataaaaatttattaaagacatagctttaaatcattggtgttaattagccaattattctaataattttacactaatactgggaacaatggaagaggaaaaacatgagtaaattgtcctaaaactaagaccgataaagagaagaaaaatgagatgaaccagaattggaggtacaggttctcctggctctatgccaatccatgccacctgactgtatatctccacaactgctatcaatcaatttgacaggctttattaaagattaactgagtaaaacaggtgttgcatttggctactattacccttcttttgttttcttttaaaaatgcagctattatatatctgtacaataaaaatgtgaaattaataatgatagcttatagttatacagtaaagttattagataactttcagcatgtttaccttttgtctttgagttctcaacaatactatacagtaggcattcctattttatatgtaaagacactgaggtttacatatttaaataacttgagtagtaaatgacaaagcaatgaagagacttgagttttctggccaggtgaggtggctcacacctgtaatcccagcactttgggaggttgaggcgggtggaccacttgaggtcaggagtttgagacaagcctggccaacatggtgaaaccccatctccactaaaaatacaaaaattagctgggtgtggtggcatgcacctgtaatcccagctactcgggagtctgaagcaagagaattgcttgaacccaggaggcagaggttgcagtgaaccaatatagcctgggcaacacagaaagaccctgtctcataaaaaaagggaaacttgagttttcttacgacaagtctaattcactttgtgtttcattatgctgaaaaatgaaacattttctcccttccttccttccttccttccttccttccttccttccttccttccttccttccttccttcgttccttccctccctccctccctcctctctccctccctccctccctctctctctctctctctctctctctctctttctttctttctttctttctgtgggaattatagtttctggttctgtatttcaaagtcactctttctgattgatctcttcaaaacatcttatctcatatttaaaccctaccacaccacaatattctcatatgtattagtaaatttcctagcaagtgcatgcatattgaatcgtgttccccttaggaattaaatggtacattgcagttaaagaagaataaatgggccaataatacagatacaggcataattaaggaaactagccaaaatgatgcacacccagaaagtagcgacagtaggagaacatcctactttggtgtctgtaagagaaataaaattaactaaagttacagttatgggagaaggcttctggttaagagctatgactggctgagaagggatagatgtatgaaaatatgtaaattgacatctcttttctcccaacctctgttctcttgtcaattccttctgggctgatcccagatgaaaaccataggtcaagggatcctgagtagcttagtcttctaaggtaaagagtgtggatctggaagatgaacagaaaggaaagagtatagcatatcatgcatacacagagatttctacatacccaattttcagttaagataattccattgaaaatcttgggttattttatgcttatgcttgcaactaccttcagttgcattgcttctctgggaagatatttaatacatatgttaaagtatatgctcatagaattctgttttttttttttttttttttttttggagactaagtctcacttcgtcacccaggctggagtgcagtggtgctgtgttggctcactgcaacctctgcttcccaggttcaggtgattctcctgcctcagcctccccagtagctggaactatacatgtgcaccaccatacctggctaatttttgtatttttagtagagaagaggtttcaccatgttgaccacgctggtctcgaactcctgacctcaagagatccgcctgcctcagcctccccaagtgctgggattacaggcgtgaaccaccatgcctggcctcatagccttcttaaagaatttacttctacttttgctgaagatgaagccattattggcaattctttaaacataaagaaaatcttcggttgtggattgtataattactacatttacttctttaggcctgtgcattttgagtccagcaattttaaataatgataatatatgctataaattttggcagttacatgaataacaacatgttaagctgtaagcatcaagactgaaatgttgacattcaaagcaacatatgcatgcctaaattgtttccacaaattttaatttttggacatcaaaatcaggataatttccatatttgatattatattttagggaaattatatgcctacttttgataatactttctgcaatgttttttgaaatcaaagtgacattttctacaaataagtgctgatgaccaggtaaaaatgaccaaattcttgaattaagtccttttaaaagttattggccattgttgtttgtaaacatatattttactaaaaccctactaaaagaaaaattattttaacaaacactgaacagttttattctaccttctaatgattaatttatgtattattttatcattcaacaaatatttgctgatcatctactgtgtgatgggcactgtgccaggttgtttgcagttatcgcagctcactgatatttgagaagcctatttcatgttgaatagagcagcttgaaagaaaacttgttctgatgaaaatttgggttccattatcttttaatcatgtgtgtttctgggtacatattttgtaagtacatttataagttggcaaaacatacagaattagcacatggtcaacaatgattgcaatgactttaaatcatctaggagtatcattttagacggttgtggcagtagaagtgggatgatgaactggctagactcagactgagtagatagtcaccaccattgtgtatatattttcctctctcaaaacaaaggaataaacaatgcaaagagtgaccagtttcctggaaaatgccttgatgttttttttttttttttttgtgatactttagattccccattttgagcattagtagcttttaaggaaggcaggcttcactaaacaagtgtcaatctgtgcacatctaagcatatttgatagttgaaagatttccaagtcacaatttcagttcaactgtatggatatctataaaatattgctatgccctgggaattatgctgggcattgagaatactaaaataaataaaatatggattttggcatcaagtgtcaagttgtcaggtaccatctatatatgggtgtggtggaagggatacagggcaagggaaattattaagtcaagcaatctgcaggtaggtaactgtaattctacttgttgcataataaactattccaggagatgcaaaatgagtaagtaatcgataaaattatccttcatgagtctagaaaaaaaataattcgacttgaaaatattcatgactgaaaacaggcttttttgataaagtgaattcctttaaagtaattataactgaactatgtaccatttgtcaaatataaagagtaacaatgtactgcaccggggcctaatttcttggtgacatactgatttctggtgacatagtgtctccatgttgaatagacttttaatcaggatcagcacaggcatcatgataatttaagatattctaacattctctttttaattttttaatttttattttttattattttactttaggttctggggcatatgtgcagaacatgcagttttgttacatagctatacacatgccatggtggtttgctgcacacatcaacccatcacctacattaagtatttctactaatgttatccctcccctatacccccacaccctgacaggcctcagtgtgtgatgttcccctccctgtgtccatgtgttctccttgttcaactaccacttatgagtgagaacatgtggtgtttggttttccgttcttgtgacaatttggtgaaaatgatggtttccagtttcatccatgtccctgcaaacaatatgaactcatccttctttatcgcttcatagtattccatggtgtatatgtaccacattttctttatccagtctatcattgatggacattcgggttggttccaagtctttgctactgtgaatagtgctgcaataaacatatgtgtgcatgtgtctttatagtagaataatttataatcctttgggtatatactcagtaatgggattgctaggtccaatggtatttctagttctagatccttgaggaatcaccacactgtcttccacaatggttgaactaatttaccctcccaccaacagtgtaaaagcattcctatttctccacatcctctccagcatctgttgttttctgacttttgaatgattgccattctaactggtgtgtgatggtatctcactgtggttttgatttgcatttctctaatgaccagtgatgataagctttttttcatgtttgttggctgcataaatgtcttcttttgagaagtgtctgtttatatgctttgcccactttttgatggggttgtttgtttttttcttataaatttgtttaagtttttttagattctggatattagccctttgtcagaaggacagattgcaaaaatttcctaccattctgtaggttgcgtgattatagtttcttttgctgtgcagaagttctttagtttaattagatcccctttgtcaattttggcttttgttgccattgtttttgtgttttacacatgaagtctttgctcacgcagtgtgtcctgaatggtattgttcaggttatcttctagggtttttacgattttaggtcttacatttaagcatttaattcatcttgagttgttttttgtataaggtgtagggaaggggtccagtttcagttttctgtatatggctagtcagttttcccaacaccatttattaaatatggaatcgtttccccattgcttgtttgtgtcaggtgtgtcaaagatcagatggttgtggatatgtggtgttatctctgaggcctctgttctgttccattggtctgtatatctgttttggtactactaccatgctgtattggttactgtagccttgtaatatagtttgaagtcaggtagtgtgatgcctccagctttgttcttgttacttaggattgccttggctatgcgggctcttttttggttccatatgaagtttaaagaatttttttttctaattctgtgaagaaagtcagtggtaggttgatggggatagcattgaatctataaaattactttgggcattatggccattttctccatattgattcttcctatccatgagcatggaatgttttttcatttgtttgtgtcctctcttatttccttgagcagtgatttgtagttctccttgaagaggtccttcatataccttatatgttttattcctagttattttattttcttagtagcaattgtgaatgggagttcactcatgatttggtctctgtttgtatgttattgatgtataggaatgcttgtgattttcacacattgattttgcactaaatgcccacaagagaaagcaggaaagatctaaaattgacaccctaacataaaaattcaaagaactagagaagcaatagcaaacaaattcaaaaactagcagaagacaaaaaagaactaagatcagagcagaactgaaggagatagagacacaaaaacccttcaaaaaatcaatgaatccaggatctggttttttgaaatgatcaacaaaacagatagactgctagccagactaataaagaagaaaagagagaagaatcaaatagacacaataaaaaatgatataggaaatatcaccactgatcccacataaataccatctaacatcagagaatactatagaaatggtagttctatagaattctatagtatattctattctatagtattctattcaaatttatatcctatagtgttctatagaatatagaatatactataaaatacttctatacaaacttctattctatagtattctatagaatatagaatattctacctatgcaggtatatagaatattctatagaatactatagaaatacaaactaccatcagagaatactataaacacctctatgcaaataaactagaaaacctaggagaaatcgataaattcctggacacatacaccctcccaagtctaaaccaggaagaagtcgaatccctgaatagaccaataacaatttgtgaaattgaggcagtaatggatagcctacaaactgaaaaagtccagaaccagacggattcacagccgaattctacaaggggtacaaaaaggagctggtaccattccttctgaaagtattccaaacaatagaaaaagagggaatcctccctaactccttttatgaggccagcatcatcctgataccaaaacctggcagagacacagcaaaaaaggaaaatttcaggccaatatccctgatgaacatcgatgcgaaaatcctcaataaaatactggcaaactgtatccagcagcacatcaaaaagcttatccaccatgatcaagtcggcttcatacttgggatgcaaggctggttcaacatacacaaatcactaaatgtaatccaactcataaacagaacccaagacaaaaaccacatgattatctcaatagatgcaaaaaaggtctttgacaaaattcaacagctcttcatgctaaaaaatttcaataaactatgtattgatagaacatatctcaaaataataagagctatttatgacaaacccacagccaatgtcatactgaatgggcagaagctggaagcattccctttgaaaaccggtgcaagacaaggttggcctctctcaccactcctattcaacatagtactggaagttctggcccggacaatgaggcaagagaaagacataaagggtattcagttaggaaaagagggagtcaaattgtctctgtttgcagatgacatgattgtatatttagaaaacctcatcatctcagcctgaaatctccttaagctgataagcaactttagcaaagttcaggatacaaaatattctaatattcttaaagtaaatttcaaaatagcattattactataattccttagtatgtaaaagaaaatcttaacaatatcaaaaaactacttgtgtataacaggcaaattcaattctatttgtaagcacataattttgacccataccaacaaaatatatttttgataagatgtattatttaaagtttactgtttaacttttaccgtttttcctgttctgtgtttttcttaataatttgcatcagacttttatagagtgatgccctcccccatagtgaatctgtattttggaaatggagcttttttttttttcctttttttagtttgaggcaggtgtaaacttagctctagagcaccaacctaaaggttattatacttaaaaacttagaggccactgtattttactgttccagtttcaacattccaggagagagaaatagattggttcagcttataataggtgcctctactgtgctttgagttataggcaggagtgtgtgtaccctgagccaggaaataactataatttataatctacaatgtacagtctccagtgtaaattgtctgtaatcaatgatgatcctaataaatggtcttgatgtatagactctatgcagggtattttcttttaatagaatagatactttatgaaaataattttaacatcaagtacaaaatgaatgagaaacctctatttttcaaatatcgtttttcaaatatcattacatggccatccatacaaaatactacagcttttaatatcaaaaggcttttttacaagtaaacttggaaatattgactgaagtacacaaaaatataaacgaaaaaggacaaaaacacacacagcgactcgctaaggcaatactaattacaaaatattaaattatgaatttattgtggttatatgttaaataatattagctacttttcaatgtattcacttgattttcttcagttatttttctgtatttataaatactaaatgttttttcaccctctcttcaggagatatttcttcactattcatacaaaataatacaatttagaaatacctacttctaaataaatatttgtaatgtgccattttaaattgtgtgagcatgaaaattacaaattaggttaggtattctacatttcctgatttattatttccctgcaggctcttgtgagccacccttggaaacagcagtaagcaagcattttgcagctctggtgaaatgtaggaggtagcgttattttagtaccaaagtgtgggtatttttaagaatcaagtctcctggttttacaccttttaatgttgagactagcaagtggactgaagtacaaatggaaagtagggaggtgaaatactgagtgattgctttgagttttccatatcactcactttcacattttagaaagaagggtagtagtttagaaagaatagcagcagtgcaaatctatacataatatattgcatttggactttcaaagtcccatcaaatacacatagtccacccttcttttaatggtgaaaactgcactcagtgagattgaatgggctatctctaaatagtgaattttgataaaaatattgtctgggtattgataaaaatgttctcctgtggggatgatgatcagttatttgtcacttatttatttctttgcaacttaaaatctaacctcatgaccttctgcaaacattagttagttgttcaaaatttataaacttggtagtcaggatagctgcacttgaatcacagttccatcgtggatttgtgtgtgatcttgaaccgaccttgactgattgcataaaccaatctcagttccagcttgtaaaccttcttgaagtggagcttgcagtgagccgagactgcaccactgcactccagcgtcggcgacagagcgagacttcctctcaaaaacaaataaacaaacaaaaaaaccttcttgaggacaatgagttttgaaaggccaccttatctcatgtctcggtgtgtaggctgaaactcttatcagaatgtgttttgagatttttgaaacattggaaaataaatgttacattaaacaaaattcaaagcaaaacaaatcataagcctatcatttaaggtcttaagcagtttctatctaggaagttgagatcttatatactccttttagaacaaaaatggctgtgttgtgggcaaatacctgaactgggccttttagtcaatcagacataaagcaaagaccctgtgttcttagtgctgtaactacattgagggtaacaacgaaacggagatttctaatttggagattcaatggctactctaaaggatttgggggaaagacctaagtgagggggaaataatttaagagacaaggaagagttcactccttcctttcctgactctgttacttttcatgttgagtgtgggctcttttggtgagaaatgtatgaaagaggctctcccacctgcagggctgcctctgagtctgtgcgacaaacagcagcataaagtgagagggggaagccagcgctggtgcttgacactggcagctacttatactggcagctacttttactttgttaccttctgtgtgttgactgggtatctagcaaaccaaaatgtgcatttctattttgtttattacctcctcactaaatactctctcagtagttcaaatagtgttttgtaacttctttatcaactcattaaatgattctgtattatctataaataattttgcttctgccattgaatagccctagctattatcttttatcttagcacattcatcacaatataaattctttaaaagttagaacactgaaaaaaggaaatcagtatctgaacagctatagaaagagaggctttgaggaaagagaggtgaaagaaagataaaaatgattttagcagctaaggtgtgacatcatgatggcctggaacagagcatgagctaagaaaacagagaaagaatgtatattaatcaaggttctccagaggaacagaactaataggatagacgtatatgtgaaagggagtttatgaaggagaattgactcacatgatcaccagatgaagtcccatgatggtcatctgcaaggtgaggagcaaggaagccagtagtggctcagtctgagtcccaaagcctcaaaagtagggaagctgacagtgcagccttcagtctgtgaccaaaggccccagaacccctggcaaaccactggtgtaagtccaagggtctgaaagtcaaagaacctagagtccgatgttcaagggcaggaagcattccgcatgggaagaagatgaaagccagaagactcagcaagccagcttcttccaccttttcctgcctgctttgttctattggtgctggcagcggattggatggtgcccacccacattgagagtgggtcttcctctcccagtccactgactcaaaggttaatctcctctggcaacaccctcacagccacacccagaaaacaacaataatttgcatccttcaatccaatcaggttgacacttaatattaaccatcacagaatatatatgaaaagttttaaggcaagaaatttactgggctttgtgatatagttaagcaacaaaaaactaattcccgattttcaaactaggagcaatttttagtctaattttgagtagtcatgcaattgattacattattaaaagatcttaaagctccctaccatccatttatggtagagaaggtgtcatcaaggaaattaattataattctgagtttctgtggaatcctaagtttacaaattcaaaagaaattaatagtcatattaattcactatatcattacagtttgatgttatatgcatgacagtaattaagattcatttattcattcagtaacaattattaaactgctttttgcagtttttctaggcgcttgagatttatcagaggacaaaacaggcaaaactctgccttcatgcaacttactctcagatgggaagaaactgatcataaacaaaataaatgagtgaacatatggtttgtctgagagtgcaaaattctgtgaagaaacaaaacttggggaagagagataagaaaagctattttaaataaatgtgagagaaagcttcatgaaggtgacattgcagcagacactcatataaggacagagaggtagaagtgtcatgtctcatcctttagaaggatagtgagccaagcagagaagcagccagaagtaaagacactctgagcatgttgaaagaagagctcagccagcgtgagcagaccaaagtggataagaagaatagaggagaggaaggcagaggtagtgggatgaggagagtgatcaaaggggccttgtcagccatagaataattctgaatttttctcagattgagatgagaaacgagcagagagtgttgatcatgggagttagatgatcctataaacattttcacagtaacactcaggctgttatcagaaaagtagactatggggaagggagagaggatcagaagcagggagaccaattagagagctattgcattaatccaagcaaaagatgaagttggtttggatcagagttagcaatgaggatgatgagaatagatggaatgttctgtgtatttgaaagtagagcaaataggaccagctgatggcaagaatgtgaggttgaagagtgaaagaggagtcatggatgatttcatggcttttgacttgaacacttgaaataacaaacttgagatggagaagcttgcaggaggtgaaggtggtgattgttttgtgggaaggtttggatttgtccttttgagcttattaaacatacaagaggagattacatgatagccaattgggtatatgagtctggagtccacagacaagcaagttaaagatcttaaatacagagtagatatgtattatcaggcttgatggcttaagaagatctagggaaaaggagtccaaggactgagttctaggatccatcagtaaccacaggttaaggaggtgagggggagacagcacttgaatcatgaatttaaatactctttttatttttaaaaatgtttacaaaaagagctttccaaatattgtgacatttgacttgcagaattctacttctgaaaagcagcgataaaactacgttggctattgtttgtcctgcagttacaagttgcaagagttttgactttcattatcatcctttgatgagtacctatccttattatacaaatccagaaaaaaataattctattgtggttctctgcatacaatatgattcctcacgcttgcctttggagatgaagttttctccttcaagcatgctttaccttgtcttgttcagcctcagaatcccagatagcaagacaagaaagctttgctctcttttccaggaagatagttagcaagaacagggagggcaggatcagacatcaataatcttactaggggaatggcatttacctctaggccaccagagggcagggcatcaatccttcatctgtcctgggtatctgcagaagcctctaagaacacctgcaagttattttaagtctatatcacccacttcctactcttattcatatcactgaagaaaacaaagtggaaacaaccagaaccaaagcaaaatgctccctaaatcctagtcctcctttagcttaatctactttttttcctgggactagaaagaaagggggctgtttgtttttgttgcatacacaagaagttagggtatacactctgtatacatcagactgtatcaggaactgttttatcttctatgcaacaagcatttttctgaacaaggtctaggtgtggagctgcaatggtgatcatgacaaactaaccttattcatggaactttgtcagtacttctcaaatcatttttgagggccatttttctctatatatcaagcacaaataatgcttttgtaatgtacaataaaatgaattactataaaacaaaataataaggcattcaaaatgcaagtttcagcttattattaggttctgcaaatataacataaaaaataaaaatgtatgtatttgttgagtgtggatatattgggaataatatagataattattatgcttataattttttgttattctggaattagaactaaacacaaagttatgagagaaacagtaatttttcatattaaatgtctatatgcatatttagaatgaacatcatatacatcaaatatttacattttaatgtggcacatgcttggttgtggcttattaatttatataatccctttggattggttacagcatttcttgctgggaataatgtataatctgaactgtttccattctttgtattaacatcagttatagcagagaaatgaatcttagagaaatacattggcagtaatggaagaagagattttgaagcaatttcagcaagtttaggatatttattttacaattttttccagggccaggtgcggtggctcatgcctgtaaacccagcactttgggaggccgaggcaggcagatcacttgaggtcaggagttcaagaccagcctggccaacatgatgaaaccccgtctttactaaaaatacaaaaattatccaggcatggtgatgtatgcttgtaatcccagctacttgggaggctaaggcagaagaattgcttgcacctggggggcgaaggttgcaatgatctgagatcacgctactgcactccagcctaggcgacagagcgaaactccatctcaaataaataaataaaataaaataaaataaaattgtatccaaaaaaggcaaattttaccacattttcaaaaattcatcatcagtcctgcattagtagcctgctccagtatttatcctataaagttatagttaaatacatttttatgaaagaaatcaactcaggatccatgaattttcatatgtggatcttatgtgacaaaatataaattcaaaatgttctatcagtgttctaaaatggtctatgataacttttcctaaatgtgcgatatcaagatcatcactttttcactgattattgtacttaatttatgaaccatgtcataaataattgtagaaactctattattctaagcttctaacttttgcttggtcctttgatcctacctgccattgcaaagcatgttgcattcattccttgcaatcagtagaaagatctttaaagataccaaatatataagataagtgaaggctggctgtccaacctacatatttaaaactttggaatgggctagtttcttatcttgtataaataaaagttttttgttgttcagatattctcaagaatttttccatgtgtaaacttggtgcctcaacatgcagtataggtgctataatcaacatctatgttattacataataaatataacaattttgtatttaatgaattagcttttacatacataaatcacaaattttacgaaatagctaagaaccctgatatttagctgatacttctattgtgcactaaggttttcttgacgaaggaagcagtaccttggtttatggtctatatgaactccttaatcagactacatcaaaatatttccctgccatggtagcttgccaatctacttctagaaaacaaacaaacaaaaacaaaccacaaaccacattactgatttctaagcatttttctcaatgtgtgtatttatctctttgctggtgagtaataaactgttgtggactggcagtttgaggagcactgttatgtggaaagtagagataatgtctactttgcagagttgttgttaagattatccataatcttcacaaagtgtctatcaaatattatcacagacatttaatttacgagagctattaatttgcattgtacaattatttttcattttaagcaaatctatagtacaaagagaataagtaacagactgtatctgaactgaaaaagtggatgaccttgtagagaaatttatctgtctgtttatagctatgcgtcaacattttgatatataaagatacaggtatgtaagtataatagagtatctcctgcaagaaaaactaacaaattgttaaagagtggtcaatatataggcagaaaaattacagcccatccgcgagattagagaaaaaacaaaacaaaactcaaaacaggagatgaatttagagattgcttcaaaaggtgacagaacaagttactacagtatgagacagtgctaaaagctttctatgcatttcgctgttgtaattttattctgggacgtttttcacccaatcaaaacgtactggagaaatagtggatagtttattttacttgaggatgcttaaaaagcactaactcatattgtactcacaatggagatactgctatgcacattttacatacaagaatattgaagcagagggaaacttagtaatttgcttaagttgcaatgtccttggtggtgcaaggatactaagcagtctgatgtcactcatagcctttgcttatccatggtttagagtgctgtgtcatggatagtaaatgggagcttaaaatggaaaacttagtgtaaacttgtgtgggaaataaaatggatagagattttttttttaagaaaaaacaaaaaaactcaaggtgagtgcacagtgcacaaagtgctgtgaaaggtgatggaggtaaagaggtatgactcttttgtcactgggaggtctagctggcactgttgtctctgaggaattaaagctacttgtgagacagagaaccaagtgtgcaatcagggtggagtctcttcattcgtgggttgagtctaaagagcacatggaaagggaaaatcacttgtaatgtttaaattgttcaaaagtccctaaaattgcccccaagcatgagaagtacatcccatatgtcatttcactttctgggtgtttatttgcttgctgagtggagtggcagtctatcctgtatggagcaaggtcaggtacttcatatgagaagcagtaaggatgcaaactaagaagtggagaagaaggaaataaaaggcagctgtgaaaaaactaaaatttttaaatttatattggcaataaactggtttattgtataatcagggaagacttgagtaggggttaatgataaccaatgatgacttagttctcaaagctctgtgaatgtgatgcccaaaatggaatgaaggacttcgggtggaggagataaatgtgaggagaagggttaaaatgataaaaacagagaataatgaattttggaaaggaaaagtaatttatattgaaaaataataatatgcatacacaaatgcatgtattatataaattgaggtacagttgatctaagcatctgagaacagcataaaactgataagcatttaaagtacaattaccgtgagagtgtgtagtcagatcacagtagaaaacacatggcaccatcaaaaggttcaagtttagagggcttaatgaagatactatattacaaagatgtgggaaggcttaaaggaactaacaaaagatgaatagctcatggaccagaaaaggtgaggaggtattacttactatccctaaggctgatatggcatgtggcttcagctgtaatcaaaacgtgcagccactaccagagcccaaataagtattccaccttacttttctaccctacaatatgctgccattgcctttctttggctgaacctaattgtaagccagaggacaggggtgctgggaaaatgcattccataaggatcagttgctcaagacatagtgtagcccatatagagtgcaggggatgaaaatggcagaatctgacatagccactatgagtaacaaaattattctctgaataatattaaagggctatctgtaggatttggaatacatattttattttatattttctaaattaactttgttttttagtcactgtgtaccgattttttaaaaatgttatgacagccactttttaaaaatttcggtagcttttgggttacaaatgttttttgtttacatggatgaattatatattggtgaattctgagattttagtacctgtcatctgagctgtgtgtataaatgttttcaaatactaggtcagggatgaattcttactgttaatgctttaatcctttttagatgttttctttgttctccataaatgtagattgtattgaaaataattttgagtataaactatttcatttaataattgttatgttttacaatttcagtaatatctctgaaagtaaaataatctagcaaggagattagttttgtaattgtatcatgacagtataattgttgaccttttatatcatcacatgcttttatagaaattcagcataatttttaaaacaactttatcattctgatatgactcatttattatatatttttcaagtacattatcaatcactttacttggagcattctgcgataccaatgagttaatcatggcatatgtgcaattactggcatctgttactctttaatttttgtgtaaagctgcccactgtattatttaatgaacaaatgcacttatccttaatcattactttgcactcaacttccattaaaacaatgacaaatcagacattcacatttcaatcattaaaataacagtaatgaattattttcctggtagtagggtttttatagttgtttttcttaaaatgaatttttatcactttttttatggttagcatagatgcaaatgacagagattgttttaataggcagaagttaagagaaagtgtgaaatacttcctctttctctcacttgcaagatgaaaagattccccctaccgttagcaaatgatagtggggaaatgaaggataagggttggagaagaataaacatttttctttgaatttaaccatggggaatttctggaagatttacaaccatattggttcattgattactcagatggcagacagatattctcagtgtgtgctcccttttcctaatgaaaaagactattagcccacctcaaaatgtatattaaaagttttatttttgttaaacggagagctctgtttaacctatttgcagaatcgggcctctacttgaaaacagcaatcacttttgaagaaatatcactgcaattacaaatcaagtggaagttagaatagatataatgctgttacattctgattacaagataaatgtagttaggaactgttgagttctttgtgatccagaaattatgtagaaaattctaattttactaagttacccaaattgaccccaaaatggatggtcacatatgcaggctagaaactgaatcaaggatgctgaaaagcaccattaatactgcctttttcaatgaccttaaagagagggtattaagaaaatcacactaggtttcattaagatgaataaaattgaacatttaagtaaaggaataatcatttttgaaaaacataatatgaaaatatatgaccataaaatcttgatagctctctagcagtgcttgtagaaattgcagtctcttttcaaatgttatagtaggtggcaactcagtagaaaattataatagctgtcaaaattcgtatacattttataaaatatgcattttgttactttttcaggtgcttgtagtaatgtatatacactgtgttgcatagcgcggtgtgtagatccatagagacagtatgttttctttagtatcaaataacttgacaaggaaattataaaattctttagaaattcaagtgattctcagtaaattaagcaatgggggattattctatttatggaaagcttaatcattttctatctcttttattattttagaaattccatttcttttattgtgtaggaatcagaccagaggctactagagagacaactgattagaaaagttcatgagaaaggtttcaaaaggaaaatcttcctgaggcttattttcatataagtctttagaaagaacagttaatgctgctgtgctgtatttttcccaaatgtattgtttttaactcataaaaatttttctctcatatatcgtactcaaagtgaatgattcaggtcaacaagatatttctgttccacgatgtcattcatggatccaggttctttctatcttgttgccctcccattgcccgggctctgttttcatttgcttgtctgaagttggttatggacaattccatgttttagtttatgaaaagaataagaggcagaatagagaagtacacattggttacctcaatgcccagttccagaagtggtgcatattacttctaggccacagtagctgcaagtgaagttgggaaacacagcttaggtgggcaggtaccacttaccatttattacaatgcaagaagaggaaaattgaggttagtaaacaattattagaccctgacgtgctatccaagcttcttgtaggtttggcagagattttaaagggcaatttagaaactgtttgaactttcatatttgccataatcccaaacacgggtaaagcagttgtaatatataatatcagtcgcttctttgtacttatatatggctcataggaaaggtaagcatctgtgttctaaacaaaaatagatttttaaaataggaattttaaaacaggaataatctttgaactgtagattaagaaagaacaccatatgggagaaaagagaaaaaagacttctaggcagttcatagattatacagttataattttcaatgacacatatattacgtatgaccaggtaaggcctcccaaatctaccacagttagcacatcagagttcaaaagtctactcagctagaaactttatacctatgtctatatatcgttaaatgtggctatgcctctcctgttttcatttacttatatcttgtataattcctcactctctcattctttgtttctccctgacttctatcatcattgatgttgttctttcagctatctaacttttttctcttaatattccattttaatcccctaattttcatcctacaaaccatattgttttctccttcagtgcattgcaagttctgtgagggagataataatgaccatgtaaccagcttttgcaatactgtacctgacaaatgatagattcccagtaaatcctactaaatgagaaatgagagaaaaatagaaaatctgaaatatgaagttcctttcctacattatctcttgaagtgtaaatctcactttgtaagttcttattttatctgggctaagttgggcccagaaattattttatttgaccataagtatactttagtgtctagcatcaccctatataaaaataataaaactatatctctacttcttgtaacactgatttataaatggtaagtaattcaagattatgtgtgtgaataatttaaagacatacttttagaagcagaacaaagcagaaagatgagtaattatatcctaatttcaggtttctttaatagtagccattcaagataatgtctgtgaaggactggctttctctgccaaacataaggatccaccaactgatctgctttttttttgcttttattatttttaattgacacataataattttacctatttatgtactagagtgagatattttgatacctatatatgatgtgtaatgatcaaatgagggtaattagcatacctatcacctcaaacatttatcatttctttgtgttgttttccaaatgtagttaactatggaaaaaaatcactatacatttattctgggcactttaaaataaagattgtatatatttaagttgtacaacatgatttgatataagtatgcattgtgtaatgattaccacaatcaaattaattaacacatccatttccacccatgctgtaccttggatccccagaccttgttcatcttctagctgaaagtttctattctttgactgacatttccccatttctttgcccctttcccagtcccgggtaaccactattctctctgctcctctgagttcaaacgtgaaatttcacatataagtgagattacatggcatttgcctttctgcgcttgacttacttcacttagcgtaatgttctccaggttcactcatgttgtcccaaatggcaaaatttcccttttttaaaaggctgaacagtatgtgtatatataccacattttcttttctttatccatttatccattggtggactcttaggttaattttacctcttgactattgtgaataattctgcaatgaacatggaagtgcagatatctcttccacatactacttcagtgtcctttggatatacccaaaagtaagattgctgacccatagggtagttttatacttttctttttatttttgaggaatcttcacaccattttccataatggctttacctgtttacattcccaccaacaatgtacaagtaattaattttcttcacacgctcgccaacacttgttatcacttctcattttggtaatagtcttcctaacatgtataatgtgatatctcattgtagatttgatttgcatatccctggtgattagtgatgttgagaacgttttcatataccttttggccatttgtaggtctgctttggaaaaatttctattcaggtcctttgcccactgtttaagaagattatttgttttctttttgccattgagttgtgtgagttcctgatacaatatggatattgaccctttatcacataaatggtcttcaaatagtttctaccatcccataagttgcctttcattttattgattctttcctttactgtgcaaaagctttttagtttgatttagctccacttgtttgtttttgcttttgttgctcaggctttggtatcgtattcaaaatattcattatgaataccaaggatattttcccctagattttcttctaggagctttatggttttagagcttacattaaagttgttaatccatttcaagttacttttgtatatggtataagggtccaattcttttgcatgctaatatccagttttctcatcaccatttattttcatttttattttgtttttggtcagaagatgtctttgtgcattttatttatttatttatttatttatttatttatttatttatttataaacttctattacaggcccagggggtacatgtgcaggcttgttacatggatgaattgcatgctgctcaggcttggtttacaaatgatcccatctcccaagttgtgagcatagacctgataagtagcttttcaaccctcgctccctgcaaccctcccacttctagtggtccccgttgtctcgtgttcccatcgttatgttcatgcgtactcagtgtttaactctcacttataagagagaacctgtggtatttggttttctgttcctgtgttaattcgcttaggataatggtctccagctgcatccatgctgctgcaaaggacacaggttgattctctttatggttgtttatcattccgtgaggtacatgtaccacattttctttatccagtccatgggcatctaggttgatttcatgtctttagtattgtgactagtgctgcaatgaacatattaatacatatgacttttggtagaatgatttattttccttcagatacatacccagtaatgggattgctggatagaatggcagttctgttttaacttctttaaaaaatctccaaactgctttccccagcaactgaactaatctacattcccacaaacagtttgtaacggttcccttttctctgcaaccttgccagaatctgttattttttgactttttaatactaaccattctgaatggtgtgaaatgatatctcattgtggctttgatgtgcatttatcaaataattagtgatgtaaagcattttaaaatatatttttggccccatgtatgtcttcttttcagaagtgtctgtctatattctttgctcccttttttaatgggtttatttgctttttgcttgcagaatcgtttaagttccttatagattttggatattagacttttgtcaaatgcatagtttgtgactattttctcccattctgtaggttgcctgtttactctcttgatactctctttcattgtgcagaagctctttaattaggttccacttgtcaagttttgttttgttgcaattggttttgggaagttataaattctttgccaaggctgatctccagaatggtgattcttaggttttcttctagaatttttatagttttaggctttacattcaaatcttcagtccatcttcagttgtttttggtatatagtgaaaggtgaaaggtaggggttcagtttcactcttctgcatgtggctagctagttatcacagcatcatttactgattagggattcctttccctattgctcatcattgttgactttgtcaaacatcagatgattgaaggtatttggctttatttctggtttctctattcttttccattgctgtgtgtgtctgtttttgctgttttggtttctgtagccttgtagtgtagtttgcagtcaggtgatgtgacaaatccagctttattttttttgcttagaatttctttggctattcagcctcctttttgctaccatatgaagttcagggtagtatatccagttctgtgaaaaatgatgtgtgtagtttgataggaatagcattgaatctgttggttgatttaggcagtatggcaattttaacaatattgattcttccaattcatgagcatgggatgcttttcatttctttgtatcatctatgatttcttcatcagtttttgtagttctctttgtagagatctttcatctccttggttagatctattccaaggtattttttctaggtatcatgcatgggatcatgttcttgatttggctctcagcttgaacattattgttgtatagaaatgctactgatttttatacattgattttgtaacctgaaattttcctgcagtcatttaccatttctaggagccctttgatggagtctagagttttctgggtatagaatcgtatcatctgcaaacagagataatttgacttcttatttttctatttggataccttttatttctttctcttacctgagtgctccggctaggaatttcagtaaagtgttgaataggagtggtgagagtgggcatcctcatcttgttacatctcttcagatgaatgcttccagcttccgctcattcagtacaatgttggctgtgaatttgtcgtagatggctgttagtattttgaggtatttttcttcagtgtctggtttgttgagggtttttatcatgaaaggatgttgaattttatcaaaagcattttctgcatctatttatcaaaagcatttctgcatcacataattttgttttaaattcagtttatgtggtgaatcacatttattgatttatgtatactaaaccatcactgcatcccaggaataaagcttacttaatcgtggcgaattagctttctgatgtgctgctggatttggtttgctagtattttggtgaggattttttaatctatgttcatcagggatattagcctgcagttttctttgttgttgttgttgttgttgttgttgtgtctttgttagattttggcatcagggtgatgctggcttcatagaatgagttagagaggagtccctcctgctctattttttcaattagtttcagtaggattggtaacagttcttcatacatctggtagaatttagctgtgaatccatctgatccagggctctttttggttggtaggtttttcattactgatgcaatttcagaacctgatattggtttgttcaggatttttttatttcttcctgactcagtcttgtgaggttgtgtgtttccagaaatttatttatttcctctaaagttttcagtctgtcccagcaccatttattggagacatcttttccccattgtgtattcttggtgcccttgtcaacgactagttgatgatgtctgcatagattccaggggtctacatgtctgttttatgccagcaacatactattttaattaatatagctttgttacagacaaagctatatcatcatcatcagaaaacatgatggttccagctttgttcttctttctcaaaattttttggctctttggagtcttttgttgtttcatatgatatttaggtttttttccatctgttaaaaatgccattggaattttaatggagattgcattgaatctgtagatggctttgagtagtatgaacattttaacagtactaattcttccaatccatgtacatgggatgtattttcatttatttgttgtcattagtttctagtgggaaattttataggatttaagtgccaaccatctatcaaatctctaatctattaagacaaccaaaattcaaaaataaagttcttcttatgattgtcaaaggtctcttaacatgaagacagaaatcatggatctactattaactcactttttaaaaatttggatgcttaaaaagagaaaaaaattattatactcttatggtaagatttaaatattcatagtgttatgttacctgcccttaagaattataaatctcgaaaatgcaagccaaacacaaataatattctatatataaatcaaagactgtcatgaagcttttaattggttagcgtttttaactacatggccttaagaaaacaggctatagtgcaaccagaaagaatacaagtaaaaaagtgtcaactaataagatagacatgagggtataagtagaaaaatccactttctacttcctaatcacatttcctatgtatggacttgtgttgttacaatatatcaaaatattctgatctgctttatgttggacaattattttttgagaaataatgatataaacacttgttagtcccataatttatgttctgagtttgacttgtagttatatgctttgtgcaaaggaatctgttgaatctactggacacatggagaacaacatttccaattgtagtctcatttgctgggttaagttttcctgtatcttcttggggaaaaaaaaaaaaacacgttggccttgggtgcatagtaatagaataagcattcatcaggagattgttatatatcacaaatggggttgagttgtcacaggtgacatctttaatttcctcaatttgagtgtaaaggcctagagaagttaattgttcagaactcataaatgacacagctgaaatctaactagattagccaagaaattaaaattattgagttaaatattcattcaatgtgtggctatatgtgagtgtgcttgcacacgcatgtgtgtgtgaatgttgaaatcagaagtatgacggtctcttgatccactgaaatgataagataaaagagtaaagaaatgtgtaacttcttgatggacatccaacttgcagtgaacaatgcaaaattttaaaaatttaaataaggctttaatctgccacagctctggtatttttgctagggttgcctttcctttttcctcacatacttgtgattaatgttttgatagacatattttgatagcttttaaaaagctacactttataatttgaaatgtgtgagaggtagctactgtgaaaacagttttagcttctttttttttttttttcctgacttgttggccttatcctgttaatcactgtttattctgagctgtaaggaaataatcaaagaatgcctagaagtcaagctcacatgggcatttttcattttggaaacttcaagaagctttgctatgtactgagtctataggcaaaacagaactacagctcttagtttgaattctcaacaaattttgcttccctgatatatcaaatatactttagagaactgtaatgccttttgcttgtttttatttttggtgtttttcctaaagagccccatgtactttatctttcattgtttttcttagaaaagaaacatgcactttaattcccaaagggcatctttgagaccttgtttatgatacagcaagtattttatatatgtatgtgtatgtgtatatatatatatatcttgctatatgtatataatatataatataatatatatatatcccttgcttgcaaaaaacagactcagtatagactgattttattatattatattccatctagtgtcagagtatctctaactaatgaaatttctcattaattaggtcttttcatgttactccctttatttctactgaaagtcaccatatttctagttaattcctggctataaagcatcatatgtgtttaaaagccctcaatgaagaaaatatttccctatgactttcatacaggctgctattttaaatgtcataattgcccacaacttgtcagttttgaaaaagcgttttagttttgagctgccaaatggaataaaaatgatgttattgacttgtaacaaagggactaaagcactctgatagcatctgaccttttatcatcacttatttaaagagctttcaggggaggaaaaaaaacctaccttaaaatgtgcagtaacttgctagtgaagtgctttttcttagtgtagtgagctgagaagagttctggaaaaaagcccagagggcatggttgtaaaaatgaccatttgctactggtgcagataataatttattccagtgaaagaaaagaaaaaactgtggtcacatatggcttcaggttttgattctttctatcttctactgactgctaacaataattaaaattttttagaaacaacctgatcaaggcctagaaaaccagtctccatcttcaatcaatagtggaggtcaggattaatttgttgttttaaaatgtggaaattactctctgtgtttgagagcagtatgtggcacctcttaactatatgacaaaaagggccttgaatttcactggatgtgtgtggcataaaggatatctatttggagagatttaatgggactgaaatagagggtaatggatactgaattggggtaatttatgttgtgcactgaagaagatatccagggaaacttcaaagacaatccctcctgcatgactaaaactgaaaaacatttcaaagctctctgcctcttacatgaaactaagtatcaatctattggtttcagaatttatatatttaaagattttgatacgagcaaaatggcatctatacagccatgtgagtgcctggcaagctaaagcacaagaacaaacatagttcagataacaggcaaagttatttcaggtggcttctaattcaccatgtgagaaagaatatgaacttgccaattatgaattacataggagggatcattttcttctgtagttgtaaaaatgaagatctcagtttccatacgatatagttcaatgaattttttttcaaatggcagcagttttaataagggacattccatgatctgagatatgattaggaatgtgtacaagtcatgttcattttagaatatttctcatcgtcctaacaacacaaattaaaatcagtatggctaactacttcatgtgttataatgtttgatgagttaaatctggggatctctgcttcacttcttgaaatgtataaatgccactaaaataaagggaaaataagcatggtaactgttaactggataatgtaatgttttcatgcttctcaagtagaactttctaaagtattttcaatagttttaagtgactataatattaaatataaaaaacattctccttttacctataatttaattagggggaaaaaaacagttccagagagatttcgcaatattaaggaagaaaaattcatcatggtgggtttaacctgttagaattgaggtagagctaaggaatcagaggaaagacactttgtacaaagtggagatttttttttccaattgtgtcagttatgtctcgtcatcattctttggaactgactgacatgcttcagcaatcatttttgacgttcaatacacatgagaattttgggctagaacaagaatcttttcttgaaaatatctacatgaactctgacaaacaatatactgcttaaaagagctgtactctgttactattctgcaggtatattaatttagagtatatttttaccataacacataacttctaaaattaaactccactgtaagataaaaattataatcaaagtgtgttgcttcctattctaagtagtattaggaaattatttacctgagatattgtgataaaagtatgctgcatttatactaattatccattcagtagcttcctccatagcccttataatgcatattctactgttataagcacaccaatatgaattcactggggcattatcactaccatacataaatcagacgaaatatttggtcattttgattatcttcaatgtttgtttgtttttgacaacaatattttagaatcacttcatctatacatactcaactcaaattttaagtggttatcttattaatagtggttaaagaaccatcactggggctaaagtccagtgtgtgggatcacattaaatcacttgcaatctatgtgaatttaaacaaggggcttgaatcttctgcatctttaaaaggaaacataaatcaaactcacctcataggtcaagaccacctacataaactgtgggctcaagaaaaaataaaaatgtagggcccttactcaaacatcatgaccaatttcaagttggcagtagcagagcattaatcactgatggcagagcttgaagccgagattggagctcttctaaacacagagccttgtgcaacccaccttggaagctgttgtgaagagtaagtttataaactgcttattagcacatattatgcactcaaaaataattttaacaattattttctacaaaatttttatttgaggtgctctggttataatatacttttttggaggagaggggaggaccttaacttaatctctgcattttggttttgttttgaaattttaaatagtatttttaaaaaccccttagtgagtttgatatgcagccaaggttgaaaaaatcatcagatatttaactaaattacttctcactgactctgtactgtatcttttatatttatacaatatataaaataccagtcatagattgattttatttacccagttacaataatagaatggggagggaattatgaaagtaactaaaatgacttggatgattcaaaggttaataaaggtttattgtccttaaggaaataataacctacagctcaaaatgtaattgaaagcctcttactgcaaattcacttaggggtgcttgttaaaatttcagatgttttggacttagcctgacctactgaatcagaatcttgaggtgggatggagagggaagaacatgtgttttgtcaagcccctctctttaacatatgcttggaaatttgagagccttggtttaatattacaatgcctacttgtcacagctattcttccctgaagcaaatttaacagccaagactgtagtaccctaattaacattgctgttcacctggtgtctataactcactgtgtagcatagggcctgagaggaataaaaaagctgctccgatttttttcccttgctttactggcaaggtcaaccctcattttagttattgaaatagtataatttcttctctagtctgttaaagatgactattctgaaatatatgaaaattcctatttttatatccccttgtccattttgtaatatttataatactctctctgtctatatattttcctctgtacttagatcttacataaaaggctaatcacacataataataaacatgaaaaacatatggttattattctttgccattttttttggttttaaccttaggactatttctttgtactagctactctgctgcctacgatagagagctcaatgagtgcacattgcaattggtgtacttcttacctcaggcacacaatttagccttctatataattggcattcaggaagatgaggggaagtgggactgaaaaaggaaaggcagtcatatctcataattgcaaatatgaaagtcagggtcacccatttcatggtgagaaagaaaacatcaaaatcctatgtctttatattacttattcaggcaaatactgaatttagttaccacatgttagactaaataaatggctatgtattctttacagatcttataaaatagttcattcagtaaaaaagaaccattttatcattgccatctgagagttccgaataattacgggtaataaaagaggaacaataagtgaaagcatcattttttggccatgtcttatttctcacagggacatgttcattaacgagaataaagattctactcagaattgtatactttaagtttctctttatttgatatataatttaccagttcactctccttcagcttttttctgtaattacttgaattttattcaacatgcgtccttttttgacagccatgttttttagttcaataaatgttatcaagcattctttgactgctcctattgcatcaactgtaattagcttttgattactgttaatttcacagcattttccctttaataagtacatcaaaatgctttcatttctgttgcagcaagtttaattagtttttgaaccatgtttctgtttttccttccatttttagaaaaaaatgacaacacctactttctttgtttctatgaggatatccatgacttacaatgtggtgttcaccaaaagcggtcacctaagacttacaatactaaattgtggtaacatgtagcctttttatttgcatcaagaatattctcatgtactcacatacttataattctgattatttaaaaaatattgtataattttactttcagcttttaaaggtgctaaatgatttatttaaaacaactaggattctaattgatccctcaattcaattaaataagctgattcacactccatgtattcaattatatgacacagaatacctgtattctcttttcagaaatccattgttcattttgtgttagtgaacccaactgttacttgcagtatcccttaggataaaatgctacaaggtatttttcagtggcctatatcataattaatgcaattttaacatgcaagatatatttatggctttttaattatatggatagaactttgaaaataattatataaatttatatgaaatgaaacattaactcttatttattcatgtgacttgaattgtaaactgggcatatgtagggacttaaaacttctaaataccaccaaaaagaaaacccaaaaaataagctgaaagtaactacatatcatatttattactactgaactcaaataccagtgattctaaattggtctatagtattcaatattataactcactttataagactgtaataattgaaataataatataataatcaatattacagaatgattggagggcagtggaagaaaagtaaatgcccaattagagaattgattatattcaatattatattataaactcttgataacatgaaacttttcagatagaaatttgacaatttcaaaacttaaaattgaatattacgggtaatggtatcctttaggtgaatatttaaaaacactttcagtgccaggctagaattacatatcaggtagcatggggaggtagaggagtagtgtaatataagagaggtagagaggagtcacgagcccagtgccttatgaatttagagtaccttgcttaaaaaagatgaaccctatattttaagaagcttaaagtttatttagtcctaccatctttctgatattactttcatttccatattattattctaaatgttctttcaaattttgtttactattcttgttagaggaaactccctatattcaaagggagtccacactgttttcagcttgtcctgaagtacttgttttaaactaaagtctgatagcttgtttctttcacccttgggttttaattctacccaaccaatccaggtttgtggctgttggggtggacgagtagtggacacaatatctgtagcacacataattaaggttcaaaaaacatatttctttggattaacagactttattcatacctatatagcaacaaatatgctatatagcaatgagatgcctgcatataacattattctttgtttaatatttaatattaaacagagaaacataaattttatcatatctttctgtgactgaatttcaaatgactgtaatttgtctaatttccttggtatgcctttattgagaatcccttataatattattaaaaacatttcagggcttgtgatttgtaaaattatagtttctgtcttgtaactaattttaatgtatttttattttctataacaaacccctttatcatgctcacattacttgtatgttatgcttttacatttaaaaaaattatttgctttaatgcataaattttccaatcctgcggctgctgcagaggttaaaaaagtctaccaagaaaacattcaccatgaactctcgtgattagtttctttgtgtattgctccagagtaaaacaaatcagcactagaaggaaaatctgttctgcgaggtcccacactgctggtctaatgacctatccccacaagaggattgaatagagtagatccactgtggcttcccaaatggctgaggctggcagcctctggagatgaggaacaacagctgaggtgatagagaaaataaaatgttctgcttgaatgcaagttatatttgcctgtcttcctcaaccctctttcaagaaatgttgccatttcagaccaggacagctgctatttttttcatttttagtttttcagtcaaagcttcatggaaaaactagacttggatcaatgagacttatcttcttgggccaattaatttcctgtccacagtctcttaaattcatctcaaatctaaacttccttcagaaagcttccctaccgatgaggtaacatcacatgtcttcttggcaaggttaggaagcagggaagccatatgtccacacccgcttccttctctgcagatctcatctaggattgaggataaagagagggtgtcccctatattttaattcaacttttcatctgtttattaaacttagtcttatgtctttctttcagttatcatgattttacccttactgttaacttcttataggagacatctatgtctcataaataattatattaaattcattagatattagattcataaattagtagatattatacacaaaagttatttagcattgattcctatacgttagagagcagattaaaaatatttaaaaagatacacaattgtggacatgcattcatataactgccagttacaggtaaaagcaaaacataaataaataattgtaattatatactagtagtacctatgtatattggcagaggaaatagaaaaaggaaaccgtataaccatgattaaatgtttagcattgtcatggctttggaagctgccatggtgcttagatacactagacacatcttttgaaaaatgcattttggaaaaacatggaataataactaagattctttcagttttgagattatatttagaatccatttatgaaattgaaaaatcttatttcatttagataatattttgctttctttgctgactttaagtgcatgggaatcaatagcagaaacatcgtcatctaaccccagccttagtaatgtatctttgtctttaagaatacggtctttctctctctctctttcctcctacccaaccccgccccccaaccttttctttctctctttagtggaaagttacaataggatatatggtgattctttaacttttatcattaagcaagatattaactacatatttcaaactttgtcttatattttttatttaaagtaaggtggaatacaaattttttctcaaataaatatttatatgaggttttgtaaccatcccattatgttgattttcaatagtaataaatatctaattcaatattctctcatcactttaattaaatgtgagtaaaacagaaataaaaatgttaattaactatatgtaagattatcattaatacatgtttaagctggcttttctccaagctcagcagtgcatttgaagatcacgttaatgctccaggtaaacaacagaagctaaaacaccaggagaaactctaatgcaaatatgttagacaatgttccaaatagacttgagcaagaatttctattataaatcttttcagaaagtgcagtttcatgtgagtgtatgtgtgtgtggggggggagcggttactaaaaaaacaaacctgatgctcttagtttagatattactagcacccagggagtgcagactgtttaagaattcgggttcggtagccaggctttacggatcggtcccagcaccacttcttcatagccgcatctcatctgataggggactgaagctttctaagctttagttttctcagctctccaatacagataataattttaataatatcttccttacagagttcttgagaagaatatgtgagataatccagctatcagagatttctgatctacagagaaccttttttcaatattatagaataatagataattagaaaagatcaccaaatttgtcatcatgaagaacaggttgggctcgatggactaagtttagagttctctatattttaccatactttgaattttttgttataatatttttttatttagttcttttggaataaaaacaaacccttttttaaaatgtgtttttaaaatatgtttaaatttccgtaggaaatatataaggcatatttgctgctgtagctttaaggggattgatacaggcacaatatatacccctaaaatgaagaaagaaacaatgaaaaggagagtaatgcattagaaacaaatgcaactttctgttcagtcatatttggaacaatataagtgcaacactttctgaagtaaatactcagttcatcagtgattaagatcatttgttcttcttatattgctatagataaaataaccatatttgaaaagcaagttccaaatgtatacctctaattgtgaatctagtctcctaataattcttgatattagtatattaataatacacacatgtataccatatgtaacgagtgtacacacacacacatattgcattcggagcagtcaggtcatcttaattaactggattctctggagttgacttttcttcttcagtctaattcctgtaaaaaaatgagctttagtccaggcgtggtggctcacacttgtaataccagcactttgggaggctggggtgggaggatacgttaaagcgaggagtttgagaccagcatgggcaacagagtgagatgcctatctttacaaaaatgaaaaaaaaaattagccaggcacgttggtatgcacatgtagtcctagctacttgggaggttaatacaaggaggttcacttgagcccaggagtttgaggctggagtgagccatgattgagccactgcacttcagcctgagtgacaaactgagacttagtcacaaaaaaaaaaaaaaaaaaagaagagcaaagaaaagaaaagaaaaacttgtaggcaccatctgatgtccaagcagtttattctggcatggctctcacaagacagatagcaggacaggctggtagcccgggccagtcacaagatagatagcaggacaggctgataggctgggccagattcagtcaggagtcagatgaccaactcacggggaaggtctccctccggagaccactctcagagtttggaagattccttctcctttcttgtaactatgttcaatccagatcacttaccagatgtttctttcatgaaggaagtttaagctattcctgtaaagttatgctttaagattcatgaagctttaagattgttcattcatgaacaatctctgtgctgaggtggcctcctccgtagggcaaccaaagtttttaggtctcattgtcataaagacatggtaatcccaggccagagttggaataccccaagttagattatgtcagattatatcatgtgctaagtggcacaggatgtaggcccagcgggatgtttgagtgggcctcaaggctatcattaatcctatatccacaatacgtgccttatagaatactacaacactatatgtaaatgagagatgataaaacaaatcttaagaaactctattaattttaacatggtgtttagaaatctgaatggaatatttggttttcttcagggaagctttggtggtggtggctctgagatttggtgctgtcctggtattgggctacactggtggccttgggttcatagtaaactcttaatgactatagagctggggttctactggggttggtggtgggtctgcctgggatattccaggacagaggaggattccaaataaaagaaagaaagcacaggccaatcttttcataggagagactcagagaagttctgcaaagccctttgaattctgaaatgttattactcttatgtattttagataaagtatcaaacttcagaacacacagggtcataagaatagaaggtttttactaatagagagattattgcatttttagtaaaaaaatgactatttggaatattttctagcgttgcatttaatatttctatttctaaatacttaatttagaaaagctaactttcatttatttgcttaatcattcagtcagtatatgatacatacccactgtcctctagaatgactgagcaacagagctgtatagaggaacacttgggaagaggtagattttttttgttgtttcaatttcttatatgccaattcctaactctccaagttggcgatatctagaacacatgggtttgcatgtcaggagtcaggttattcagaaaagacattgccaaaaatgctgagttttaagggtatgcaaatatttgcagttaagcaaaaattaaaatatatttcaagattaaggctatgtgtggtggcttacacctgtaatccccacactatgagaggctgaggcaggacaatcgcatgtagccaggagtttaagaccagcctaggtaacacagtcaaactctctctacagattaaaaaaatcagccgatgtggtggtgcatgcctgtagtcccaggtaattgggaggctgaggcaggaggattgtttgagcccaggagttcaagtctgcagtgagctatgatcatgccacagtactccagtctgcgtgacagagtaagataccatgtctaaataaataaattaaaatataagattttgcgtctattttttcctttggccattgagtgaatatgatgacaagcatagagccccaccaaaatgagtgtaggattaagatggtatctgcttaattggtaggactgctgaatttcactgccaaagcactatgaatcaatattatttgcaagtcacagtgttttccataccagcaccatgggcttcaagggaactactgatgtaatttagggcaaataccagtaatgatgttgacattagcagtgtgccaggctgttaataacttttgctctagtgtactaattcatacaccttatggatttgttagcatagtatcaccaacaaaatctagaacacactaagaggctttttatccacttaagtagcaaagtaaaacaaaacaaaaacaatgagtcatcaatgatatgttttccattaatttggtatctgcatgaatctcaaaaagtcaaccattttcaccatagtgatctaggtaagatttgctgggatcacataggaaatcagctacccggtgattagcacatggcaagatttcagaaaaatacggcatcagaattgaagctttaaagttttcaagtgcttcagatgggaaatgttaatttgtacaatggtggattttattacttaaaattacttaaattacttaatcttaaaaatgttcttggagaaataattacttaaaatgcaaaaatatctcctatcatttctattttaatgagctacatatttgctttagagtacctattagcacactagaagctgtcaaatcgttctcagaaagagtggaagaattggccaaacaaggatgtgggtataggcttctatcatattgttgacattaaagaaagccagaatcccttaaaaggcccattaatggataagcaattatatttttaattaatttagggctataactctgaggaaggtaaagtttagattatcaattatttgctactcagagatataaatatgcttttatctactgccgtccttggctgaaccagttctagccacctatttttttctagtcttgtattaggatgtcttatgttacttaatttattagttatttgataaaaataaatcatataactgccaccttgtttaattttctgtatggaattaatacattttttatcattcgatagtcaattttctttttatactcataatttttttaattaatgttgattgtttctcttatgaaacatttttctcattgcatattagctattacctaatgaactatctggattggctgggggagttagtaaaaactgagtagatcagcaagaaaatgtatttatctcagataattcttccattacaacttaaaaaatgtatatttttagtatatgcaccaattatcaataattgctatctcagtattggattcatcatatctcatccccaatcttaaaggacaaaaggttagggtgtgattttattattttccttatttctcctattatattttaaaatgtatatttagctggatgcatttcatgtttctcttagtagtatgcaatataacattttgagaaggagataattaaaccataaaataatcaaaatttaaaaaagtgaaaaacctgaatttgatttttcagtgagtttgatgagttgtgcaaaaactaatttaagataattgtgttaatgcaataaaatatttattataactgcattttattttctggcaatctttaagttactacctgtgttagtacatggttcactttggtttgagttcttaactttcagtcataataaaaaatacagtaaatcttatttttactattttttctaaataatgcttttaaatgatttttccctgaacccgaatttaagaaacgcatacaacagaataactggaataaattatggataaatatttcctttggttttatttaatgaacaacttcatgttactgactacatgtcaggcactggtctacttcatttcatcacaaacaaactagaaacagatttttttttagtctgtattacagatgaaaaaaattgaggctacgacaaatttaaatacttttactaaattgacacatctgaacaaattggcagattcaagacatgaatccgggcagtctatacttctcatattccaataagtaaaaactattcacatggcccaaagagatgaaaaggaactgtgggatgatatttctctgggccagtgcttcctacagacagttccagagaatggcagaaggaacctggattccaggaggacagcaagccacctctgtcacagttgtgttacataaatgtgagccaaattcgtatttatacacaggaaatgctattggccagttcactgattactgtcagtcttagtaatattatgaaaagtcagtaagattatatactttcttagaactgtattgtttcaacaataataacctcatgatgttctccatttgaacaaatactgttatcttaggaatcgtatatatgctactgtttactgaattagctatttctattttctgaagaattttagcccaaaatgaattactctaaataaaaaccaccattcttttctcttgtaaaacatatctggaatttcaaaataaccttttcccaaaaaatacttctagcttcagaatttggcaaaagtcacgcctaatttaacatcgtgaatgtaacacaattacatttttattttattagaaataaactgttaaaacagctttctgtgttatttatctgcctagcttatcatgaacaccacattttgagtattaatcatcatatataagccacgcctggtgtttagcaccagaatttccaaggtagggagattatttatttgtttgtttttcttcttattgtggaatattttggggcttgactttaatagccatactctggggtaggatgtgttcaaatttagtaaatgctagatttaaaagtacaatgaataaattagatgtagtgcttctcagagactttgctctcaaaaactcttgcaaacagagtattaccaagaaaatgatttaacaggcagatgttaaagtttgggacacactaatttacaccgatataactgaaggtatttttaattcaggataccgtaaagaactgttaagaataaaagaattggtaaaaaggaatgaaaacttagtatattttactcttcgttaactcaatacttctcaaatgttttcaggtcttgacacagatagaaaatgacaatatttatatggcagcaaactagtgtaaataaataaggttgcttgtggctggaaactataggtccagcggctctatctgccttaaaagggccgaaaggattattatcactgtgcctgccagttacggcaaaacaagttatggtacataaaaaaccaaggcaaacttgatcagtgtggctacctaactgctctctgttctggtctgttgcaattcttttttttttttttttttttttttttttgagacagagtctcgctccgtcgcccaggctggagagcagtggcgcgatctcggctcactgcaagctccgcctcccgggttcacaccattctcctgcctcagcctcctgagtaggtgggactacaggcgcccgccaccacgctcggataattttttgtatttttttttagtagagacggggtttcaccatgtttgcaaggatggtctggatttcctgacctcctgatccgcccgcctcggcctcccaaagtgctgggattacaggcgtgagccaccgcacccagcctcaattcttgtcataagacgttcctttctctttgtggattggagtattctgtactctatgcctgtgtgtgggtatctgttatctctgagttattcctgtttgcataaagttcttactgttgcatcttcgaatgctgaagggtttattttataagtttaatcttagtgttttgagtaagctttgtgaaagcaaagatttcttccaatatgttttgtgcgtggttggttgcctgtaaatggaatatagtcactctgtcttgctaatctgagtttttgcagtcctttactggatgccgagacctctagcacactgtagcaatgggagggacattcaaaattattttgggaggaagggtcttatttattatttgatccagttgagagtagtcctctcttgcacataaatttagatacatggcacttccaatgcaaccctcaaagtctttcccccactataaacttttgagtcattttatgccccaaatcttacaggacacactaaaacattttaattgtgtagtttaaaataaacatatgcttttgaatatgttttgcaagaaaatttataattaaatgagctatttcctgtttaaatttagaggctagaggacagttgtgacattttacaattgtttctcatgattaattgaaataagcataagaaggtgaagatctttccagctgtgaattctctgtcagagtgatttttcctaaattgctcacagttgttctactatttgtcttttcatgtaaaatcactttacaaacaagggtgaaagtccagccacttttaatgtttgaggtctgtaaaacaattcaaatctcctcttaggaaccagaacactttttaggaccagattttgtatcactttttaaaatacaaagaaaataaaaatgtttttattgtattattccagttactttatcatttttcatgaatttaagtccgagaataagcacagcttaatataaatttactgaaatcagttttctactatcaaacactttgtcatactagatactatagtgtgtatgttggtgtctcttcaaaattacatttaactgagaccagaaaactacataacagctaaactcagcagagtagtggcagatgggatattcagaactagacagaatctagagagattttagaagtagaatctatagatctatgtatataagaaatgaagaaaagaaagacaccaaagattttcatcttgaacaacttaggtgatggggatgctatttggtgagttaatgaagaatgaaggagaacaaatgtgtgtgggaagggtttgggtggagaggaggttgagtaattaagtggtttatgttaactgtttcttaagtttgagattcttgtaatataactacatggcaattttatgtacctacatggatctggaggtctgaggcttatccgtattactgcaaatgcctttaaaataactgttctttccatccacatataatttttctaatctgtaatgagttggattttcatttattctgtacagagagtactaagtatttactgcatgtttactttttaaatataccatctatatgctacttggcccctctacactgctttcttggaaataaaatactgtgcctataactgctccaagtacataataggcactcaataaatgtttgttccatgaatgcatgaattaatagataagtggattagagactttaatgagatgtgtatatttgtttttttctctctccagaagactgatagctggtagcaaagatcttgtcttaatcttctttcagatcctttaagatgtgtaacactctagtggacattaaataaatactcattgattcatgggtattaaagtgagacacactggttgagttgaatagttccacaatctgtcttcaaaaaagtcatgaattttactttatttttaaacatttaacaggaaatattgagagaaagaaaaaaatgtatcagtatacaaggatggagacaagaatatacacaaatgtgaagacactgtaaatctagaaacataattttagaggttaaagccaaagaaaagagacatgcaaaacattttataactaaattgtattttgcaactctttttagctaaaatttaattatcatcatactttgcacatatttgaacagaacctatacactttgaattatacttatttgcttacagatgatttactctttctgggaagttcactccttgtagccccatcatctaactcagcacctggcatacaacattcaatcaataaattttctgctgaatcaattaatggatgtaaactgctgataattattctcttttgatctaaaaagtttgtcatttagataaaatgtatgtttaaatatttactttaaaacgaataaaaatatagtatttaaaacttaagcataaatccctggatataggtagcaactattaaaaccacagctgggacagtgatttaaacaatctttcttaaaaaaattctttccctgccagcattgtcattagaacattagcagtaattaaaaccataagtagaagttctagatgactgagcagctgagaaagagcaattaaacatcatagacagaaagaaatttacattttctacataaccattgtatatatattaaaagaggcattagaaaccaaggggtggggggaagcaacaaaaacaacaacaacaacaacacaaatagaagaagaagggggacagatcatctaagaaataataatagtgaatagaatatttatgtattttaagtatttcagtttttaagtttttaaacatccaaaattataggcgattaagcaaagattatgtcaaagccttaaatgtatcaaattataaaataaactaataattatcttaccttggtttattaaattgctagaatgtcataattaaaatggccatgacatgcatgtttactttcctttaataccacttataaatttgtaatacttcgaaaaagagaaagtgagccacttagtgaaatatgaaatgcttcttaaataaaaccaaaactagaaacttccatgagatgaaaaaaaaaaaatacttgtgtaattgtttaagagaaatcatgagaaaataaacaatagtttatttagatctctttaatagaaaatttaaaaagaaggaaactaaaataatatataaatgttattagtaatcaaaatagtgcagtgcttgaagttccactttaggaaaaggcagaatagaattttctgggtcattactaaagggctaactttttcatgagctaacctacttcttatatttagtagaggtttaggtgtataaatataaaagatatggtcctgagctttgtggtgatgtaatgatgagccagcgcatattaaaaactttacagcttagtaaaggagacagatgcatacgtggtcagctgactccagaactccctcttttccaggatatagtaagacatgatgttattttatagataaacttttttaaaaactaaaaaccactgtagaaagtacttacttgcttatttatcctggccattcagtaagtagatagcagactggaattctttcactgtattccacaaccactctaaaagtgcttataaaaataatgtgggtgttctaaatcccatttgactcagcaatcccactactgggtatatacccaaaggattatatttcattctactataaagacacatgcactcgtatgtttactgcagcactgttcacaatagcaaagacttggaaccaacccaaatgcccatcaatgatagactggataaagaaaatgtggcacatatacaccatggaatactatgcagccataaaaaaggatgaattcatgtcctttgcagggacattgattaatctggaaaccataattctcagcaaactaacagaggagcagaaaaccaaacaccaaatgttctcactcataagtgggagttgaacaaagagaacgcatggacacatggaggggaacatcacacaccagggcctgtcaggggttgggggtcaaggggagggatagcgttaggagaaatacctgatgtagatgacgagttgatgggtgcagcaaaccatatatagcatgtgtatacctatgtaacaagcctgcacgttctgcatatgtatcccagaacttaaagtataataaaacaaatttaaaaaccacacaaaaaaataatgcgggtatgtgtgtcatgtctctaactcagatctccacctgtcctccttgtttattttccatttaacaacctaaatgagaataccttagtaactctccacattggcccagaatattctacttttgaatgcattatgtagaatttactgacttattccatagtaagaaggagaagtttccaccttatgcccacaggaatctttttatcagacctcatcaaaggtctcttgccttccatgacaccccaagagattttcaactgattttcaggctcctcttccctcttcctacaacatcctttcctccactctccagaactacacagttttgtcccatctgttaccttcctatcccactcaatttgctgcccaacaaacaaagtggccggcaatgagcaagaaacaccctcactagaacacagtaaaatcagcacctattgctctcaagcttgtcctttggtctgtctcctcaccccaagccaccctctaaactatttcttgagggtaccatgcactgcccttcagaggagcctaacaaataaaatatgcatgtcattacacactcatgacgctgctcttcccttgttaattaaacatttcacattaaattccagcaggttctaatccagtgatatgtcatatagattttcaatcttccctttttgacataatgtgagatttattcaagacggttttacaaagtattatttatttcagtaaaaatgtcaagaattgtttatttttatatatttatatttatatatatataaaaaacatatatatatataaaacatatatatatatataaaacatatatatatatatatatattttgagacggagtttcgcactgttgcctaggctggagtgcagtggcattatctcagctcactgcaagctccgcctcctgggttcatgccattctcctgcctcagcctcctgtgtagctgggactacaggtgcctgccaccatgcctggctaattgtttgtatttttagtagagacggggtttcactgtgttagccaggatggtctcgatctcctgacctcgtgatcagcctgcctcggcctccgaaagtgctgggattacaggcgtgagccaccatgcccggccaaaaaatattttaatcttaactaattatacgctttttgcaggttaattaagatggaaatcaatgcagcattgcattagttcatactcgttatttaatttcctgaccctcttctacatttcttggaactgcacccttccatttatagcaatgaagagattcttctttttgctagagtttagtggttattggcagtaaggcagtataaagcttgtgtagttccacttaggtagatattataaacatagcgtatttattctactgtataacttaaaatagcatatttattctactatatagcttattagtttactactgcataaatattttaggtttattcctttgagaaatctatgttaatctattttatctctatttaagtgctgaaccacacattcaataattgttttaaaggaaaatagcacatattttgttaagtactctgtactttttcataacggatctattggattttggccagtttctctaaacctgctgtaagcatgacttatttaattacctaagttgattgaacacttttcccttagcaatagattatctcaaactatatgctacccaatttttcttcagaagcatcataggctatttaatattttcttttctttgtgttctatactgttaaattactatcagaaatatggtcaaggattacaggcatcaatatattatgcttaataatgaattgtttggaaatggtaaaatgcaaaatgatctaatttagagtttgatattaaataatatgttgaaaaatgttcaattgaattaactcttggtaccattttctgaaatacaaaatgaagaattatcccattgtgcttgtctatataagtatagtaaaaacaaaaacttgcctaaaaatcacatttaagataaataaagagtcactgcttaggaaattaagtaaaaagttattttctcccattttgtgtcggggtaggatgggcaaatcagcattgtgagataaaccatgcaaaacattttctgaaggatgttgtcttggttcagtctaccataacaaagtgtcagaaactaatttacttacaagcaacagagatttatttatttcttttgaagtttggagtttaaaatcagggcaacagcatagttgggttctagtgatgttctctttcaggttgtagaccactgttttttcattatatcctcacattgcacaaaaagggtgagataactctctgaggtctcttttataagggtgctaatcccattcataagggttccactctaatcacctaaaggccctacttcctaataccatcacattaggaggctgggatttcaacatatggcttttggacagaatgaaacattcagttcactgtagaggttgaggtcaaagatgggtcaaaataaacaagctaagggaccacatgccagggagtcaagatactagtcaaaatgtcccaatagccctaggaaatacctagggaatcttgggtttaacagggaaggtttagagaatacttatggcagagtcctccgtgcctaccataaactctttttatcctctttgtgtatttgtttatttatttagagatagagtctcactctgttgctcaggctggagtgcagtggtgccgtcatagctcactgtatcctggaacacctgggctcaagtgatcctcccacctcagcctcccaaagtgttgggtaactcccaggctcactgtgtaggtgttcttggttcatttaaagggacaggcagaacaaattggtggtaagagagtgcagttggttcttataatagctgtttccacaaacttagatcttagcacttaacactatttttatgagaagctgttggtgtcattgttttctttatcattaaaatagttcaaatttaattgaattgaatttttaccaccatcagcagtgcagattaaaaagaaaaacagaataaacatctttgtttactaacaatttcattgccatccagagcaaaacaaaacaaaaatctaattttaattcccttattttgggtgactgcaggtaatgagttaccaggggaatataataataagctgactattgaccctaccattaactttcagtcctaatcattttacttagttttgtgttagcagtggagacaaatctgacaactcattgatgtgaagtaaacatgttttggctgtaaaattgtagtatgaagcctcacacaatatctctgcctttagctatgggacggtctagtgtcttttactaaaagtgaaatattctgataagttgtgatagcatatgcttaactgctaatgaataggatctctgtgacttgatatcacatttgatgaaacatgttaaaagatagattgttcattaacccttgaggaattataactttgtttatccgattatattacatttaacacaattttcttgttataaaatgccatctgaacatccattatcattcagacacaagcacttcagtgagaaaactaatgggcttaaattactaaaagttgatggctttctaaagtaaactaacattgcagattacttttgcaaaatatataaagcagtttctttcgagcccataacaggaaaaaagaaaatgagaaaaactgaattcaactcacatgtctcattcacatattttacttgtatactgcccggaggaagcccagatggctgaaatgttggcaggtttctgcacctgcaatgataataaactactcctctattacctgaagtacgtgagttgaatacaattacactttactcactgctatatgcactggcaggtcaacagtttatattgtatttttataggattggcaaatgcatgttgctgggctttgctgaattcacttttagcaatagaatgccaaaggccactaaagcacctacatgctgacacattaatcatgtgccaaagcttagcttggagtggcttattgctaccatgatatatagaaaaaaagtaacaaaacagcctatatgatagtttagtaaacaaatggatgctcctgagatcccaaatgagtgagcttaactcagtgtgagctataatttttaataccttcaaacaagagaagatatttgaaggactcagccacaaaccttttcattttgtgacattttttacaaaacattctcattgtatactatttgagaagtatagaaatgatgaaaaagtaataaacgttattcacaacccattactcacacactaaccctattgtcattttagtatttctttctgtatgtaaacataactggaaatatatacaagctaccttgtgcttttcttttttttgtcttttttttttttttttttttttttttgagacggagtctcactgtcacccaggctggagtgcagtggtgcgatcttggctcactgcaacctctgcctcccgggttcaagcgattctcctgcctcagcctcttaagtagctaggactacaggcatgcgtcaccacgccaggctaattttttgtatttttaatagagacgaggtttcaccatgttggccaggctggcctcaaactccagacctcaagtgagccacctgtcttggcgtcccaaagtgctgggattacaggcatgagccactgtgcctggcccatcctgtgcttttctaagtgatgtaatcattttcctatgtgattaaacatttctgcaaattcctctcactagacactcatcctccaccctcaaacactatcactttgttgactcttagtcttccttctccaaatctaatttcggtcaatactgtctcaggagtgcttttcctaactttccttgctagggcagtacctacctgtattaattgccctcacagtaccttaaaacatttcctttgttctccttatgtcagtctttatgttgttctcattcgcaaaaatttttgaaagaaaaatcgtagaattttggttggaattttgacaaacttataaattaattaaagaaatactgttctatttatattaattgtttctattccataagtggatttttcatcattctccttgaagtgagattttttcccatttccatttaatacactcatgttaaattttgaaaacataacctattcttatttttgttaatatttgagtcgatcttttacctattatatctttagctcatttcagttgttatattgtgagcctgtgacatctatatataatttattttgaagtgtagaaacatgattgaacattatataattttaaaagatttattacatattcatggatactatttacatacttagtagcaaatccattcattcattcaaaaatattccttggttacttattttgtgccacacactcttacggacataggaggcacagaaggaaacaaaaacaacaaaaatcctgtattacatggaggctacagactattgaagggaacatataataagataaataataggtaatatgtatttacattatgttatctggtgatctgctatatggagggaaaaaaaacaagaaagaggaataaggtaatttgatgggaatttcaatactaaatttagtgtctttgtcctatttgtgctgctataacaaaatttaaactgagtggcttataaacaacggaagtttatttctcacagttctggaggctggcaagtccaagatcaagttccagtctctggtgagggcctgctttctggtgcatagatagcaccatcttcttgtgtagagaggtagagagaacagagttttttagggtctattagggcatgaattccattcacgaaagctctgatcttatgactgaatcctagctccaaaagtcatcctttccttattccatcaccttgggagttagggtttccacatatgaaatttggaggaagggggacacaaacattcagactataacaatcagggtggtcagatgagtcttaaaggaagtgagaaagccgattttgtggattatcaggggtgaaagcaccacaaaatgaagtacacacactctgaggtgcgaatatagcttctgtcatctaggaacagcatcaaggccaatgtgtctgaagcagagtgagctagggggacagcagtgtgacatgaggtcacagaagtgatgggaagaaagaggcaaattgtgcccagtgcagtggatcactataagaatattggggttttcagtgagcaggacaggaggtcattgaaagtgtctgagcataagctagtttttggcaggatcactctggctgttgcgttgagaatagactatagaaggtaaccagaaaggtcagttaggagtctcaaaaatccaggtgagaaatacttgtggcttgaagtatggtgttaggagtataggtagtgagaaatgcttttcagtctatttccaattacatatcaggaatttgtaatttgtaattcctgatatgtaactggaaatagacctaaaagcatttgttaactgttagatgtaggatttgagagaaagataagagttaagaatgactttctggtttatggcttgagaaaggatgaagttgacataaaatggagtgggaaaatttcaggaggagaaattcaagaaggaaaatcaggaaattctgttttaaacatgttaaattggagatgactgttatgcatgcaactggagatgtggagtgagcagttgtgtacatcccctggaggtcagggggtaggtataggctgcagatacaaatttttgataaaaaagttatataatcttaaacatattagcttatattttaatcagtggatatttgttgatggtgatagtaataagagaaattcaatgtaacaaatatttatttgtcaggtgctaagatataatgattaataagacacatatggttcttggcctcatccaaattaaaatatatgggggtggatagaatattttgcattttttataatttatatttcttttaataagataaagcattcaaagctaataatatcataaattaataaaaaataacttaaaagaaaatttaatataatatgtcctgatatattaccaaaaacatgtattcaccttcatcacttacctcatattgacatcccttccatcctttcattcaatctactccatgctacacaattgcaataatttttattaataaatatcgtgaataaaaaattatttatgtaagttattcttgcttctcagagctattttcactaaggtcagataaatcactttgatcataattctgtgtattttattctcaaaactttctttagctaatgatgtctcatgttacatcaatgaattcactttcaccattttacttagcagtatgacactgaccattttggtcctctcaattaggatatttcttattctccttttaattacttcactgctatttatttctgagtgcttatcaagaaaatataattttataataacttaataagaggagtagaatctctctaactagatgattctaagcagtttggtatcctttatgttgtatacttttcatagaccattgaaatgaaaatcttaggaaaagtttttgaattacaagaattgaattatatttccagaatatttctgagcttgtgccaacgtagtctacattgtgagcaatggtgacaatattagttccccaaatgaaaacaacataaatttatattaatgtttattttatccagggtaatcatagtaacacattttttggcattattaattttaattaacctgttaattgccacatataaatgataccaaattttttctttctataaaatgcatatgagccaaactactcttactagattattttgactataagatgaaatgtatagttaacatggagtgacatgtttagtaacccaggtaaggtatcagaatggcttggtccatagtgaaagcagcagaggcagtgataggtggtgaatttgaatgttgattatacagttgctagtattggatgatgtcttttctagtgattgaaaaaatggaggcataagaacaactcaaatttttttttacctgaaagactagatgacagagttattcactgagatgtggaagactgaaagagctggttaggagaggaaatgttatcaagaactctgcttcagacatgctaattctgaactgcttattaggtattcagtagaggtgtcaagtcagttaaatgtatgggtaatgggttgagaaataggtatagtctggagacataaatataggcattgtcagcatattgatggccttgaatgactaagataagatgaaagcattttataagcaggtgataggcatgaataggggagtagagtgaattctgtttaactcacatgtggtctttgtaagtgaggagatgaggaagttgaaagggaatgtaagggattgctatggttggaatgtcccctccaaaatcatgtggttatttaattgccaatgtcattgcattgggagataaggcctttaagaggtgattgccaatgtcactgcattgggagatgaggcctttaagaggtgactgccaatgtaattgcattgggagatgaggcctttaagaggtgattaagtcatgagggctctgccctcttgaatggattaatgcccttattacaggagtgggttaattactgcaggagtttggttctctttttctctctgtctcacacacttgcttgtccttctgctcttctgccccaggataatgcagcacaaggccttcagcagacactagcactttgatgttagacttctcagtatccagtaccatgagccaaatacatcattttctctataaattacccagcctgcagtattctgttatagtagcgaaaaatgattgaaacagaaagtgatcttggtcacaaatgtgccaccaaaaacccctaaacagcacttgataatacatatttgctcaatggatcatgaaatctaagccaaataaaatcagaaaagaggacttgtgaggcttgaatgacaatgaaagtgtagtagcatctaagaatgaaatgttctggttgcatttgagtcccagagagagtggactggagacgtgggagttggtggtcagcaagtagcatgtgtggaatatggaagggctgcgtgtattggttatgaaaacgtgaagagcacacccacagagtgactgagaaagggtagagactgggatcttaggacgagagtccaggaactaggagaatgatgggaatgatcatctgcatgaaaagtaaaaccaccagttcctttttcttccaagttttataagagttttatcatgattgttattaattttataaaatacttttatgccttctttaagatagttataagcttttcctccttcattttgttagtatgtcaaaatgcattgattactttttctgtaattataaacaccttgcattactggactaaacccaaatcagcaggaatgaattactttttatttacatcaacggattcagtttgctaaatattttgattagtattctttgcatttatctttatgaggaatttgcctgtaactttcccttcttaagtatttcttcagttttgggaaatttacagcaattatttattgaaatgatactactacaccattccattatgctggatttactcttatctatatgtactggaggctgtcagcttagcctctggttgctcaactattgtcctatttgtaacatatctttgtctttttgagtgatttgctagtaaattcctcaacaacagcaacaaatttagtaattccaagtacagttcaagtgactgtactttctaatactatttaaaattacttctttacatattgacctttttaaatttgttttataatttcttactttatgtcaatggaaattattccttcgtttatcactggaagcatcttaaacacactttagattatttatgtaactgatacaaaatattattttttatgcaattttctttgaatattccttggaagctagaattttcttctttttgctatcttttttctagcctttctcctttttattccaactctcacttcccatctctgtattcactcttccagtcttgaggttgaacattatcttaatctctctagtcacttaactccctgggctcccagcccagaaccactttttaaatcaagacattttaggcagggcactgtgatccagttagagaggcagtttggtcagttcttgtttataaggctgtgtctgtgttctcactgctacaggcctgcaagctgtttgaagccacagcccaggtggtgtgaatttttattcttagcttacttcaaagaactggagaggcttactccaggccctggcttcaagaactttctatgcctgctcctgtctctgtctgggagcactgaagtctctttcactccctcggaacaaacttaagacctgcaactaagcagacctgtagttttcattgtatttgcttcttctctgcttactttatttatttaaaagattggtcctccaaataaaatgtgtgtatgttgctttttccttcatatttttattattatatgtttgcaaagaaagcatggagcaaaaatatgaactcctgcacccacttatgaggaaatcctgatacatctgaatcagtttttcttgatggaatgagtgtttattagtaaaatacgaaacggaataaaaacaaataaatacttagtgcactgcactgacattttcaggagaaacatttttgaaaattttacatgtggaaaaaaagtttatttctgcaaatgataatatgactgtaaaatttttgaaaagcttataaccatctctgtatttttatgagcctaaactgtgattgaagctgtgttaagtcacagctggtagttaagctgtgagagggacgcagataaatgcacgatactacttttacggaacttaaactacaatagatacaatattatcacagaaaactataataaatcatagacatggataaacctgaaatgagatctatatttaaagaatttcaagaaatatgacatttcagtgagagtggaaagcaacattttcgtgcaaaactatgagatagatagcctttcaaaataaatagaattttggaactgggaggtttgtagctaggacactatgaacagagggagctgtaagaagagaaaccccacttgggaggctgaggcaggagaaacacttgaacccaggagacagaggttgcagtgagcccacatggcgccattgcactcttctgggcgacagagtgagagtccatcttaaaaaataataataataatgatagaagaaaaaccccgaagtggacaaattttgcttgcctaccagtaattactaacattttactaagaaaggtaaaataagtgtaggtggcaagagatcagcatatatttgtgcatgctgaaatgctattagcttttctggacctacccaccctgttaactgagtccatcttttcttttattggagctaatttttgacatttaaaatccttctgcaggtttcagtcactcactggcctaactccatattcaaagtttctagaacagttttcttgattcattggagtcttatttaattacattccttccatagccctgatttgtgaattttatgccatattattattcacttgttttcatgttgttttgcaattatcacctacgtattttatatctgtacgtttagtctccttcaaataaattgcaagctcttaaaaatcagtacaggcactttgtacttctttggaacttcctctatacatattcagtgttttgaaggaatgttttaattaataatttatgtatttgaaaaaaatatatattataaaaaagaattcaattttacgtgttcttctggtttttttctccatttgtccccattattctctttctactttcaccatgactgccctactctctctctatctgaacacataaatatttattgtacatatacatacacacatacgcaaacacacatataacacatacacacatgcacaaacgtgcattcatgctatacagatagtatattaagaagtagtcatttcttataggttcaagtgtgtgcaattttttaacaggataagttctagtagaatgaataacagcatgaatttcacaaattatgaaaaaagtagtcatttctaagagggataatatataacatttagtataatcatactataaattcccttattattatttttaggcaaagacaacatcttagaaagttagagaagtaaagcatctttaaaaccctcaagatagtacttttatgtatgtgtaaaacgtaacaactgtatgtctaagacagtgtctatgtctacttgccgtcaatcaccttccttcttttattagtttgagatagaagataaacaacaagactgacagttttgtgtcctttgctgttttgtgtcaccatcacagacaaaacagtattatgtcatcactcaagtctgtcacatttattgtgtgctcctatatgtcttaaagactgttttcttcctaatcctcataaataaatatataaagaatatattgattgtatattattttatcgtggaaatatttcccataatattatgacctctaccacagatgagaacatttatgctgttgccagtctcaaaagtaaatgtattttgtttgaaaggaatgtttcttagataaacaataaatattttaaaaagaatttatttttcaaaatatggagaagctgtaatgaatatctacatctgtgtaatatgtaaatcaagcatagtgaatgttattattttatcataagaacttaagcatttagtgctacaagaagaaatactttgaaaatttttaaattatgcttattttatgggccgtttaaatagcattgtacacttcttcagaaaattggtatctgatcttgaatagtgataaaaacagtgaatcggcaagtataagaagaccttcacgtgattgatataatcaccacttccttttcctttttcttgtattttctggagcctcatctatttccaccttgccttactttcacattttaaaatgagatcttaggccacgtttcttgctaaaacacagtctaaacaagtgaatcagctctacagcttcaaatagtcaatttcaatagtaccttattattaaggtaccaacaatataatttgtgatttttattttatatcttctcagtgtaacattttaaaaatagatagatgtaattaacttagctgataaaaatttaaaaattcagaaaagctcaaagaagcaagaaaagagtcccaaatttcatcaatccgttagatacattttctattttattatagaatagataccatattgaacattttattttacatccttctgttctattttcaattaaagttgtattattttcctattataaaagttttcaggcttataatatgaaagctttctaatgttccattaaaattataatgttggatatttatttatacttttgcattattataaatctatgatgacagttttcttcatacaaattttggttaaaacagaaacgactttcactagaatgatgagagcacatcaattcttacctataattgacagcctgttatcttgattgcctaatgaatttcttaggtaaataggtaatatttttctgaggccttgaatgtctaacgattttctattgcaatatcatgtggaagataaattggttggttatgaaatttttgtcctcaaagttgtgatgaaattactcctttgtttttgagatttaataactattctaatgaaaacacaagtgacttttagccacagaaattatgctactaatatgccttcaattctgttgtcatagtgttatttttctcaataatttgtgtttgtgtgtaatctttcccttctcttgtatgtactaccttatcttctgctttctgagctatctcaagttggttaacgaaatcattgtttccattttgcactgcatttacatagctttgactgctttgagtttggacttgaattcttttgcacctttatcttcatctccatttttaattggatcgtttattgtaatatttcagattaatttttctatgtgtctttctgcttttttattggagtttatatcttcttacagcatattgaggatttaaacatttttattatatttttctgtttttttgtagcaaattctatagtaatattttaagaatgatatcccttttatgataaattgtatttttcatgcttcccatttactttttatttaattcatttttgtctgttatggtaatgctaacctcactagttcagctaactcgacagaagctctactaacttcttaaagctcggcaatgaagtgaaatatgtcactttactcacttttttttggctgaatctggtcacatgacagcccttcactaagcaattacttactgaatttaaatatggaataaaacttttttttttagaaaagtagtcagcttcgttccattcatttttagcaggaaggtattttttcagatacgatgtgtgatgacaggagacattaatattaccctcaaattcccttttgttttacaattaaatggtttataaatgtattagttcttagcccaatccctaatttctaggtgaattaatcacaggtggtcccatagatctcatatgggatttcaactttcctaatttttgtggggtctcagatacttctaacagagctctgtacaaccaccatgctcgtgattcattgctgttaaagttcttgtttcctttatctgcctacattttttatattgttattattattattattttgagatggagtctcactctgtctatcaggctggagtgcagtggcgcgatctcggctcacggcaagctctgcatcctgggttcacgccattctcttccctcagcctcccaagtagctgggactacaggtgcccgccaccacggggcctggctaattttttgtatttttagtagagacggagtttcaccatgttagccaggacggtattgatctcctgacctcgtgatcctcccgccttggcctcccaaagtgctgggattacaggcgtgagccaccgcgccctgccctatctgcctagattttagttgtgagttctgaaccttctcgaatataatctaccactgccaatcccaatgtgtatggcaggagattacttttatactgttaacttcttactataacataagatctcctgggctcattagaaacaattctgatcacttcaaaatgcagcactgacttggtattttctgcttggtaaaattccttatatatcttgaataggtagatgcatagacaaagattcatttagcttgtttgggctaactaactttttgttgttgttgatgatgattttttttttttaacttttactttaggttcagggtacatgtgcagatttgttatatgggtatacttgtgtcatggagatttgttgtactaattattttgccaccaaagtcttgagcctagcacccactaattattttttcctgatttctccttcctcccatcctccatcctcaggtaggccctagtgtctgttcccttctttgtgtctgtgtgttctcatcatttagctcccatttataagtgagaaaatgctgtattttgttttctgtcctgtactagtttgctaaggatgatagccttcaactccatccatgatcctgcaaaggacatgatcttcttttgtatggctgtgtaatattccatagtatatatgtaccacattttctttatccattctaccaatgatggacatttaggttaattccatgtctttgctattgtgaatagtgctacaatgaacaaaatgtatgcatatgtctttatggtagaatgatttctattcctttgggtatatagcccataatgggattgctgggttgaatgatagttctgtttttagctctttgaggaatcctcacattgctttgcacaatgattgaactaattcacactctccttcttataccatatacaaaaaaatcaactcaagatggattaaaggcttaaatgtaaaacccaaaactataaaaactctggaagacaacataggcaataatattccagacataggaactgacagagatttcctgatgaagatgccaaaagcaatcacaacaaaagcaaaagttgacaaatgagatctaattaaacttaagagcttctgtacagtaaaagaaacaacagagtgaacagacaacctacagaatgggataaaatgcttgcaaactatgcatctgacaaaggtctaatatccagcaactataaggaacttaaatttacatgaataaacaaccccattaaaaagtgggtaaaacatgaacagacagttttcaaaataagatatgcacatggccaaaacatatattgaaaaatgctcaacatcactaatcattagagaaatgcacatcaaaaccactaaatgttttttaagtctggttagtctatcatcagccttatatttaataagataccattcacagtttttctaacagattgaatatgaggattagtaattattagctaggaagttacttgaatataatatttaagagatctataggctctagagtcagactgcctgaacactcatctgtgctcagatatatattatctatgtaactttgggtgagttactgaacctctctgatgtttaggtttctcatctttagaagagaaataatgctagtgtaagtctcaatgagctattgtgaagataaaaggtagaaaaatctatataaacacttagcaaatgttttgtcagatagtgcatactccataaattaacattactctatcgttgtcatcatcatcatcatcatcatgtgatttttcctctatgtgatgatggttttcctatatccatctttgatgagacattaggtttatctactgcccttgtattgagcacatggttggtaggcatccagttctttaagaaatttttaaatggcattttcttttgtccagttggaaaattccccaaaatatttgcatggtggtgtggctattcaaaatatgttgtggaatatacaaacaaaatacagtttattagccaattattttcaaatcgtgtatttttcttattctctcctgcattggaagactattttatacaatctttctttcatactgtccccattacctcagtgaaagctccctaagagagagccagcatcttttctacagtgtaagctggttgttgggctgcctatgtgaccaaggccaagtcaagctcaaagcctgtaagtctagatctcaaagattcatatgacagtggtggagtcagcaagtacagaagactttgaagcagtacatatcacactatggatttccctcttgagaattagtaagagcagtgtgtgttcagagctttctctctgggtttcagaagtcacctccacagtatatctcatttcaacctagctacaaagtaggaattcacagttactgctgaaccattatatttaataaaacacaatgtgttcttttattgtgaatttcacatgtgtctaatttgatgtatattttttccaatgtttttggtaagttttggaacatttcttatgtgaattactaaaaaaaaaagcctttattatactcatttataaaagatgtttatcaaattacctttcatcagtcactttcatttgccccaggagttgcaacttcaataattttaattttgcattggctttttgtcctattccatcttaaactgcccttctcacttatctatatatttattcatacatacaatgtatacatattattgtatttatatttatactttatataaatttatgtttatatttatacattatatatatataatttagatacattcagtactatatatcacaagataaatatgcttaaattttccaaaattttatggtttagttgtggtattaagtattaagatatgctgtctctcgtttttacacttcttttttgtgccttttgctaaaacttcttatcaatttgaatgtcatgaatttttttatacattgactgtcttagtctattgcatgttgctataacaaaataccacagactgggtaatttacaaacactagaaattcacttggctcatggttctggaggctgaagtgtaagaacatggtgctggcatctggcaagggtctttgtgctgtatcatggcagaaggtaaaagggcacttcccaaaacttctttgttaaagtcattaaaatgctccataaggaagagccctcatgacttaatcactctttaaagggccaacctcttaatactgttacaatggctattaaatttcaatgtgagctttggaggagacattcaaaccatagcattaacaaaactactaaatgttaacatgtaacttagtataaatagaattgttaaaaaccaattcagatcactctgtgataaagaaaaataaatcatttaaagaaagaaaattcaacatcatagaaaatacttcaaaaagtaggatgtcagccaaacgtggtggctgagctggtggtcccagcactttgggaagccaaggcaggcagatcacttaaggtcaggaatttaagaccagcctggccaacctggtgaaacttcgtctctactaaaaataggaaaattagtcaggcatggtggtgtgtgcctgttatcccagctactggggaggctgagacaggagaatcgctggaaccagggaggcagaggttgcagtgggctgagattgtgccactgcactccagcctgggtgacagagtgagtgaaattcatctcaaaaaaataaaattaaattaaatttaaaaagtaggatgtcattcttcaaattctatatagtaaatgataatttttaaaatttttattactcatcactttcacattgaatttttgatgtatgtgagatattagaaacaatattcattataatcagtaatttgctaattttttaaagataatattttatttgtggaaaattcacactcacctccttcatccccaaaagggaaatattagtaagaagtggggaaactgagggaaggaagcaagatcaagtggtgaaactttccgtagcaaaaatatattggcaatgaaaaatattaaactcatttcatagaaaattatggactattgttaataaaatttatattattttaatatttttattcttatgcctacgttttaaaaatataaaagagaacagtttcttaattgtacaacaagtgcctggattttcagtttgtgtactctaagaagttgtttatttcattaaataattatgttattaccttagtgaaaacagaactgtgaaaaatttaatccaaatttcaggctgtagaaggtacaacttcgggattattagaattgtacacaatgtagtctggagtcattttcccttcctgtgttgtaaatgccaactgaaggctttcacagaatatgggattctgtaaaattacaaggcagattataaataacaagggctggtttctctatctaatgaaggcagatgtttttgattcccaatctacctttgtgtatgcatttccataatagcatgacatataatcttcttgtctctttgatataaatgctacatgagagttataccacatggctacatatggtgatggttttatagttagatataaaaaatgaatttcatatgtctatgaggagaccaatatattgtaggttgttaaaaagaatgagggcttacaaaaattgttatggttcaaataccatatcattttcttgttctacggatccaggccagtagtgagtggtatcaaattgtgaacgctatcaaataccaaaatatattttctcaagaaaaataaaaactgtaatgtgacaaacacctagggaaatactgtgttttgaagaaggaaacaaaatattcacaaacttttatttgtaggggatggagaggaaatattttgtctctgtaagtctcttgaaaatgggtattagaattttgtagttaattaattttgatgactatctgttaacagtcttctctcataaaactacaatactaaacatagaaatactagggtgtaaaaactgaaattctattactgaaaaactgtcttcaaatagtaacacagtttccagatgtattgcttaggttctgtttgcatttctattttaaaactccatttactatggtttcagtaaaaattcggtccaggctgaaacttggaataccaaataggagctctggagcaatggttgtctttaccaattttccagaagattgatttagattgttttatgttgtatgactgtgaaagaacaaaacagaaaaggatttgcttgtttgatattttattctgtctgtaatacaaatcttatttttttttcctggcaatttgtactattacaaatgacacatactgattttaatatatccaataagattgtatggagctaccaacaaataaaataacattttgataataagaataagagtcttcatcttgcctcttttgcaatatctaatggcatattttcatcacacagctcaagatacaaagtataacatctgacaagtgttaagtcttagacttctgatcctttttgtaagctttcttatagtttatttgacttagttttcctatctgatttattagggtacagatctaagtagtagaaaaattattctagtatgtaaaaaacaaagttgtcctcactgaagcttcaaatccttgtcctgattctgatccttgggggaagtagagatttcaactgaaaaaaacatggctagcagattgcatgagtcagtcctgttagtgaccagctttggagaaagcaataggagtaaagcagagtaagcaattagcacaggactaagtggacaatgtgcagagagcaagcctgttgcagaagtctgaaagtagcagtgtttgtgtgggtaaccttaaagaacaaagttagaaacagaggaagtagtctactctcaggcaacagacagcaaaataaaattcaatactggatcaaaggccttatgggtagagttcttaagtacatcttcccataggtagaacttggcttattgtactgacacatctcaacttcctataggaattaagtgggatacttgggtggaaagcacatgcactgaggctaaggaaaatgaaggctgacaccccgtggttgttgaaatcctgtcacatcagtgacatggatttaagttaggaaatgaaacttactggttggagattaaatacattttaaaaacttttaaatgtgtgcagtgtttgtcttggctaaagtcttatgagtgtaaatgttatacattgagaattacatagccaagggatacttgaagtgatttctatcatcctgatgtaggttttcctttagtacttgtctataaaatataatgaattataatgataaaaatcacacagtataaaatattcacttaatatgtggaattttctcaaacgttgttaatacagttatagaatattatatgctgaagattgataatccgcatattcaatttaatctaataaattactaatgggtattgatatgtaccatgacatgtgtgaggccttgaaaaaagtccaaaaaggtatatcataatcccagtttgggaaagtttcatgtccaatgggtgaactagaaaaaaatgtaagaaatgttgcattttaatgttctcttaaaagtgactcacaatggaatatgattttttgtcatgatttaagcattctaaaatgtgacatgaattattactcactagaaaccaatctaaagataccttttaaagtttccagcaaggagtatgtgatcacctttataaatataacacttaaggaaagaaaactatgaatgtaagtattcacaaattgctagcaggttcttgaataaatcatgctacataaattcaacagtgctattcttattaagttaatttggtctaaaactaactaatatacaacttacttaatatgctggtaccttttgttagaaatgggcataaaatgtgtctgaaatcctccaattagttgtcttaggcatttttattttattcagcatgaatccaaaatacacgtttgtatgattgttgaaccatttaaaaccaacggtgtattggaaaaatcattttatccagagttaagtactatttaatagagttttactcattggtcatatagtagagtgttatatgcagctaagatggaatcttccagaatttagagttttgaactgttaaattaccccaccggtgggtagcaggcaactaatggctgttagggcatgacctcaaagtggcctacttaacccattcgcttatttttaatagctctgtgatatgtgaataacacccttttcttcttttattacacatgctcatttcttttattctttattcattcctagtttaatgttttaaaatatttttaaataaaatgtttgagtttttagtttattattgaaaaggacattcaggtaatgatttatattctgtgtcctcaaaggggaacattttttaaaagattgaattcatttccactgacaatattacaattctttatttaggttcactgtatatttgggacctgctacatagaaaagttaaatgatatgaatggtctctgattaactacggccttttgtgttttgggaaaccgtaaggtaaaatgaaaatattttcaaagttcactcattcagtagttcagatcattttccagtgaactgtcacttacttaaaaaatttgtgtagcatgatgtttctagctcttttatactcaacagtgtctaaatggaacattttttttcttctgtttttttttttttttttttggtttttttgtggcttctttcccatgggggatcctgtggagagatattgaagaggacttcctagttcagctctttttcactctgttcttatcacatatagacagagtttagctctcagtttcaattcaatagctactcactgaatgcctactgtgtagatagctatagctcagggtgctgaaatagtgaaacaaggttcctgctcacaggaaacccactgagttatagtatattcctctttggactgttaaatgttttttccttattcttcatacttgaaatgctgttttaaagtgaactgtagatgacatcataagtgtttgtgaacttgaaaagattaacagtgtggatgtaggatttacttaaaatattcagttcatggaaaatcttgttaggcagctctattgcttagccaataaactattaagaaaatgtacacaataaataatccatgtagtaattttggcagtttcttggtccttaagaatgtgttgtccatttttaaatatatattcatatatttcagttctaaaattctaaaccacattctttatactttcactgtgatgtagcataggagttttacctcatagaggactgagacatatttaagtaacttgctcaagttaatatgattaaactataatgaagcttacataaaacttcatgtgttctgcttttcagagcctagtttttaattagtcaaggctggtaataatcatagaaacaactgaaagtattatatgatttgataagttgaattgattgaaatatttcagacatgaaaatatctagtttttcctcaggattccaaaccccaaataattttaaaatgtcattgtagatgtatttgaagtcacattacattctccatgatatcattcagttctcatcataatccaaagatggaaggaatcagaaattattatcaccagaaactgacttcatacaagtgtctggagccaagtcttttgatttcaaatcagtacctttagccttgttccatgaaaatggtttaaatatgaaagtcttatattcgtatgtagtgagcaattcagtttaactttggtgatgttatataggttccaaaatacagtctggctaaaatagagttaaattccttttgtctggattcactgagaattgtaagctctgtctgtgtcagtggaacctgtgttaggggaaatgaaattgagcacaggaggtgggtaacgtattctatccatacagtatcacagcaggaatttgagatttttccttttggtgacctcttaaaaaatgtgtgaacaaactacatgagtatgtataatatacatatatatttagtatatatgtacacatagtaacaaaattttaaaattatatataaatacatatatttatataagataaatatttatgtgaataaatcattgttttgaaaaggggttgatatagcatgagttcctattgtgagaataacaaatttgtgccctactactttcctctggcagctaaacaaggcatctatatcatggcatgtaggagatagagtatgaaatagacattttttttaaagtgtgctgtatccaaattcagtcacaagcacagacctgctttatttttcacattcaatataaatcaattctaaaaatatttgcaagtgtatatcttcctaagcaattagagttcacaaagaatgacagcaaaggggatacaatcatttaggtttttattatttgagtgtatgggagggtgattttttaaagatacttagaatcacaatgatttagaattttcccaaaggctatatattttataattatctgctcctctcacaaagcacatagggaaggtgcaggtaattttcaaatatatgacatttgggatcaccctcttgtgtagtaaatgtgtacactgaattttaagctttgatatcctaactgttctccctactccatcaaatgtgcattaaaattttttaatcaatttttttgtagatttatatgcagttgtaagaaataatagagagctcttgtgtacctttcacccaaggaacagctgtaaagctatgaaacaacatcacaacgaggaaattgacaccgatacagtttaatagtcttacttggctttcatcagttttacatgtatttatttttgtgtgcatatgtgtaagtgtgtgtgtgtttatatgtttagttctagacaatgttgttacatgtgtgggttcatgtatccatcactacaatcaagagacaaaacagttccagaaccacagggattccttcttcctcttagagccacacccatgtccctctactctccatcgcccctgccatccctagtccttggcaaccaaacgctgttctctacctctataattttgttatctcaaaacatcatataaatggattccgtctttatttatagagtttttgagtgtattctttgtgtgcgtttcttagtggttgctctgggtatcgcaattaacagatataattgacacagtctactagtagcaacattttactatttcaagtatggaaaccttacttccactaggtatctttgccctatccactttttttcttgtcttaagtattccttctatatatggtggacattatcaaagttatactttttgttttaataatcttatatttgaaaaaactcaggagaagggtagtccattgtattttctcttattttgttattttttcattctttcttcttgatgcgtcaagatttcctcttattactaattcttttatgtttgaaaaatattttttctttaagacagtcctgctagaggcaaattatctgtttctctttcttctaagaacatatttatttcctcttgattcctaaaggatagttttactggttaagaaatcatagttgatagttctttttcagaagttgaaaaatgcaccacttcctctggcctccatgacttgaaatgggaaatgcattgtcatttgaatttgtattctcttacaggtaataagctattctcttgggatcctttcaagaagtttgtttatatagttttcatctagttttcacagtagagttcactctcctatgagaaatgcccccactcatctgacaggaggtggagctcaggcagtgatgctagcttttcgaagtttcctcttgatgtatctcgatatagagttctttggggttttcctagtttgggggtttcactcagcttcttgattgattctctatcttcctgacttttgccaaatttggaatgttttcaaccattatttctttgaatacccttttagtcccactctctttcttctttccttctgggactctaatgatatcactgatggatattttgttattgtctcacaggtccctgggcctctgttctttgctatcttttctttttatccttctgttttctctcagctattcagattgggtgaattctatttctctgtctttaaattaactgattctatcctctgtcattttcattgtactatagagaaaatccaattagtttttatattggcttttgtatttttatttctgtaacgtccatttttaataacatttttcatgctaaggttttctgttttttttatttgtgtcaagatcattagtaattgcttattaaagtatttttataatggttgcttaaaaatttttgtcaaaaatttcaatatttgattcatctcagtataggcatcttttattttttctcattcggttatgattttcctggtgtttagtatgactagtaagttttttttattatacgctgaacattttgattatgttaagagactctggatgctaattagatttattctaagaagcagttgccctgttaaggtataacatgctagtcctagctttcaattatgggctgtggttctaatgagaatttaatttttagggactttgtgctgctatttggacaggttgatttgtctaattctactgggggccacactgatctcttctggtccaccgaagggagaagaggagattcctcaggctaagctgtagtggtctaggtgagctaaaaaatgctctagctcagcggtccccaacctttttggcaccaggaaccagttttgtggaagacaatttttccatggatggtgggcggtatgtgtgggggatggttttgggatgaaattgtttgatctcaaatcatccggcattagttagattctcataaggggcacgcaacctagatgcctcatatccagagttcacaatagggttcactctcctataagaagtgcccctgctgatctgacaggaggcagagctcaggcagtaatgttggctggctcatggctcacctcctgctgtgtgacccagttcctaacagactgcaaactggtactggcccatggcctagggattggggacccctgctctagctgacgaaaagaggattacttccagggctctgtacttttggtagagacatccccccgcccccaccccgcatataccctcccgcctcaccctccacacacactgctagagctgcttatctgctcagaacctctagatggagaggggaagtcttaggcatcctagaaaaagaggtcactttctctggctgtttgctgttagtaaggctcctacttcattctccttgcaggtaacccagtctctcctgatattgttggatggattctcatttgatcagcaataaaaatgagtctacctagactaccttctgtttctagtttgtggttgggagaagctgggtctggatcgtcttttactgtttgggaagctactgggattttcctcgggtgctggtgtctttaaccagtcctcctcactctttctaccttttagagtactcttttagttgctgcttgcttaattcccgattctacagctctacttagtagagcacacaatgataaactttttaatgcttttgtttttctcccaaaatgagtcaagtgaagcataattcagcaagatgctaaagtatcttctgtgaaactgagtgtcttgtgatagaaaaggtgattcaaaccaaagactgtattaacatacaatacagcagtggcaccaaccaatcagagcaaatttaaaagccagatagtttacaggtgcctttctgctcaatatcagctcaagttgaaatagttcaagtgcctctactgcagagagcttgtaataggccaatatttttgttgttgccttggaagtcctgcagcagtcacagtttaccaaatttatctgtccatagaagtgaacccattttgtttatagcttttcttggcactggtattctatgaaacatttgcagaggaaagctatgtttatcaacatcagtatctacctcatctgaagtattgcattagatgtaatcatttaataaaaaagttatttctgaaaacattaaggagcacctaattctactttgatttttaaaaatctgataaaatatttcaatatatttaaactttcttttaaactgttccaagaaataagatttgaatgtatggccaaagaaaacatttattgtattgtgttgaaaatatatagtctaaaaatactgactgtttctgatgtccttatttacattttcaatattttctctttccagctttaagggacaataggatcgagctggttcgcgcttcctggcatgaattgagtattagtgtcagtgatgtgtctctctctgatgaaggacagtacacctgttctttatttacaatgcctgtcaaaacttccaaggcatatctcaccgttctgggtaagtgcaagggactaacaccatgtaatcacaaaaccagaatgatatatattgctacagcaacataattcaatacaaaaatatattttgaagattatatgaatagatatggtttaatcctttctctgctacattttaacacaggcgttttaaaatcatttagtcactttcagcattttataaagggacaaagatagattcaaagatgtatatgacttctagaaggcacatagctattttgtttcttagccagcaatagacaccggttctcttgatttcagctaatttcttttttatcaaataatctatatgttgtatatattctgatccttttacgacatgacacaataatgagcataatgagttcaacttgtgttctatactatgctcctttatttgatcatgtaagtcacctgataagggcctttcttgctaacttgtggctctcaaatatgacctgcttgtgtatttagtgcatttaaatgaccctgatatttccatgtgtcttctctccttttgaaattatattttctagattcctaaatgaagtacctaatgtcgcttcagcttgcagcttgtagtttctttgtgcttttgttctctaaatattgggccattttcccaaaggtgaaagtgacacaaaaaaagcaatacattcatagagattccgaggaaataaagttgcagctctgagctctctgtgattccacagacgtcagtgccccaatcagctgaaattgctgcatttcattgaaacacacctgcgtgctgaacaagttagaagaatttaaagattgatttttttcccccaagcttgctgccctctttagatagaaaaaggcacaatgctgcatttaaaaggactaacacatgctgttctttttggtgggaatattaaagttaatccagctagtgaattggttttgtgcataggatataaaacatttctctgcaagtgacactgggactattttataaaaatcttcacaagtttgccattaaagacaaaatatgccctctaaaatggagtatttcaggataacaactgcataaggttaatgtattgttctgtagagagccaatttgaaatccaaagaatagatgactgatgaattcactttattaaatggtgatgaggcatagattttttaaaaagaaagcaggtagtatgtaggtgaagacaaaaaatgttaagaggagttatgttaatttttcatgtatctttgttgttcctgttgtttaatttgtacttctcatattggtgccttccaatattcttcttctttttttttttttttttaaaacggagtctcactctgtagcctggctggagtgcagtggcgccatctcagctcactgcaacctctgtctcccaagttcaagcgattctcctgcctcagccttctgagtagctgggattacaggcacctgccaccacgcctggctaattttttttttttttttgtatttttagtagagacggggtttcaccatgttggccaagatggtctcgatcacttgacctcggcctcccaaagtgttgggattacaagggatgagccaccgtacctggccataaaatacagagatgataatattctttttaagctttaagaactatgaaatcaggaaagaaagaagctaaagttaaattataatttgttaatggataaagaaatatgttttgtgagttttttttctttaatgcaatctaccttttaaaatttctacactagtaaattgtaaattatattaaatgattgtttttaagatttacaagagtattttcacaggtaaaattttacaaatgaggccaggcacggtggctcttgcctgtaatcccagcactttgggaggccgaggtaggtggatcacttgaggtcaggagtttgagaccagcccggccaacatgaggaaaccccatctctactaaaaaatacaaaattaggccaggcacggtggctcatgcctgtaatcccagcactttgggaggctgaagtgggcagatcacgaggtcaggagttcgagaccagcctggccaacatggagaaccacccccacctccccgtatctactaaacgtacaaaaattagccgggcttggtggcacccacctgtaatcccagctactcaggaggctgaggcaggagaattgcttgaacctgggaggtggaggttgcagtgaacagagattgcaccactgcactccagcctggggtcagagcaagactctatctcaaaaaaaaaaaaaaaaaaaaaattagtcgggcatggtggtgcacacctgtaatcccagctacttgggagtctgaagcaggagaatcacttgaacttgggaggcaaaggttgcagtgagccgagatcgagccagtccactccatcctgggcgacagagcaagatcctgtctcaaaaaaaaaaaaaaaaaaaattacaatttaatttaaaaaactactttgagctatatgcatcttacatacttttttgatactatatatatttatatatctgtacacatatatatgtgtatggatgtgtgtatatgtttatgtgtatgcatatagacatatacacctaagtatgtataacacacacatatgaagcagtttattacatagtagtttgttcatcttgatcgaacttcttgtcaattaaccatccagttcagtttcatgtgtgaaagtaatagacataataacaaatcaaccctgaagattgatgctcacttcatcattcgcttaaatttcaggtgttcctgaaaagcctcagattagtggattctcatcaccagttatggagggtgacttgatgcagctgacttgcaaaacatctggtagtaaacctgcagctgatataagatggttcaaaaatgacaaagagattaaaggtaaagaatagaaaaatgaaaatcaaaattaatgtgctgaaaccagtatgacatgttaagaaaaaggcattttacattatttttcaaaacatagtgtctcttacagattatgcatcatttgaaccagatttacccattcttaagtaaggtaattttacaagatatattaatatataagtatgatccctgtgggcctcattttcttcttccgtaaaataggtttaaaataatatatgccttatagaaaagttgagggaataattaagttaatatatgaagaaacatatagattcatacttcacaatagtacatattagatactattatttcagacctcatatataatattttggttaaagacagagaaactgtataaattatttcttcaacttagtttcgggaattatagagttctgagaataaaactggttaaacatcaataaatttgattcctgttaattctcacaaaaggcaaaaatgtgtacttgtctaagtaaaagtgcatactttaaattctttatacatctaaatttaaactccctctctctctgtcacacacacacactcaaacatacattctttaggaggggaataagtttataagggagatggcttggtatttaagtataagaattgtttatgatgattattaaaacatatttcttatgccactgtaatatgtattattttcaacattatcttctatgaaacaggtttatgcaaaccattctgcttattttaaaatgttatttatctatttatttttaagagtttttaagagatagggtcttgctctgtcacgcaggctggaatgcagtgatacgatcatagctcactgtacctcgcactcctaggctccagtgattttcccgcctcagcctcctgagtagttgggaatacaggcatgcacgaccatgcttggctaacttgttttattttttgtagagatcgtgctgtgttgcctaggctggtctcgaacttctgggctaaagtgaccctcctgcctcagcctcctaaagtgctaggattgcaggtgtgagccaccatgctcagacattctgattattttaacctataattgtgataccttatatcacactaattaattctttgtaatgggcatgcaggcttagcagataagattgcctatattactgaaaaattatgattataatccatgcaattatttttatcagtttcctgttttaattactctttctctgcatatttttcccaaaaaaggtccttatccataattttaccctgatcactacgcttgccttagtatttctaataaatatacattattggattacattttgagaaatacaagtcccaagacacaagttagacatcttattatgctaaattaaatttcaggttactgtgtaacctgattcttgaattctgtcaaggctcagtaacatccattctaattctgcctctaggatatgttagtctaggcatttctggacttggttagatctctctttaatggatgttccatagtgcttccagagttatcttactacaacaagaatctgatccaggcacttttctggcttaagcatttctaatggaaagccctaaactttagaataagtttaaaatctgctttctgtagcctgtaagaattctccaggcagtgaactcttacacgtcacatatttccttttgtgtgaaggtcttggcttacactaaaatgcacttcttagatacaatccttcaatgaattactttattacctacatgttttttcttcctaaattctgacacaattagttaattaattagttgtttactcagttctcactttcttagtattttatttatgttccaaggatttgcctcttttgtatcctcaaggaggtcatacactttcacatattaagtacctcattaatattgattgattgtttttcacattgtagctgcatgacaaacccatgatatactcagacatttataaaggaagtgaatttttgacaaaattggcctctgttttaaatgccaaacagatttaatcatacattgggcaggaggggaaagatttttgctcatatgaagaaatatgaaaagtttaatcttataaacaacatagtttaaaatcatctgaatcaagatcagaacaacaatgaagacagaaacaggtacagaatcagaatatggttctatgcagtactgaaaacttgtgaagatcccattttttctatgctcttcaatgcactgccatttacagagcatttatctctacacttgcatctatctatctgtctatctatgtatctatgtatctatctatctaatcttacaattctttagcatgtttacatcgtttgtctccctaaccagatggtgaactttctgagtggcatatattttatttttgtaagtgtatatgtaaatacagttaggtaaagactacggcacaaagtaaatattcactgtagttgctgtttctggatatgctaagcaaaatttcactcttccatcttttagcaaaccctcctcatttaaaggggtaatccaccttatctggcactattttgtctttttagggataaaagtttgacttcctattactatctaactgtttttagtataatatcacttgacacgttttaaaaagacactccctagcataaaataaggcaaacagaaaagacaggctaatcaaattcaattaaattcaattcaataagaaattgttaaaatgcctctcgatttcacagtattctatggtgcattagtgaagatgcaaatgagaaaccaagaaacttgacctgcagctgttgaagatgtctttggggttatcaaacatgttatggagaatattttcctaaaaatagaaacgtttatacaaatctttatcttttctctatcactacctaacatattaattttatatccatgtttctgggtaaaagtcacttgaaagtgctagtttatcacattttcttgtccagaatatgtccatacttggttatagaacagtggttctgaagctgtagccattaagcacagggcatcctcaagtacagggcttgctgaatctcagattatcaggccttgatccaagattttctggtggagcaggcccacgggggagcctgaaaatgtgcgtgtttgccattgtgttaaatgtgtgaatgatgttgacgctcctgtttcaggatcactttggtatgaaaaatataaaatgaagagtatcagtaaactatacagaagtcctgcctctgtctctgagctttctttttctcctttgctaaataaggacaataatggttgcctcaaagtgcttttgcaagaattctgtataaaatgatatgtatgaagtgttttcagagtacaaggaatcactgaatacattttagatattattatcattatcattgtaatttgtattttcaggaaatcatgatgagttgtaccaattcctgaattagtcctagaaatataaacaaataaaacaaaaatattccacccaagctttcacagttgagaaagagacataaaaacataagacataacaggcacaggtatatgaactggctacagttttgtgcagaagtagcagatatcagccctactttgtgggagaggttaaggctcaacagttcattgatggaagcaggcactcagtaaagatctgtttattgagtaaatgtgtcttaaacaatgtataaaccaaacagtgacagaagcaagtctcagtcgatctagaggtttattttgccaagattgaggacgtgcccaagaaaataacacaaatcacagaagcatctgtggtctgtgccttttccaaaaagggtttggaggacttcaatattgaaaggggaaagagcaagcaggaggggagtaagaaggaaaaaaaggggtttaggggaagggtagacaatgagacaagtggttacattcttgtgagagtttgattagctctcagttcatctgtattttacatgagaaagagagagtaggggaaaggtaaattatgcacttgtctctcactcagtcaatctacattttacataagataaccgtgtgaacagatgaagtggaggaaggagtcaattatgcactggtctcagataggcagagggattatttctagtctttctttgtctcatacctgtgaagaaaagctggtaatttgcattgtcatggttagattttacagaactatgttttagggctagtttatagggaaggcatgtattctgatagattatcggacccagaaggaatttccttgtcagtaattttggagagagaccatttggggagatacatggccttctattattataaggctgtgacataggtttgtgaaattgtagctatcagttcatgaaaaaaaagaaagacttttttttttctttttttcattactgagatcccaagcttaactttccctttggcgcagtgattttgggatcctgagattcctattttctttcacaaaggagtagaattcatcatatgtgtttgggacaaaagtaggtggtaggacactttgaagaaatgaatttcatatatctatgcagagtaacagcatgtgattgaaataactatgaaactttatgtgtggtataggcatgagaagtaaacagagaggcagggttcagttatgtcatgaaagagcttttattccagattaagggtttgaaatttattctataggcaatagtgagacttttttttaataagctttcaaaagtaaaatgaaacaatcataatttcatccaactctgttttttatcccctttatgagagttttactcagaaatccctttggtgcctctgggcagagctgcatccaaaaccacaggtagtttcactgcagcctttaatcttctgcatagcaagaaagtgaatatctgctacttagtgtgagaaaagatgtgcattgccttcctaagtctgtcagctccctaagagcttacatttacattaaagttgtcattccatgtataagtttagttctgtgcagtttgaggatttgctattacaaaaccatgagatcttttctacctaactagcttttacattaatgcattaggcagcattctatgataatccttaattatccacacccttgtataaacccttcccctagcatgtaggagataattgtgaatatgatgtgatatgattgcctcgaatatgatactttatattacaaaatgggttttgcagttatcactgtgggccccttttgagttcatcaaagggtgattatcaaggatgggcctcatacaatgagacgaggtctttaagaaggggtagagtcagagagacattattttcctggcctagaagaaaacaaatagctatgctgtgaattgtttacgggtgccatgtggcaaagaactgtgggtgacctctaggagctgaaagcagtcccaggtgatagctagtgagaacatggggacatcagacatatagtctcaaggaaattaatttactaacaatcagagagcttgaagaggaccctaactcagattgaaactatagccccagctaacatctttatttagccaagtgacactgagcagaggacaaggcttagccataccttgattcctcactcacagaaaccctgagataataaatatgtgttgttttaagccattaaacttacagtaatgtgttacacagcagtattaggaaactgagatctagagagacagaatattttttcatggtcacacatctggcaaagactagccttgaatattctgattctaagacccagcacttgggtttggggagaagtctgaagactagcttagtacttaagaggcattgcaagcaagagctggtaagtacctgaactaatggatgacaatggaattttttacaaagaaatggttctgaaagagaagataactttcaagtgaacttggtgaatgatctggacagatggagtaaaagcaagcattaagattataaaattcaggtgcctaaatgacttggataatgaatgtttgctcattaagaaaatgagaggcagtaggagaaattaattcacacacaaattataatatgttcatgatatggttggctatgtccccacccaaatctcatcttgaattctagctcccacaatccccgtatgtcatgggaaggacttggtgggaggtaattgaatcatgggggtgtgtttttcccatgctgttcccataatagtgaataagtctcatgagatctgatggctttataaaggcagttcccctgcacacgctctcttgcctgccaccatgtaagatgtgcctttgctcctccttcaccttcctccatgatagtgaggcctccccagccatgtggaattgtgagtccattaaccctctttttctttataaattactcatctcaggtatgtctttattagcagcatgagacagactaatacactaatgagacactgctgtaaagttacccaaaaatgtggaggcgactctgaaactgggtaacaggcagaaagatagggacagtttggaggtatcagaagaagacaggaaaatgtgggaaaatttagacttgcctacagacttggagggctcagaaagcaggaagatgtgggaaactttggcactccctagagacttcttgaatggctttgatcaaaatgctgatagtgatatggacaacaaagttcagcctcaggtggtctcagagggagatgagaaacttgttgggaagtggagtaaaggtcatccttgccatgcaaagagattggtggtattttgccactgccatagagatctttggaacaactgaacttcagagagataatttagagtatatggcagaagaaatttctgagtggtaaaacagtaaagagaaagcagagcataaaagtaggggaaatttgcagcctactgatgtagtagaaaagaaaaccccattttctggggaaacgattccttatttaataaatggtgctaggaaaactggctagccatatgtagaaagctgaaactggatcccttccctacaccttatacaaaaattaattcaagatggattaaggacttaaatgttagacctaaaaccataaaaaccctagaagaaaacctaggcagtaccattctggacataggcatgggcaagggcttcatgtctaaaacacgaaaagcaatggcaacaaaagccaaaattgacaaatgggatctaattaaactaaagagcttctgcacagcaaaagaaactaccatcagagtgaacaggcaacccacagaatggaagaaaatttctgcaatctactcacctgacaaagggctaatatccagaatctacaatgaactcaaacaaatttacaagaaaaaaacaaacaaccccatcaaaaagtgggtgaaggatatgaacagacacttctcaaaagaagatatttatgcagcaagaagacacatgaaaaaatgctcatcatcactggccatcagagaaatgcaaatcaaaaccacaatgagataccatctcacaccagttagaatggcgatcattaaaaagtcaggaaacaacaggtgctagagaggatgtggagaaataggaacacttttacactgttggtgggactgtaaacgaattcaaccgttgtggaagtcagtgtggcgattcctcagggatctagaactggaaataccatttgagcccgccatcccattactgggtatatacccaaaggattataaatcatgctgctataaagacacatgcacacgtatgtttattgcggcactattcacgatagcaaagacttggaaccaagccaaatgtccaacaatgatagactggattaagaaaatgtggcacatatacaccatagaatactatgcagccataaaaaatgatgagttcatgtcctttgtagggacatggatgaagctggaaaccatcattctcagcaaactattgcaatgacaaaaaaccaaacaccgcatgttctcactcatatgtgggaattgagcaatgagaacacttggacacaggaaggggaacatccacaccgggaactgttgtggggtaggggaagtggggagggatagcattaggagatatacctaatgttaaatgacgagttaatgggtgcagcacaccaacatggcacatgtatacatatgtaactaacctgcatgttgtgcacatgtaccctaaaacttaaagtataaaaaaaaaaccccattttctggggagaacttcaagtggactgcaaaaatgtgcataagtaattaggagccaaatgttaatcaccaagacaatgaggaaaatgtctccagggcatgtcagagaccttcagggcaacccctctcattacaggcccattgtcctagaagggaaatagggtttcctgagccaggtccagggacttcttctgtgtgcagcctctggacatgttgccttgcacccagctgcttcagctccagctgtggctaaaaggggccaacttacagctcaggatgctgcttcagagggtgcaagtcccaagccttagtggcttacatgcagtgttgagcttgtgggtacaaaaactcaagaattgagattctggaacctctgcctagatttcagaggatgtatggaaatgcctggatgtcaaagcagaagtttgctgcaggggcagggccctcatggagaacttctgctagggcaatgtggaaggataattggggtcataacccccacagagagtcccgactgaggcactgcctagtggagctgtgagaagagagccactgtccttcagacctgagaatggtagatccactgacagcttgaagcctgcacctggaatagctgcagacactcacgcctgctatgaatgcagctgggaggggggctgtaccctacatatccatctgggtgcagctgcctaaggccatggaagcccacttcttgcatcagtgtgacctggatgtgggagcccacctcttgcatcagtgcgacctgaatgtgagacatagagtcaaaggagatcatttcagagctttaagatttggctgtcctgccagattgtgacaatgcacagggcctgtagatccttcattttggccaatttctcccatttggaacaggtgtatttacccaataactatacccccattgtatctaagaagtaactaactacatttgattttacaggctcataggcagaagggactagccttgtctcagatgagactttaggctgtggacttttgagttaatgctgaaatgagttaagacttcaggggactgttgggaaggcatgattggttttgagatgtgggggcaatctgtgtccccatccaaatcttatcttgaattgtagctcccataattctcaggtgttatgggagggacccagtgggaggtaaatgaatcgtgggggaagtttttccatgctgttcttgtaatagtaaataagtctcatgagatctgatggttatataaagggcaattcccctgcacactctctcttgcctgctgccatggaagacatgcctttgctcctcctgtgctttctgccatgaggcctccccagcctttgctcctcttttgctttctgtgaggcctccccagccatatggaactgtgagtccattaaacctctttttctttataaattactcagccttgggggtgtctttattagtagtgtgagaatggactaatacagttcattctttaaaatgttgaggttaaggctgggcatggtggctcatgcctctaatcccagccctttgtggggctgaggcaggaggatcaattgaacccaagacttggacatcagcctggacaaaataatgagatcctctctctacaaaaaatttaaaaattagctgggtgtggtggcacattagtcttagctgcttgggaggctgaggttggaagatcatttgaatctggaagtttgagtttgcagagagccatgatagcaccactgcattctaacctgggtgacatagtaagacctcgtctcaaataaaagagaaaaaagtttgaggttgaagtaattatacagaatttaaaaggttatgcttatagtaggtttttgaagttaagtgacttataatgaggaaagagattttgaatatataaagatctgccattcggtaataagaaatgtataagttttagccttttaaaatagccatttctcatgatgtgtacagtatgcttcaaacaaaacttatctccacatgcgttccctgccctgagaattatgctgtgtacacctggttaggcaccaaagctggactctgtagtgggtcactgaagtttgccaggatctaatggtattgccatcattctataagcattatttacttattatataccgtgtgtttcaaaatgtttggccattaagctcgaattgacattagctatgtttccttgtgtgagtaggttcttgccatacattttaatgtcaatcaaagataatgcagcttctaattttcaagttggcaaaatatagcataattttactgtaagctgcttatatcggcagttggagaagagtgaatttctgaatgctgtgcttctcaaaaagtggcctttagaccacttagattagaatcacctcaggtggtagtttacaaaatgcagattcctggttttaaagtagacttactaagtcagaattcctggttgtcaggcctaaaaattccattatttctcatgtatctgtaatgttccttattattaatagagtttcagaacccgtgggattagagactaataagcaaagcattaataggtatttaggaaagaaaggaaggggcttcctaaagtagtaaatttagaaaatgactcttaacattctttctaccttatgagttctttcttagaggaggattctgtaatatggaatcaggatgtatgttagcattattaatgtttctgagaattacaacaataattgctttaacctacatctttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctaacctacatcttagtaatagtctctggccatataactcgatttttttatttctttatttcttgcttgcttgttttacttttttttggattaagctttgtggaaactacttgataaatggtagattatatttttatttattttatttggtgttgcaaaactggttttgtcctaaggactcatttaacatcagttgtataaaactttaatttgaatgagtaaaatattaacatgtaaaccagacattgcaaattctttgaaattaaacataaaagaagaggaagagatttgtgtcccctgagtttaaagtccctgcatcatgtataagaatgaatttaaaatatcattatttaaacttatagtatatgccatagatctgttatttttatgttcctttatttatacttactgctttgaaagtggccttgccatttcatccagaacatgctgggcactatattaagtgagaaaaaaaaattaatagcatttaaatgtgggtatgtatatctgtgtgtgcgtgcacataacttgaagttttcttaatggtgttaaacgcagtacctcaagactcaggcaatactaggagatacataagtcactctatagaaggagatataatgattgttccaggtgtatatgagtggttgagttgaaagaataatcaccagaaatcattgagagtctttactttttcatatttattttaaaaataaatttattaagatataattgacaaaaatcaatatatagatatttaaattttgcaatttattaagttttgacaaatgtctgtagtagtgaaaccatcaccacaagcaagataaaaaatgtatttattatccccaaaagtttatttatatcctttccaacaccttccctttgccttctctgcccactctctacctcagtcccaggaaaccattgttctgctttatggtacaatagattagtttgcattttctgcaattttacataaaaagaatcatagggtctgtacatatctttctttttttttttttgagtctcaacataagtatttgagactcattcatgttgttgcatgtacatagtttcttctctgttttcttgctgaataatattctattgtatggatacatacgccacaattagttacctgtttacccagtgatggacattcaggttgtttatagtttgcagatattatagtaaagctactatgaacatttgtgggtacaattttgtatggccatttgtcttcatttttcttaggcaaatgcctagatgcagactagctggattatatggtagccatatatttaattttttaaaggccttgccattttccaaaatgtttgtactacttcataaaatccaattcatttattgtgtatatatatatatatatattttttttttttttttttttttttttttgagacggagtctcactctgtctcccaggttggagtgcagcggtgcaatcttggctcactgcaacctctgcctcctgggttggagcaattctcctgtctcagcctcctgagtagctgggattacaggcgtgcaccaacatgtctggctaatttttgtaatattagtagagacagggtttcgtcattttgaccaggctggtcttgaactcctgacctcaggtgatccacccaccttggcctcccagagtgctgggattacaggtgtgagccaccgcactcagcaatattactattatattttagttttatgaatcatgctttagttttgtatgtgagaaatttttatctaacgcaagatcacaaaaattatacatatacattttgccatttaggcttaggttttgaatctattttgagttaatttttgtatttttaatgcctttgttattactaccaggtgaattattttcgggtcagtttccattgattgatttatttcctcattgtagacagcattttcgtgcttctttgaatgaattatggtttttttattaggttccagatgctgtatatttatctttttattgttgtatattttcatattgctataaatattcttaagctttattctagtcaagttatttagaggttagtcctttcagaggtttttaaaaatttattaagtgagaccagaacagtatttgactaggaattatgtttttcctgtttattgatgtaaaatttttctgtgtatccagtgccctcaattgtaaggattttggttctggctgatggtaataggcaccatttacggtcctgtttgaacatcatatgcaatttcctctaatcctttcaaatagatcttgtcccagcctcagtttccttacacagatgcactgattagttcttaagcgaatactggggggagcactatggatgtctggagtccactctttgtccatctctcttcttctcggtactctgctctgcaaactgattttgccttccaggctcccagcttcatcaccttaactcaaagaggccaccaaattcttttgcatgggttctcctccatgcaacgcatcgtgtaaaatctctcaagatattaagcagggactattttagggttcatctcacttattttccatctctaagagatcatttttcattatgatgttcaattgttttaaaaattattgttttcaggtgaaaacaacaatttgtctctgttacttcatctagactagaaggagtagtctttgtcattttgttttgaattgtagagaaatatacttttatttcaatggtagtgtgtctcaacctttttgcttgtttaaggtttatgagaaatttaaaagatgaaaatgaatgagagggaaacacatccatacctattttgacaggctattttaaattaaaaatcatgcgagttttgaggttagacattattttgcttagttacaggaatttagtcttgttatgaattcttatacattgttggaatggaaaagaaaatttcggtatgtatatcatgagatacataaaaacattttttttaaatttttactggcttttacttagtgtcaaggaattgaccaaagaaattgcttctttttaaacttgtgattaattaatgttgttaatcaacgtatttaatttaagggttaaagcaagtgcataccttaatcttctagcactcataagcccatgagtaatcctgacattataataacaaaaatattcaaatttgctagttccatagctctcatccggtgatggagggacttaattactgctcaaattttcttcaggttatttccaaaaaatattttatggcttcttcatatgtgaggaaaatacctttttcattctttaactttgaatttttcatggaaattcacttcatgatccttgtggcacataggagaaggtagcttttcccattacctttggctaatgaccttctttgaatgcataagatattttacaaaatttatgaatcatattttactaaaattaactcgctaattaattgattaccctgtgtctatgaaaaatacaaaaattagctgggcgtggtggtgcacacctgtaatcccagctactggggaggctaaagcagaattgcttaaacttgggaggcagaggttgcagtgcaccaagatggtgccattgcactgcagcctgggtgacaagggcaaaactccatctcaaaaaaagaaaacaaagcaaaaacaaacaaacataaaaagacattagatccaaacaatttttcacaatatgatcaaattgatgtcttagtgtagcagtatctaaatgagttggtaaattaccttccatttgtgttggtaatgggaagttgattgagatagattattttacctacattatgttatagtatagattacagttggatcatgaagttcaagtgcattcattgtctgctattttatttactagtttggaaataaaatactctgtttgctgaaagtagtcattatataaaaagtcttccaaggtaatcttccaagagaataaccaatcttacctttccgtcacatttttctcttcaatcagtaactctaaatttaaagtgttatttgtatacctcccaaattgaagccaaacctggggttagctatttttatttattttcacatagaaacattatttagatataattcacatcatcaaattcatgtatacaatttaatagtttttagtaaattcacagaactatgaaactctcaccacaatcaatttcaaatttttatgattctacaagaagcctgttagtgataactcccgactttcccccaactgtctccaccctaactctaagcaaccacaaatctactttctgtctgtataaatttgcctactgtggacatttcatctacaaaaatatatattatgtgttttttgtgattagcttagcataagctaatatcatctgtgttgtagcatatatcagtactttattctttataattgccaaataatatatcattgtatgcatattccatatgttatttagtcattcattagttgatatgcatttgggtttttatgctttggggcttttattttaaaactctgctataaaaatttaggtgccaggttttgtgtagaaatatgctttcaattctcttgagtatattcctgagaacagtattgctggactaaatggtttctgcttcacgtaccttaagtgctctctttacatagatgtatacatacttataattgttatatctttctaatggatggtcttttctatcattttgaaatgttctccattattttaatatattttattttaaaatctgctttgatattagtatagtcactctagctttctattgcttgctgtttgtatcatatattatttttcatccttttattttcagtccatttgtatctttaaatctaaagtgtgtctcctgtagaaagcatatatttttatcatttaaaaaaatacagttttataatctcggctttttgattgaatttttaatcaactcacctgtaatcttataattgatattggttaatttccatgtatgatattacaataattgatataggtttattttcatccatgattttacatttatcttctatgtttcatgtcatttttgttttatgttcattctttaccactttatgctatatgaagtaaatattttctagtttaacatttaaattcctgtaaaaatttttcactttatttttaaattatattgttagtagatgctctcaggcatatcatatatattaacttatcagaatctaaatcagattcataatagcctaatttagaagatatagaaatgctactacaatatagctgtttgctctttctcccatttttgtagtattgttgttaaacatattacattttaagatgttaaaaacacaacaatacatgattacaattattacttcatatagtgttatgtctttaataaagctgagaaaagcaaggataccaagtacctaaaatttgttacataaaacatattatatgtttttaattctcctaatttcttcctgcaaattcaagttaccacctagaatcatttccttattctacgaaaaacttactttttatccacttcctttgtgctgttattgtcaaatatattgcattttcttgttatagaccctgtaatacaatgataaataattgttttacatcattaattttgtttccctgaataatctttgttctgattattattttttaatcacttaagagaagaaaaaagaagaaacatgccattttaacctctttttaattatacaattacctttactggtgcttttttttttccttttctatctgagatcacttgttttagcccaactttccttaacatttcttgtaaggcaggactgctttaataacctctcttagattttgtttacctgaaaaatattttatttcaccttcatttttgaaaaataattttactggatatcaggttcttatctgacattttttccttcttttagcacttgggatatgctacccaactaccttctgaccttcattggttttgatgaaaagtcaattgtcaagggagttcctttgtaaaagtacccgttgttgttggcttattgtttattgatttggatgaggtatttctattgcagtgtgatgtcattcctcaggaaacgcaggctttggcacgtgcacagccaccgtgggaatgataatggcttcagcagggctctcactgaatgtctttctttcctgttgtctctgttaagctctctgcttacgttagtatcacacccagtgattccccttcactatttgtcagctggttgccctactgttttcaataatgctatgtgcataagttgttctatagcttgatccatttacatctagaatcctttgctgggctttattgttttgttttgttttttcttgaggccagtctttgagattttctttaacctgtgacgacaggaaggccgttgctagttgtctttttctctggttttcttttataaactatggtttagcgtgcttatctcatctaaacacaagggctttcttacttgctttcttccaaagtctccactttgaacttcccccaactctgttccaaatagttcgttcccttagagagcttcagaaaaacacttccctgttatagctggcttcttccctgggcaaaatggtggtagcttccggtcttcttgctttgtctcttctggattgaaatctcccctctataagtgagctaaagtgagagctattggggtccctttattcttggcatatgagcagggactgggtgaaagaagagagtcccaacctttcagccacaccacctggaattttgactttgcaaccaagagtaataatgactgaaataagaaatgctggcagcctgcctcttctggaaaggaccgtagtccttcgttgaggaaacatggatctccaccttgggtacatctatccagttttcctaatgctgagttggggatgaggttgaattagggagaaagtcatggttcaaataccatagactctatctgttcttactaagatttgctagttttttaaaataattatttgttcatttgctatagacccttggcacaattttcagagaccttaaatatgtatgtgtgttttagaatagttttcactagttatggttgtttagctggagagaaagtctgcagagctacttatttagcatgatgttcaggagttgcccccaatttctttttcatactcatacgttttcacgatattgactcgtaaattattctaatttatcttcttaaaaatatattccttgctttatgtttatgtatccttttgtctctcacttcctgctaatttttcatagataaaatctgcacttttctattttatattcaaaaaatgtctttattttttgcctctataggagatgaaactattttataattttctttttccttgtaagtatagataatgtttagtaatgttattccccctttttttgtaaaatttatatggaaaaatgtttatgaattgaaaagatttaacagctaggtatatttttaacttggtaatttttcatttagtttttttctctttagtgatattgccaatctcctttcttcccccttttgtctatggtgaatgcctgaactcccaactctaggaagttctgataaatgggactctaatctagttgatctgcagtgagaattacaatggctgtggaaaatagcaaagatagaattgaaaaacaaagggtaaatatagatctgcgtaaaagaaaaaagttagtctgtctaattccaaatattttgtcatatccctctagattttgtattcttccaatacagaaactgatgggaggatttaaaaagagataaactacaaagaaaatcaattaaagactgacaactgtccccgaattatatatattgacatggaacgaatctacttactagaaggaaaagaagctttacctggctgattgcaacctttattttaattaattaaaaacatacttgttaagcatctatgatgtttcagatactgtcctagatgctgtacccagcgtctaaaacctatagagaaatataaaaattaggaatttctgcagacgaaagaaagaaaagagagcagaagggagagaaagaatgaacagaaaaagaaaaataattagtaaaaaaggaaataacaaagttaaaaatttaatctaatctttattttatgaatacataatttatattgaaccttgtgaatgtcccaatgggtaattttaatttttaaatgatgtgattctcagaatacaaggtaacctgttgaaaaattattgtaaaaactctggtagtacatggtacatagaaatattgtaatatattcagaaacttatcatttcatcacaatgttttactgatgcaagtgattcatttattcattttcactataggtagatgaggagcaggttgctttttctgacatgtgctgagtgctgcaggactccatgaaacaaatagtttgattaccagaaaattgcatcatcataaatgtttcaaagaagtcacacttgcctgctgctacagaagttgctcaaatgcgtagatatttttatttccttaaagtttattctactgaatagacttaaaataattttctgccatatgttattatattttgggcatgcaataaaacatcattttaaatatatttgaggagaaaggacattctaatgtagacaaatatagagcccaccctgaggcttcgagtcaggtaatatatgtacctggttcttgtagcacctctcaatgtagatctgcgaaataacatttaagatacattttatgaaaagcattgacattttacttgtctgggtaaactgaaaaagagactttaatatttagataaatgaagtatctcctcttaataatcttccataaacattatttttctcatctgaccttttcagatctattaagaagagctgaatttcagtactattccttgctaagtgggatagttatccatgttaccaatgaatggtggggtcatacctgtagagtcagttaagaaacaggattatgactggtacttccttcaaaaagttgaatattataaggacttttaaaaatctaccctatttcagacaggaattgtatgaaagggtgctcataggcaagaatgagatttgcctcaagaatttgtttgaattctttttcagtgcacaaatgaatgtggttaccagactttaaagttatacaatgtaaaatatagccactatgtttggtctagagacagtttaaaacaaatacaaaatgaaaagctttgcttgaacattaaagaaaagtgttttgtaaaatatctttgagcatttaaccttaagacacacacaaaaaagtattgacatttcctctaagacaaattgcctttaaagtatgcatccaagttactgaatgaattagccagacatagttactttaggtcagttaagaaagaaataatggggaagttggctgtgttctaaaaatggtgtatttagttttaggaattttgatttacagaactgtgaagcagtaattacaacatgtccagttctccactgagttcgttcactcctaatttttgacaataaagccaactctcatgtaatgcgtatattttctgttctctatgagatgaggtcatgaatctagctcactggttatggcacaaaatcattaaaggaccactgacaacaattatgtggattcagactaaattccttgatttctccccctgaaactatcatgttatccatcaaaaaccacttttacaaaccttacctctgaaaatactagtaaagttcaagttccatataagcatcactgtttgggacacactaagaccatgctgttttgctcatggtcagagaattcaaggcccatataggaaatgtcacttaatagcctacatgattcctaagagataccttcaagtgatgagaaaatatggaagtttcagtttctaaatcctgccttgttcccagtgtggtctattgaacttggaatggattaaaaagaactggcctactctaggcagatggctgataaagaggtctatttcaggatccagggaaagtatttcattataaaagtgaaggtattggctggacacggtggctcacacctataatcctagcactttgggaggccgtggcaggcagatcacctgaggtcaggagttcgagaccagcctgaccaaagtggcgaaactccgtctctacaaaaaatgcaaaaattagctgagtgttttggcatacacctgtaatcccagctactcaggaggctgaggcaggagaatcacttgaacctgagatgcagaggttgcagtgagccaagattgcgccactgtactccagcctgggtgacagaatgagactctgtctcaaaaaaaaaaaaaaagaagatatcttcttttccagtctgtctaaatagcaccaaaaccgcaaaagtggagaaagcaaataaaccaaaatagttgagattatactgctcaaggcatataagcaccactgtggagacaaggcaacttctctaggaacttcacttaagaggattttctttttccaaaacttcattctaaaagtggccagaaactagatatagagcctgatgagttaatattataaacctaggaaagatggatatgaaagtatctccggaaatatgatattttgtgaaaaaaaattggatgcaagaaaatcaagatatcttggcttttttttttcttcttttttttttttttttttttccagttaacctaacttgaagcatttaaacttacttattttgggtgctccagtgctcgaacttaaatttgctatttcttttttcaccttagttcttgctaagacaaaagatctaatctcctgaatataaggagattgctattctacaatccagattttataaagataaataatataaaaactaatagaaagtcctttatcttgagactttaccaagaaatatttaggcagctaatttttgtttagaattatacttgaggaatttttctttaggtatatttaaaaattttattatagaaaatttctgacatatgcaaagtaagcacaataatagaatgagaaactgcatgccatcacccaattttaaatgtatcgacattcagccatctttgtttcatctatccctctaattactctccactcaattgtaattattataataacttacggttatgattttttttttttttgagatggaatctcactctgtcacccaggctggagtgcaggggcgtggtctctgctcactgcaacctccacttcccgggttcaagcgattcttctgcctcagcctcctgagtagctgggactacaggcacccgccaccaggcccagctaattttttgtatttttagtagagatggggtttcagcatgttagccaggatggtctcgatatcctgacctcgtgatcctcccacctcggcctcccaaagtgctgggattacaggcgtgagccaccacgcccggcctacagttgtgatttttgagggaaaatttacatacattgaaataagctaatcttaactgtaaaatttttacacaaattgcaaagcagatgacctcacaccgcttttgatgtagagcatttccttaactccagaaaacccgaatatattctctcccagtcagtttcccacatgactcaccaccaaaagtgaccacgttttgactatttaaatgtccagaaggtctactagagagagtaggaggagtggttatgtggattatgaaagaaagaaattctgaaatttcctttgtttcttgtttgttctcaaggttttctagtcatttcattaacacattatgtaatatataggacgtgcatattttgaaaaatgtaaaatgaaatatatatatatatatataatgtccaatggaagtttttgaaaagaaacaattaaaaaataacaagagagagaaaaagagaaaaagatgggaagagtaagtcccactattcccactccatctttagttatgtctccagtgtcaaatgtttgcactgtactcttgctcctcaaaatatggtctgtgggctagcagcagactctcagactccacactctaacctactgaatgcgaatctgcattttaacaagatcatatgtgcattgcattttgagaaggctattcttgatcaccatgtaatataactgacatgcaaaggaaaggaaagtggacagaacatgaaagaaggatacacgtggtatcagcaaataaactatacaatgtaaagaaaatttctgttggctctataactgtgtaatgcatcgttattttaaaaatacagaaagggaaagcagagatacattttaagtgtcttctctattcatttctttggggaagaaggtcagcctaaaatatgagaaaagatattatgattggctcttctcaatgttttttctgttcatcttaaggcttctggtaaccctataatctatcacataagccgatattaaaatcaacaaattacacttttgtttattttacttgaattagttcattaaaattttatgatttatacaattgctatcaaatgttatgtgtccaattaatattacattaaatgctacttttgtaagggaaacagctaaaagaagcagatgtgtgagttcttaaagtgcagctgttataaaaagtaaacaaccagcagtaatactttggagtaatttctcatatgttgtgtagcacaattataaaaattgtttgtcaagagatcaatattttcttactctgacactgcttagagctaggaacaagtaaacgttgggcatagagttataaaaaaagaaaataaatgtaaaaatgaagcaacatatttgtataaatctatgagactgaaaagtgaaagaaccttataatattttaaatataagcaaagaatcataaatgcatctgaattattgtgacatattttttctgaaaggtcatagagtctttaatatttttaaatggaattgtacctaattttcaagtgcaaaaatcttagtaaatgactttagtaaaaatgagatgagatatttcataggacacgtttataaacaattctgcgtataattttgtatcctgtgttatttactttcagttaaaagatggaattgagacttcatggttctgttcttctttctaaatgttagagattttcttactcttcagaattgcctaacatacataaaacattttgtggtaaaaatcttaattaggtcattttcccctaatatgtgaaactataaacatattttcaagaacaagacatatcacatctatcatttaatctcttactaatgtttattttatttctatctttaaaatcaatcaatatgataaagtcatacttctgaaataagtgaaagttagtgaacatgcatatgtctattaatcaaatgttacatcaaatccaatactattttaaaagcccaatctttgcgtaaggcacaaagatagaaaaactgaatgtattcatttttgttattaatacattttaaaatgtttttaaaataaattacttaatataagttaaaatcaaattatgtattttatgtgaaaggtcttatttactgacaatatcaatgtttatttgatactgaatgatgtaaaaaaatgacagaaagcaagaaaactgaatacacttttccatcaactacatttaagatcttgttataatgataacttaaccttatcttattagtttgatttctaaacctttaaaattgccctcttcttatcagctacttcagacttgagaaattacaaattaagcaaaaatattgctaaacctcttttccacaaagaacaaatagtcccttagtgcaccatttaacgatggatctaaatcatgcacagcaagtttaaatatcgataaatgaattcacatcttgtagaaagtactcttgttcatgctgaaataaattcctcagccaagtgaagagcattcatctcaatgtaaatttcactgcaaatatatacttaagtattcaaaatattcagatggctgtgctccttttctttccaaagatgacaactttctcatcctaagtatcctttagcaatttatgttcacctcacattgttcatgttaaagttgtatttcaaatgcattgtgctttcttttaggcatagccatatagttgtaaatttgcccttcctaactgtgcttgtggctcagaaaattaagattatgttttagtaaaacttatagctaagagaaaagacagactacttttgtaagatgatatgcattgttttaatggagtatataagaatatcttgtgcctgattataagctaggtaagcctgagaccaaagaaataaaattgctgcgcccccacccttttataatatttctggatctagctcttagaattttttaattttttttattatttatttatttattaatttttttttttagacagagtcttgctctgtcactcaggctggagtgcagtggcgccatctctgctcactctgcaagctctgcctcctgggttcacgccattctcctgcctcagcctcccgagtagctgggactacaggtgcccgtcaccacatccggctaattttttttgtacttttagtagagacggggtttcaccgtgttagccaggatggtctcgatctcctgacctcgtgaagaatttattttttaagtaattgtaattttatttaattgaattgaaatagattaaatgttaaaatcacaaatatttgcttcttaaaaattgataaaaatagggagaagctgtttccattatcttgagtaaatgcaatctgttttattttgaaaggtgtcacattttaaaattcatattttattttcagatgtaaaatatttaaaagaagaggatgcaaatcgcaagacattcactgtcagcagcacactggacttccgagtggaccggagtgatgatggagtggcggtcatctgcagagtagatcacgaatccctcaatgccacccctcaggtagccatgcaggtgctagaaatacactgtaagtaaacactacttccccctcctttatctcagcagcaaatctcttcatctgcatctaaaatcatttcaaaactacctgaagttatagcaaaggtgcagtaaaatccacggcaaaatgaagtaaaactacattcactagtattaatcaggttcaaaggaaaacactccttgtctgagtttcattcttaacaatgaggaaaaatgaaggagatgtacgaggttaatactcctatgtttcaaattgtggcttaacgtaggcgtgcacgtaagggtgggggagaaaaagtagtaatttgagcaaaatcactgagaatcggtaatctgagagggccttgatgaacagtgttatattaaaataactttattttatgcaattgtggcttctcagctatgcttttaagattagactagttttaccttctctatggcatatactaatgtataaatataggagcttatttattatgttttcatcatcatcattattcacaatcaataagaacaaaattaattttgtgaatctaatagatcggggcagtgctaaatgttttgctggaattatgtcattgagtactcatttacgaatagtagcctgatgagtagttactctcattagtcacaagatacacacaaggattctgaagattatggaggctgagtcacacaactagcaaatgacagacttgtaattatggcagttttagtacctagcaaggttttagtagacaattatatatactaatcaaaatgaaaatgaatgaattgaaacatgtgaaataaaatataaaagaatagaggataggagataatatgttctgaattgcaatatttgattttctagataatgaagattttgttttctctatttgtgataaaattatagcttgagcttagaaattgtgtgtgatatgcaattacattaaatcctaaaatactaaactctaagtactgttccaatatgtttcattgcattttgttttcatttatttattcaacaataattttttagtggcactatgtaataggcattgttttgggcactggggttacagcaatgaccaaacaaaaacacaaaacaaattgagtttgtctccaagtgtcaaaataatcacctccgctatcaccaacaaacttcatttctcttacagcatccattctaggtagggatgaaaaaaataaataaatggaacatatcacatgttacatattgataagtactaagtacctgttgataagtacatggctgcaaggaaaataaagcataggagggcagtaaggagactgaaatggagattaaggaaagtgagtatgtgtgttggtgtaatgcagagggaagggcaagtacaaagaccctgaggtagcttgtttgttgtttttatttctaggaatagcaagggtgccagtgagactggagtagagtagactaggagaaaaatacagagtgttgtgagaaaagattggagaattgccaggtgaactagaattttttgattactttttatatggaaaatataaagctgactataatatgcttatttttaaattattcttagtttagtagttattgaaaacattataatgtttaaatgattacaattatgttaggttaattttagtaatttactgctattctccttgaagcaaattcagaaagaagcatacttcagagcccaaatggagattatctctcaattttgacatttatttgtattttggctttgggaaaattactgaaactcgttgagctttgattataaagtagaggagtcattcctgtgaggatgtgatgataggctagagaattaattccttgaacttaagtcaagttcatggcatttaatagactgaataaatgtcaattgtcttcctttttctgtttctttttcttacatcagtgggtctctcaaaatataaaaaattgtgtaacaatatttttaaaggaccaggatcaacagcattttaatttaaactctttaatatttacatacaaagcaaagtaaaactaaatttaaaataataattgactacttagttaacggtaattctaacatataattaaataaaacaataaaaatcagtcataagaactattgaagaccacttccagtcacagatcacccaaaatctaccaatagtcaagcaaaaccacatttatgtaagttgctctggcaaaggagaaaacatagcagatgaatctctggatgtaggtaagaaagagtgagaagagacttgttacaggatttgggcttgtgccggctattctaaagaggcttctggattgtgtgttctcaggattaggagcatgtcagtgatgggtgtatgagtaactttagctaaaaaatgaaaatattgtaggtttgctattataaagacacagtagttaattttgctaattttgtggacattgagggtcctgatctctgtcttgtttcacacctggtcataagatgaacttgtctttgtgttattccacgccacagtcacagactacctttatttgattactctacacattctggaaaattgtttgttgagaatattttagcctatatgtcagctgccaaggtcattttcactactttggaaatcaaaaatggaagtattatacaattcttgagcattttagccattaaccatatttcaatatgcatgaataagtaaaacttcatggaggaaggcaattgaattatctaatttttaaagaaagttttacattaaaaatgttacacttttcatggctagccaattaaaaatagcatctcattctatcatggtttaatatgtaaatggctagaaggcagaaaccagatctatttaaattattttcctagcatctagcataccatcattcaagtatgtgaagttaattaaaactaactgatgataatgctaaatgtttctttaagcgtgcagaacattctccggagattaaatgagtagaggatggaaaggagacattgagcaacagtcagcatcaatattagagcaaattggtgtgattttcataaacatcttagaataatgataatagcatctcaatagttgttcccagagacagtagatcatggctgcacttagatccacatgtgcaatctagattatatagaactttccatgaatgagaaggaggaaagaagagctcagccttggaaacgaagaagatgggttaatctgggatttatggagcataattttagtatttctccattgtttgacaatattcttgtgatgaataacctaaaagactggcccaaatggaagaacatttagcatttcagatccacagagatgatattgttttcagtggtaagtcaaaagagtaaatatatattcctacaataatggaaacagctatgactacatctaaaataaaaatcctctgatattgtagaaacctaagtttggtgagcaataagaaattaaagataaacatacaatgccaagaggcataatgaaaaaagtatagtaggaggacttatatttctagggcttaactgtgttaagtctgtaaccttgtgatatacaatttatatgaatctagcctgtaaaatatatcagagcaatgtttttaaaaataaaatattaatcatacatttaaatactgccactatgatgaaagagagttctctttttttattattatactttaagttttagggtacatgtgcacaacgtgcaggttagttacatatgtatacatgtgccatgttggtgtgctgcacccattaactggtcatttagcgttaggtatatctcctaatactatcccttccccctccccccaccccacaacatgccccagtgtgtgatgttccccttcctgtgtccatgtgttctcattgttaaattgccacctatgagtgagaacatgcagtgtttggttttttgtccttgagatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtaaatagtgcctcaataaacatacgtgtgcatgtgtctttatagcagcatgatttataatcctttgggtatatacccagtaatgggatggctgggtcaaatggtatttctagttctagatccctgaggaatcaccacactgacttccacaatggttgaactagtttacagtcccaccaacagtgtaaaagtgtttctatttctccatatcctctccagcacctgttgtttcctgactttttaatgatcgccattctaactggtgtgaggtggtatctcactgtggttttgatttgcatttctctgatggccagtgatgatgagcattttttcatgtgttttttggctgcataaatgtcttcttttgagaagtgtctgttcatatccttcgcccactttttgatggggtttttttttattgtaaatttgtttgagttaattatagattatggatattagccatttgtcagatgagtaggctgcaaaaattttcttccattctgtaggttgcctgttcactctgatggtagtttcttttgctgtgcagaagctctttagtttaattagatcccatttgtcaattttgtcttttgttgccattgcttttggtgttttagtcatgaagtccttgcccatgcctgtgtcctgaatggtattgcctaggttttcttctagggtttttatgattttaggtctaacatttaagtctttaatccatcttgaattaatttttgtataaggtgtaaggaatggatccagtttcagctttctacatatggctagccagttttcccggcaccatttattaaatagggaatcccttccccatttcttctttttgtcaggtttgtcaaagatcagatagttgtagatatgcagcattatttctgagggctctgttctgttccattggcctatatctctgttttggtaccagtaccatgctgttttggttactgtagccttgtagtatagtttgaagtcaggtagcgtgatgcctccagctttgttcttttggcttaggattgatttggcaatgcaggttattttttggttccatatgaactttaaagtagctttttccaattctgtgaagaaagtcattggtagcttgatggggatggcattgaatctataaattaccttgggcagtatggccattttcacgatattgattcttcctgtttatgagcacggagtgttcttccatttgtttgtgtcctcttttatttagttgagcactggtttgtagttctccttgaagaggtccttcacatcccttgtaagttggattcctaggtattttattctctttgaagcaattgtgaattggagttcactcatggtttggctctctgtctgttattggtgtataagaatgcttgtgatttttgcacattgattttgtgtcctgagactttgctgaagtttcttatcagcttgggcttagacgatggggttttctagatatacaatcatgtcatctgcaaacagggacaatttgacttcctcttttcctaattgaatgccctttattcacttctccttcctgattggcctggccagaacttccaacactatgttgaataggggtggtgagagaaggcatccctgtcttgtgccagttttcaaagggaatgcttccagtttttgtccattcagtatgatattggctgtgggtttgtcatagatagctcttattattttgagatatgtcctatcaacacctaatttattgtgagtttttaacatgaaaggttgttgaattttgtcaaaggccttttcagcatctattgagataatcatgtggtttttgtctttggttctgtttatatgctggattacatttattgattttcgtatgttggaccagccttgcatctcagggatgaagcccacttgatcatggtggataagctttttgatgtgttgctggattcggtttgccagcattttattgaggatttttgcatcagtgttcatcaaggatattggtctaaaattctctttttttgttgtgtctctgccaggcagaaagagagttcttttaaaactgaaatttaagaaaatcaaaagcagaactttcacaatgaatcacaaatacctgcagattttacataacagggaagaggaaacttcacaactgagcagtgggaaaaaccacttttaaaaattaatcaatgaaaactcaaatttgtcctcccatttttgcacagatttctttgtaaaataactttttatttgtgagttaatttttagaagaacatattgtatgagtcagatattatttaaatctcagtataaataatgtatctgcactcacagtgcacaaaacacagaaaagaagaaaatgactgaatattcattttctgtatgtatcattgacaaaaattacattaaaaataaacttaatgaaaatgaaaagtgcaagagacagaaaactaaaatatgtcagactattgtgtgtttttcctgaaaaagcattttaatactgtaactaagaactgaaaatatgaaaaatgagagttcaaattttaaaaaatgtgtgtaaagtatattttctatataattcatctcatcatgaaatcttatgcttatcattaatgtttgtttagtacttcttttaacagtactaggctttgcctataaaaatgagtagctatttacacatgaaagttattactgtttaaagcaataaatagttaaaatagcttgtagaggagaccctgcatgtacacccaaaaaattctgagtatcaaggaaaggaaggaatgaatggctgaaggaaaggaggaaggatgagaggaaaataagctgaagtgttaaaattgtgtttacatgaaattaattaggttaataacgaatgaaaataagaaatatatcatatatatttaaaataacagaaaaacgtttgggtccaattgttactaaaattatatctttttaaggggttaaatggtcaattgacagtcctgaccttcttgatgattatatctctattctagttaccatgcgaattactaataaagtcaatccatttttctcttaacaacttacatttttaaaatgtatcaaactatttctgaagagattccttccttgccttactccgttttaaagataattactttgtgcccagagaaactaaattcttccctgtacttttttgttacttttctggaccaactaatatgcttgatcagttctctgtttagttgcaaaacaatgaaattgatttaaaataaaattctgattatagaagacaatattcaatatagatgggtttaaagtttggtaattcagttgttcgtatcttctttttattctcagatgtgggcagagattctttatttcatgtattcttggctgttgtcctttttcacttgtaaaaagtaataaagttcttatctatgcagtctacactacacaaacccgtacgtttctctagcccaggtcagtttattttaaattgccctatgttagttatattctctttgctttcactacctttctacatattatatattaagtgtttcaggatatatcagcttatcagataggaagacgaatattccaaggagcattcaaaataaaatatctcactcatctggcatctcatttatgaaatgctaattatctaattatcttgtctaccacaaattatatatagcataagggcacagaatataaaaggaaataggaaaggtgaaatgaaaattatatttgggttacatttttttagaactaaactgttcttttgacaaacaaaatgccatatttatgcctgggaatgccttagaagaattttaatttagcctaagatatttcaaaaagctactgaaatggtatatatgctagaatcataaggtgatctatgctgtttagtaagagatgcatttcattatgtcaataaagatagcctagagtgtgaccactatttgagattctaaaaaatttttaatttttttcagagaagttacatttatgtatattaccagcagtatatattaatggcacattttgctcatgagacaaatattgttttcttttataaaatataagaatatttatgttaaatattaaaagtaattgaatcatcaggtattttaagccatctacaggcaaggattcaaaatgttgttattgtgccatctttatattattaatagtacgtaacaatttgtgtgtgtgttattaaaactcattgaagaggatatatatatttgtgaatgggaattccaaattaaaagataataaatgtatatataaaattaatataacatactctcaaatttcctaattaagcttatcatcaagtacgcatttataaaactttttggaagttttaaaattattttgaaaacacaccttaatttcataaagaggcagtaaaacataacatcaaaattatggaatgtatgtatagtacagatgttagtgaatgttttcaattatttttaagtcagtctaatagagaataaaaactggataaaaatgagacataaatgaccgtgacaagtaaaaatatcatatacatcttgttaatacctaatatttttaactttcaatttaataacttattctactttatgtctatttttaaaagatagctacaggtatttttgtattaaaaatgagtagatatttaatgcccaatattttgaaatttttgtatttctactttctgaataaactataaacacacacacatacacacacacacagacatacacacaatttccatgagaaaaacgtatagttagaaaatgactgtaataaatcaatgtattagactttactggattggctcttgatatattaggaaagattgttattgctatttaccatcaggtccaatagtctggtgtttttttaaataatatactttatttttaagagcagttttgggtttactgattagctgagcagaaagtacagagggttcccatatacaccctctcctcactccccttatagtttcccctattattaatatcttgcgttattgtgttatctttgtcacaactgaagaactaatattgatagattattgttaagtaaagtacatcctttacattagggttcactctgcattgtgtagttctatgggttttgacatgtgtataatgtcatgtatctactgttatctctctctctctctctctcgttacatcatccaatttaattctacagcccaaaaaatctcctgtgctccacctctttatctcactttacttctcccacaagacctggtaaccagtgatcctattattgactatagttttgtgttttctagaatgtcatataatgggaattttgcaggatgtaatctcttcggactggcatctttcacttagcaatatgaatctcctttttcaccagtaccttactgttttgagtactgtagtttgatactgtgtcttgaagttgggtagtgtcagtcctcagatgattctgctgctgctgcagattcatcatcatcttcttcttcctcttccttctcctccttcttcttctcctccttcttttgcttcttttctttcttattctttctcctttcttcctctttccccttctttctctttccttctccttcttccccttctttcctttcttctccttctatattgtaattatgttatgttggtcaatttgtaattataaattgttgtaatttttatcacatttataattaaaatgtgattaatcagtatattaaactttattaatcctcaatgtatcaggaaacaaaatagtcatatctactatctgggccacactttttttgttttatactctaagtcttttttttaatgacgtattaatgtaataataaaaggagagtgaacaacaaattttattagaactttcaatacaaaatttaaacagaaaaaccggactttttattatctatttctctggctttaatggtatatatacacaaattgcgcaataattggcatgcatgatcctgaaatatacccatcttgtaaataatgagtcaagcttcaaaatgcatctctactgtgtcctatcttgtcattgctttttggttcttctttcactagcattgttagaatgcaatactttagaaacactttgatggctcatagttttacccagaagaatacaatatctttattccataattgcaaaacattttcatttttagatttataaagagcaattaaaataaaactaaaatatatattttttgttgtttttttttttgagatggagtctcgctctgtcacccaggctggagtgcagtggcactatcttggctcactgcaacctccgcctcccgggttcaagcgattctcctgcctcagcctcctgagtagctgggactataggcgcccgccaccacacccagctaattttttgtatttttttagtagagacagggtttcaccatgttagcgaggatggtcttgatctcctgacctcatgacccacctgcctcggcctcccaaagtgctgggattacaagcgtgagccaccgcgcccggccgaaactaaaatatattcttaaaatttcctcatcaccaaatgctttcaacatgtttccatttatggactgtgtaaagtaaattcttatgttcaaaaatcataaaaggtaaaagaacattgtcatattttcctttcagcaaaatcatatggttgcaaaatattgtgtggtgaagtccttctttgtattagaaactgttccaactcatctatttttgagcttgatagaatttatctagagtatcaaaagtgaaaacttgttttactgtcattttaagaggcttgagcttcactgttttctctttgcatttctcctccaatttttctaataattttggggtgtctttattaatttccttcttttgccattataggcagaaaattaaaaattctgagttctcaattgatatcatgaaagcaaaaaaaaaaaacaacaaaacaaacaaacacagtagcaaacagaactacaatatggtgtttttgtttctatacttcttttaattttttacaaaagaaaatccaaaacctgggcaatcctataagcacataaggattaggtaacagtgatgatttatatcacttgcataaaccttctaccccagcattgtccaatataactttctgtgataatagagatgttctctatctccagatggtagccaataatcagctccctgtggttatcggcaattgaagtgtgggtattgtgactaaggaaatgctatttaaattttacttaatcataattgaattacatttaaatttaaatagccacatgtgattagttgttactgtgtggacattcccactcttaaatcatttgtatatatatccattttattcttatgttattctttttatcatagttggggataattgatgagttagtggtgaagtaataactaggtccctgaagtagcaagatttctcataataaaagaaacatagtgtcaccaaaatttcataatgtatcttagatttataagatgatttaatgtttccatatcataattgcaaggtaagccaatttttaaacctatttttaaaattaaattgtttctttttttttggagcacctctaataaagaaagaacacaaattatgaaatatcattacttaaacatagttagaactgtttcaaatgcacttaaaataatgtaccatagagtcaacagttataaaaatgtatggactggcacagtggttcacgcttgtaatcatagcactttgggaggccaaggcagatggatcacttgagctcaggagtttgaaaccagcctggccaacatggaggaaaccacgtctctacaaaaaatacaaaataattagccatgagtggtggcgtgttcctgtagcccagctacatcgggggccaaagtggaaggatcccttaagcccaggagtttgaggctgcagtgagccgagatggcaccactgcactccagcctgggtgacaaaatgaaacaacatctaaaaataaataaataaataaataaataaataaataagaattaaaatgaacgaaagtgctgatgcatttattatctgtatttttactgctaccttttgcttccctttaaggtcttccttgtggcccaactttatgatagagacacattgcttctatgcctctcctagatacactcagttttacacactgccaaacatgtcttcttaaatattggttctttacctgatacaaacccgcgaagatttcttattgcttctaacataaagtccaaactctacagcttgacattcaaggcttttaaaatacaaccaaccccctataatgctgctctcaagtactctttttcagacaatgcattctatgctttacattatttctagatgcctcatatatagccaacattctttaatacaacactttgttaatttttcctttgccttaaatcccttcttttctttccctctagaaaatttctaccagatcaaatgctgtgttttctctgaattattttaaatgtcacttttctaagtaatcttctttgcttctgacaaatatgtataatctatcctggcaactcccatactacatcatccaagtactatggtgtctacaatattgagtttgaattattttgaactatatataatttatctaatttattaatactatattccgatgggttgctatttttgcagatgtataacagttttataatagtggtactgtgtcttgtatgcacagtgatttataaatatttttcaaataaataatgattgccacagaagcattcactaaaatcgaaagaaatttaacacaccgttgaagaaaagtaccggataattttcagtattaagaaatgtaagttaaatggaaagtgagaattttactacagaattacaaacgggaaaaataaactaaacatcttagaaaaacacaattgtacccaggaaaaaacgagaatcagatagtgctggaactgaaagagtcctgttaacccttggtattttaaccccactgttcctattgagtggtagaacttgaggtgtggattgagtttgatttacagcttttcatttcaggagtgtatcataatggcctaactcagagtattaagcgttcacttcctttcaggagtaagcaatgatgtgagagaacataagcaattcgtatcaatgcatacagcgccacagttctctagtagctccctatcttttgtaacaaagaagacagagatagatagatagatagacaaatataaagaaaataggccgggcacagtggctcacgcctgtaatcccagcactttgggaggccaaggagggcagatcatgaggtcaggagatcgagaccatcctggctaacacggtgaaaccccgtctctattaaaaatataaaaaaatgaccgggcgtggtggaagacgcctgtagtcccagctactcgggaggctgaggcaggagaatggcatgaacccgggaggaggagcttgcagtgagccgagatcataccactgcactccagccggacgacagagtgaggctctgtctcaaaaataaataaataaataaataaataaataaataaataaatagaaaatagataataaagtaaatgtaaatattttaaagaaaagtattattgacattttgggcaagagaattctgtttgtttttttgggggctggtgtggggctgtcctatgtgctgtgggatgtttagcagcactcctggcctctgctcattagatgttaattgctattctccgttcctctaacaagcaaaaatatcttcagacattttcaaatatacttaggggatgaaattgtactcagatgagaaccactattttgaagtaaaacaaaagtggcttcacaatagtgagttagtgcattgtcttctttagtattaatgttaagttctgagagatctttatatgagtgttacctaaatttagtttggaaactcttatgcaataatattgcgataaggcaaagattcacaagtctttcatctgcaagacactttaaaatttctaaatttccgttagtacaaatttgctatcgggaggttttttttttatattatttgtggatgagaagagtttgtgaataagaagaacctgtttttataaatgagacagtgggtgtattttaaaagaatattttttgactgtcaatgaggaaaacgatgtgagagagatatatgagagtgtacacaatatgcagatcatatagagccaaagccttgggctggctgctaatttaaccagatagagaaagagttaattctgatgaatttaacagaacatagtatgaaaaacatcaattgctagtgtagtctaaaagagactagaaaacacaaactcattgaaatgtgattaagattggagaaaaagggtcaaataaatttatcagtgttaacttcactcctttgagcatgtttcgtattctgtacaatgaggagagcacagaatttttggtatgctttataagagtttgatgagccaatgcatacagagcaattacatcaatgcgtattatttaccaagtatttgattaatgtttactattattagaagatagttgtgacgagtaaatttgattttctaacaaatttaatcagtagttggaaaatatttcaaaagaccattattcatttatttactcaacaattacttaattgaggtccagtagttattctaggacatgaggataagtcagtgtacaagataaaagatgatctctgctttgataagcatgcatcctaggaatatgccaaacactgagtagcaccgtttaagactaatacctgatcttgagggaccgcaatatgaatgtcacaatgtaaaatgttataatgttacaatgttaccattctagtgaaacaatggatagaaatgggtactagcactcttctttgtgtgtcttaggaactatgtaagtgtttgtcaaatgaataaatgacagtactcataggaactaattttgtgaacaaataaaattatcaatattataattttctttcaaccaaagactgtaatataagcaatgcaaatgactgctactttgtgttacaaaccactgtatttcttcactcactacattatgcaatataggagggtacagtagtctttggttgtttctcttacttagcattttggccatcatccataacaggttaagtgttgattttatataaccttaaatttctattatacttattcaattacaaaagaaatacgttgttttttattttatttttttcctgataaaacatttaactcaaagcttctttttatttatctacaaaatctggtgatggataaattttgttaagccaatgacgctaaatactttcaaagcttgtgcttttaagattgttcataaggtggtttaatagaagcttcatcacaggtcttttctcttttaaaatccttgctaaggatatagaaaatccattctgctggatcaatatctttactttgattcaaatcctcagtcattcaaatggaaagtgagctatccttacttcccaagttcataaaacctttaaatttttgtataaaagaagaatttttttttttttttttttgaaatggagtcttgctctgttgccaggctggagtgcaatggcacgatctcggctcactgtaacctccgcctcccgggttcaagtgattctcctgcctcagcctctcgagtagctgggattacaggcgcatgccatcatgcccagctaatttttgtatttttagtagagacggcgtttcaccatgttgggcagaatagtcttgatctcctgacctcatgatccgtccacctcggcctccgaaagtgctgggattacaggcgtgagccaccacgcccagtcaaaagaagaaaaaccttttgtccataaatctagcttttgaaagtaattgtgtttcttcctaaataagccccagaatatgtcagacaaaggtaaagcaataaaaaaaaaatctaggaaaacaatggggctttccacatttaaacattttatagacattctaaagaatattttttgtttctacaaaagtcttagagcattttgcttttaaaatatctgcgtattttagttggatacttacaagtactgaaaaattatttgttaatgattgaatatatgcctatctttacacacttgtacaaaacttcagtttttttgcattttgaacaaaacattcatttatttacacaacacttaaagagctcttacaatttactaagcatgagatataaggacacacaatcgagtaagttaatatattagattttgagtgctcaaaatgtggatatattacaaatatacattatgtacattcatgtatatttaataaatacaacgttgaaaggaccaattttttaaaggcattttaaaactgcgtgaaaattgctagtttgcaaaaaatatctgagtttcacatacaggacaaaactagaataaatagcagtcgtattaatgcattttttctaacccccttttaaactattactaattggtacaatacaatacattatatcagtaaattaaaaacagaacatcatacacatctccaatgtattgaaccaaaagagtcattctgtcttgtgaaatagtagagcaggaataaatgtaacacaccttgctcctacagaggaaaatagaggaattatttctacagtaagtctggaattactgtttaagtaaaatttggtttagaaaatattcccaatttcaatcatttgaaatatgtttaaaatgaacaactatgaaccagaagaaaatctataattaacttataaaacatattcacagaaaaaatacaaacttttttttctaaatctagtagataacttggcaaaagcatgtaaggaaaagtttggatgatgcactatttacttcattactattcatatctgggtcagtaaaaagtggagtaacatattaagtgcataaatttaagattattttagaaaaccgtttacatgtaatctattatgcattgtgccagtcctgacaatccattcattttgatatgtaacaaaataaataatagagagaaatatgtttacatcagagtctcacacattaatataaatagtttgaagacatcctggaaagtgaagactttcaaaattaactcagtttttgagatgactacttttctgttctttggttagctaacaaagtatagtagttctaaacgcatttacaagcattatttctagaatattattgatatcttactaaaatgtttttaggataacattgcttaatcaattctcttatgtatgataaagtgtctgatgaaaataaatagaaataataatgacatagatctttatcaaaaccaaaattacttcctgctattaaaaacaattattcgagagtcaagtttaagataataacctcattactgtagtacttgtggttaataaaaaggcatttagtgagtattactaaaatggcatgtttaaagaggaataatttatatcatggaaatataaactagctttggctgaataattaaataaatgtcttcacaattgagtactacctctgccaaaatcagatgagtaaaaaatagtttacacatgtagtacttgcattaaaaagaaattggtatttttaacaacatagaaaattgttacctaatgatatccaatgcagattatttgtaacagagagtgtgcaatatacatttaaaaaatttttctttttttaaaactttctatgggtacataattggtgtatatatttatggggtacatgagatgttttgatacaggcatgcaaaacgaaataagcacatcatgaagaatgggttatctatcccctcaagcatttattctttgagttacaaacagtccaattaccttctgtaacttattttaaaatatatagttaaattactattgactatagtcacttccttgtgctatcaaatagtaggtcttgttcattctttctaatttttttctcgtactccttaaccattcctacctccctctcaaacccccagtacccttctgagcctttggtaaccatccttctactctctatgattacgagttgaattgatttgatttttatatctcacaaataaatgagaacatgtgatgtttgtgtttctgtgcctcgcttatttcacaaaacaaaatgatctccagttccatccatgttgttaaaaatgactggatctcattctttttatggttgaatagtactccacattaaattaaatatgaactaagattaaaagttaatctaaggtttgcaacttaaatatttaagattaattatatgttaattaattaatatattaataattatattacttaataattaaatgttaattaattaatagttcagattaattataatgttaatcttgttaatgtaccttctaaacatcaggcaccaataaatttcatttaagcatttaaaaatattttagaatagtataccaaaatgatgataagatatatcacaaattttattgctggccatgcatggtagctcacacctgtaatcccagcacttttggaggccaaggtgggaggatcacgtgaggccaggagttcgagaccagcctgggcaacacagtgagactccatctcttcaaaaatggaagaaagaaagaagaaagaaagtaagaaagagataaagagagaaaaagaaagagagagcaagagaaagaaaattagccaggcatggtggagcacacctgtggtcccagctacttactagactgaggctgcaggatcgatcatgtgagcccaggaggccgaggctgcagtgagctgtgatcacacccctgcaatccagcctcggggacagagtgagaccttgtctgaaaaaaaagaaaataaaaagaatattacttccacttatttaacaattatttattaagcacacactttgtttaaacactatgcaagacatggaggatatatcaactacttttaaaaagaacattacacaaaggtgaaaaaaggaacatgcagcaatggtatctgatcagatttgaaggtaatgaatgattgcccttagcaaaagcatttgaattaagattttaaaaatacgtaagaattaaataagcaaggaatctctccaaaatggagcatttctgataatttgtatgaaggcaaaatgaaacacatttattaaagaacttgataaaaataaaattggctggaattcaaataataaaatagaacattagaagacaagaacataaatgatacaggttatgcaggacttaaatttaaaatcattaaattttaaaatttaaaattattttaaatttttattttaaatttattaattattaaaattattaaatggtttaataatttttaagagaaaagattaattatgaaaggttttaagtagtaagttgatgtgatcagatttatgttttgagaagacaattttgtttcgttatcagagtaagatttaaagggttaaaattttgacataaaggagaccatttactattttggcaaactagattaaaatagtggctgtggaactatgaaaaagtagtgaattaatttgaaaattatttagaagataaattaacaagagttcatgggtaattgattatggaaaaaaacaaagaaacgaggtatcgggtgtatgtcactgcgtggatgctagtggtatctatagaaatagagctctctgaaggagaaacgttggggaaagattggagactgagttcattttgaatacgtcaaatgtgccaagccttttagatatccaagtgaacatgccacataggtgttgcacataaataagcttgtgaagcagaactgcactaggatataaatccatgagtgattggtaagtaaatggaaactaaagataagagtgaggcttaaaagacctagagaaattcatcaaagaacagaatttgaatcccattcaccctgatcttaaacatgtaaaggctacatagaaaaataccacccaacagaatctgagaaaatgtagccagggacctaagagttgaaccaggagtatatgtgtggcagggagggggttgaggaacagatgaaacataggtatttgtcaaggaaatctagggaagataattatttaaatctccattttaaaattatctttacataaattctgtttttgtgtgtgtgtgtttccttatttatatggaaagataggtcttagaaacaggagctaatcaacactttgaataattttgaagtcaaataaatgaatactgtcttacatctcttgatttttagtaacttagagcttatttaggttattcctgagagttgtatggaaatatgtgttaagtatattatctgctttggcgtttgcttataatggaaattctgtgtgtcagatctaaagggaatgctgaatcatacttcaagggaacatttgttacacagattctcgcctctcctgtactgcttaaactaaacaggcagagcaaagccacattgtgcgttcctcttttctcacagctgcctgccactatgtaatttaccttagtgaagcagatcctggtggtgaccttccatttccctttggcacatactatttttgtgtactgacaagggcaaaagtgcctaggaaataacacctcctcaccaacctcctccacccccaccctcaggagcagtcctcaaccaaagaggataactaataaataaatattccatcaatagtcctgtgtcttgcccatcaagtaaggtaactcagagtcatgtcctccactcactctcggttccacagtggaattgaattcaatttgctttgctcatagtgtaatctgctcaataacacaggcttcatttacttccttcccttcctgtctcacttctcaaggcttcctgagattaccacctggcacattccccgctcaataaaagacagcctcagggtctctttgttaggatattggacaccatgttagggttctccggagacatggagccaataggctgtacatacatataaaaggagatttattgtgaggaattgtccatgtgattatggaggtgaaatcccaagatatgcaaagtgagtcagcgagctggaagaccaagagtaccaatggtttagttccactctgagtctaatggcctgagaacgaagagaattgatgatatagttccagtccaaaggtctcaggatccagacccagaaagacccaaggtttccattctattctaaaggcaggaaaaaagtcaacattgcagttcaaacgacatcaggcaggaagatttattttctacttggaggaggagcagccttttaattttatttagtctttcaagagattggatgaggccctttcatatcatggaatgccatctgctctactcagtctaccaactttaatgttaatctcctccaaaaaacatcctcgcattaacactcagaataatgtttggtcaaatagctggactccccaaggcacagtcaaactgacacacaaaattaaacatcacagacacccatgttaacataattctgtctcccaaaattatacatttctgatctttcacctcaaactttttccatgaaaactaaactcttctttataatatgtcatggggaaaataaatgttgctatatgtatgtttagttagaggtcaaaagaccataggcctcagtttgaccagaacagtctggttcacaactgtcatcttcataattattaatattttctctttttcttttaaaaatgtcctgctctggagatgaaattatatggttatcctagtcaataactgattccatagatgtgctgataatggaaaaaattaataaagtatgtttaaatctgatattcaatttttttcttctatcagttaaaaaagtatgatgaatgtgtatcatattttttcagattaatttttcttcctaagtcattttacaccacaagtatttactgtgatgtattttgaatgtttatttgcaaccagaatgttatttttaattgtcttcaatgcattctcttgtttaaggaattaaaggagaatgcatttgaaaagcatacataattttaaagtatgatataaactattacattttattttatactttattattctatataggagaaatctaaataatattttccttagataaggtaactcacctgaaaattacacaatcggtagtaactcatttaactggctctaaaatcaaagaatgtatataataacagtgcagatcagtccttctgttacagctaagaagggaagagtgagaataattgtgatcttctggagagttcagagcctattttgtttattgtagagaatgtgaagataagaggagaagacaatttcacattgactgtgggccagacaatgccaggactagcaaagcctcataaagaaagaatgtgttaatatcgtctcttttttgagcttattttccattttttctatgaaatatgttacctttgtgttgattaaggaatattgtatgtcattcaagttatacatataaatgtcttgaagtattctttaattctcactagggatgatttattgttaaatggaaataaataattttctaacaaacatgcagtagcacatataacaaatgttaacttttaataaaatcataaatgctattggaagtgactcactaactgtacttctgtacttcagagcaagcggcatgtgcccagtgctgcatcattgcattttgaaaagattctgcataatacttgtgagacagtaattgagcttgagttcattgtgggttccttattgtgagtccctggtattcctgtaacaatgaaagtgttgttattcagatgcacataaatgcattcagcccataataatagtattcatagccatctataaatagtttaagaaacaattgtatgaaatgcttgatattcatctcaaccacattttgcaatttctcttttaaattcagatttcagaaataatacaacagtggtgctcaggagatatttagatatttttgttagctttgcatggacaggttgttagctttttaaatcacacaccttattttaccaaatctaagaaatcctttataaatatacacaattataaataatatataagaaatgctgaacacacagcatgatgcacagttattaaatatctagttttgtatgtgtttaattacctttcttaatattcttttatttctagatacaccatcagttaagattataccatcgactccttttccacaagaaggacagcctttaattttgacttgtgaatccaaaggaaaaccactgtaagtgagttaatgagcaataaagcttttaactttttttcttttatcttgctttgattacagcctttaactgtagaaatccacagtttgtgtcttttcttggtgggcaaagtgatctctagaacagaaaacctcatgaaccatgtcttcattaaggtctatggaagattggtttttactttgtcatctagtgaagtttctgggaagatttccagctgttatttctttttgtattttttccagtaagatattttaacctgaatggagtatatcagtcactgttcatatcatcagagtataaaagcagcacaccgttgaattcagttctcccatgaaaaacttagaaaatattgaagcatccccaaaatacgcccaagttttaaagttacaagaagactcattttcataaaaggaaaatcgaatctatatttcttatgaaacacccaatgaaacaagtaatgggtcacaaactcaatgtgtttaattgtaaagtaatttcaatattagaatatatgcacgtcaatgtgataatgtcacttcaactctaaaacttcaccttttgaaatttgtgtttataaatagctagtcaaggaataccaattattaagcaaaacttacatatggatatttaattatggattatttaaattctatttgaaagcaatatgatcattctaatacaggaacactctaggcctagctttatgtaatttacttgatttgttaaaagattccaatttattttaattctgtttaaattttaatagaaggaattaaattgttctttgtatataactatatgagattgcttctggcaaatcaggttaaattgctaaaaatttgtctccaataacatttatattatttaagtttcatactatcccatggagaatgtttctaaaagaattgtaagatagatgcctggcactttaacttcataaattgtatgtcattatattttttaccatattaataaatccatgccttatttaccacagttttgatatttttaaactgttctctcttctagtaattattttaaagagattgtttttggtcttctttccttcagatttatccaaaagtacatttgtatacatttggattatgtgcacaatttatgcaattaaacaaggtgaagttagggaatatgctttatagaatgcttgaaaataaatgaatgcctgctcaagtagcatccaattgtcttacaacgattctttgattccatatctacttccaacagtagaaacattattttacttatggaaattattagactttatgttttatataattaaatatttaagtagttcatataactcatctaagatatggttgaatgaatgtgccttcttttaatctcttttcagttacctagaaataatcttggatgtgtaataatcctctgcactgcagatgaatgaaaagcacaataatttcttatttattttatttaagaatacaaatttcaagagatttatgaaatgcaaaatattacctttctcagaaggatcctgattactatcattttgcaaatagataaaggaaataagaaaggctccctattttacggaagagaaactaaggctcaaaacttttcactaaattttcctatttatccagatttaaaatgagtgagaatttgaattcagttcagtcttgcccaaagccttaactctttctattatgtgctgctacttcaattgctaaatgtaaatttccacttattctagctaaagttacttttgaaaaactagaataggactgacaataattttcatcactgaagttgaagccctagatgctttagggcagtgaactggctagtctcatgatatgtttcactgttgccatcctcctttattaggctttcttctatatttatattatttctggaaacttgtcaaatttctaccaaactagtcgtttctggcatgagttcttaaccatataaaaatctgtaatttaatgtagtgtgttctggcaaataactcatgagctccacaacgtcttcaaagtaaagtagtcattatatgttgcgtttatcttcataaatcccagtgttatattctgtatgctatggtccacaagtaaatatgtattaactgatttcttgtattatattctcattcacaactttccctttatcatatttccttgcagactgtcaggacattagcattaaagttagaatcaacttctttgatgcctttcttcatttggactattgcttcttcttcgttcttctaatcatcttaaataaacttctctatatttttacagtaactgtcttctccattagatgaaggcattaatctctttaaaaacagtctaatttttagcctttctgtagtttatatactatttccaacagtgccagatgaggcagaaaggacaaaaaacaagacaagactgaaataattggattttcccagaaggaaatcttactgatcgtaaagaaaagtcttaccagagtaaaaagaacaggatgcaaattgaaacggtttaatcagggagttagtaggtagtagggaagtgaagacagccactaaaggaaagactatcaacttcaaaaaatgaatcaaaaagtggaagagggatgagaaaaaattctgtcaaacatattttaaaataaaacataataatagcaacacatataatggggagtcttgcatattttaagatagccatacaagagtgggagtgaaaatgaaatatgtgatatactcaatcagcaggttagaattccctgttttactcaggtaatcgttgtcaaagttctactccattattttgcaactattgtacctgtatcttcattttgttatttaagaaccactgagaagcaatactatagcttagtattaagtaagcttagtatataagcttacttagtatacttaatgtactaagtatagcttagtataagtaagcacttaatttttatcatctttatcatttatctgatccacttctcattaacatgtgaaaatcaggaatgaatagtggctatatgatttctttatatcttgtagctgtcttcaataatacatttaatctgtggtcaaaacttcattgtttcttaaaaagtatttaactagtacgttttgaagaatgagttattcagagtaattaggtatattggtagtaggcaaaatcacaccactatcttttgtgtaaatcacaacatcatggcatggctcaagttgcactgagcctggtgttccgaacctgcccttctttatgctaatgttgttttccttgttctaaatgtgagggccccagtgactgtttatgaacaatcatgcctatttgcctgctttggactgaagccttttgccattttcctgtgaaacagctgcataacttgggccaggaccaaattgttccacttgacactactatagaagcattctattctttccttaaaagagagattactgtacatgtctgtccattgttttaattttagtttaaagtgaggaccgagctaatgccagccacttttctttcaagtccccagagtttttgcaaccctcttctttctttggctgaattcccagacagctttcaggcagcagcattctccattttaaaagtaaacgaaaacacacacacacacacacacacacacacacacacaacatgaaacctttatattacattaaagtcatgaccttaaatggtgtgaggttgcccccaacacgctgtaaataatgagtcatcattcattttaatcgaatgtgtaaggctgtttaaattcacctccaaaaaagtgatgcgacattttcagtgagataaatatgtatttggcatctattctgtaaaagaaaataattataggtattgataagtttttctatgtatccagcacaatgtttatgctgtacttactattttactttctggtaaccacaatttttcttttgttcttgccataaatctagtatgcataattgcacagcacataacattccaattctataaaagaagaaagaatttaatctttaggaagacagatcacatactatatagcaactagtgaggtgttttagagaaataattacacatctatttttgaaatgatcaggaattaaagaactctgatatgtatatattaatgtatttttctattaggataatagagaatttttaacaacaacaaaaaaaaaacagacaaaagcctgggtgctcacacctgtaatcccagcactttgggagatggaggcaggaggatcatctgaggtcaggagttcaagaccagcctgggcaatatggtgaaaccccatctctactaaaaatacaaaaaaaaaaaaaaaaaaaaaaaaaatagccgggcgtggtggtgggcgcctgtaatcccagctactggggaggttgagcaaggagaattgcttgaacctgggaggtggaagttgcagtgagccgagatcacgccattgaactccagactgggcaacaagagcaaaactccatccaaaaaaaattacagcaaaacagttttatataaagtcaattttcttagcctaacatgtacctttttacaaatcacaggttatttgctaatcattatacagtgcaattaccatcagacgaaatgacaaaataaactacgaatcaaagaaagcaagttatcatctagagtgaaatattgtttaccaaaataagataaaatatgtactttaaaataatattaatctataatagcaatgttaaattatttggcctaatatatagcagttgttattacagaatatttaccgctctcctgctatatagaaaacctctaattaatcattgagatctgtatgttattttcaaataggatgcctaaggtgtcatactttgaggcacaaaatgtttggaggtattgtagaaagagaatgcagacctgggtttaaattataaatctgcggatattagtggcctgagtaatcctgagcaaatcacttaaccacactgagtattttttttcctttttttaaattgatgaactttatttttagagcagttttaggttcacagcaaaattgagtggaaagtacaaagatttctcctatacccccgtcctcacccactgatagccttcctcagtattgacatgctataccaaaatgttacatttgttgtaatcaatgtacctacactgacccatcattacgacaccaaagtccaatgtttacattagggttcactcttacacatcaagtagttttatctctaaaatgaagaacacaaaatttatcaaacagattgttttaataatgacagtgtatatgaaatgtcggcctccaagtaattgtataatacatcataacaatgagggtgataaattattacttgatcaaggaaatacatacagtgtatctcagcaagtttccaactcagaagtcttacttatatatttaatacacatgctaatattaggctattatggcaactctgacaactgagttatcatctcacatatattctcaggcaatggaatccaagatttcaagcaaaataaacacatttcaggacagtgggtctgtattttcaaaaacatatttaaacagcaaaggaatccagaccgaagtcatggcaaaactgatacagcaacttcgatattttatttgaagttaaataataatagttataaattagagagaagagaggcagtgtcatgaacctcagttggggtaaaatccaaaatagttaaaacgagacactggaaaatcctgagccacaggaaaagccccttctctaatttaccttaatttaaggtaggacaagtttagatcaatttgcaaggaacagaaggaattaagattgagttttagtttgatgcgtgtgggaaaagctacactctgaagcagttttattgagtgaaagggactaagtagttagcaagttttgacaaagaacaaatgcagatctggaaggccttaaagaacccaaactaagtagatggcttggctcaggagtggtgaggaatccagggtcagtgatacataagaccttgttttggcatagtttttcataattttctctcatgcataaatgtttaatttaaatcacacaactattacattgtaaaaggtttacaaagactgctgtaatcgtttcaattttttaggtgaagaaaaataagtcttgttcaagttatatgatctttcccagtaacacagctgataaatggtagaattgggattacaaacaagtttcccttttgtattaacaacaatgatgattgtatttttttgtttacccagtgttttttagcattgatgtttttcacaataactcaataaagttggcaaacattgaagagttctaaaaaattgctaggacagcccatatttcaatcaaatagttgttaaaaaaaataccaccaggcctgccctacaagagctcctgaaggaagcactaaacatggacaagaacaactggtaccagccactgcaaaaccatgccaaattgtttttttttgtttgtttgttttttattataccttaagttctagggtacatgtgcatattgtgcaggttagttacatatatataaatgtgccatgctggtgcgctgcacccactaacttgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtatgtttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgtcgcagtaaacatacgtgtgcatgtgtctttatagcagcataatttatagtcctttgggtatatacccagtaatgggatggctgggtcaaatggtatttccagttctagatccctgaggaatcgccacaccgacttccacaatggttgaactagttcacagtcccaccaacagtgtaaaagtgttcctatttcttcacatcctctccagcacctgttgtttcctgactttttaatgattcccattctaactggtgtgagatggtatctcattgtagttttgatttgcatttctctgatggccagtgaagatgaacattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcagtctgatggtagtttcttttgctgtgcagaaggtctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagagtcaatcctaagacaaaagaacaaagctggaggcatcacgctacctgacttcaaactatactacaaggctacagtacccaaaacagcatggtactggtaccaaaacagagatatagatcaatggaaccaaacagagccctcagaaataacgccgcatatctacaactatctgatctttgacaaacctgagaaaaacaagcaatggggaaaggattccctatttaaccatgccaaattgtaaagaccattgatgctaagtagaaactgcatcaactaacgagcaaaataaccagctaacatcaaaatgacaggatcaaattcacacataacaatattaaccttaaatgcaaatgggctaaatgctctaattaaaatacacacactggcaaattggataaacagtcaagacctatcagtgtgctgtattcaggaaacccatctcacctatagagacacacataggctcaaaataaagggatggaggaagatctaccaagcaaatgaaaaacgaaaaatggcagggttgcaatcttagtctctgataaaacagactttaaaccaacaaagatcaaaagagacaaaaaaggccgttacgtaatggtaaagggatcaattcgacaacaagagcgaactatcctaaatatatatgcgcccaatacaggagcacccagattcataaagcaaatccttagagacctgcaaagagacttagactcccacacaataataatgggaggctttaacaccccactgtcaacattagacagatcaacgaaacagaaagttaacagggatatccaggaattgaattcagctctgcaccaaggagacctaatagaaatctacagaactctccactccaaatcaacagaatatatattcttttcagcaccacagcacacctattccaaaattgaccacagagttggaagtaaagcactcctcagcaaatgtaaaataatagaaattataacaaactgtctgtcagaccacagtgcagtcaaactagaactcaggattaagaaactcactcaaaactgctcaactacatggaaactgaacaaacaacctgctcctgaatgactactgggtacataatgaaatgaaggcagaaataaagatgttctttgaaaccaacgagaacaaagacacaacataccagaatatctgggacacatttaaaacatgtgtgtagagggaaatttatagcactaaaggcccacaagacaaagtaggaaagatctaaaattgacaccctaatatcacaattaaaagaactagagaagcaagagcaaacacattcaaaagctagcagaaggcaagaaataactaagatcagagcagaactgaaggaaatagagacacaaaaaacccttcaaaaaatcggtgaatccaggagctggttttttcaagagatcaacaaaataaatagaccgctagcaagactaataaagaagaaaagtgagaagaatcaaatagatgcaataaaaaatgataaaggggatatcaccaccgatcccacagaaatacaaactaccatcagagaattctataaacacctctacgcaaataaattagaaaatctagaagaaatggataaattcctcgacacatacaccctcccaagactaaaccaggaagaagttgaatctctgaatagaccaataacaggctctgaaattgaggcaataattaagagcttaccaacaaaaaaaagtcccagaccagacggtttcacagccgaattctaccagaggtacaaggaggagctggtactattccttctgaaactattccaatcaatagaaaaagagggaatcctccccaactcgttttatgaggccagcatcatcctgataccaaagccgggcagagacataaccaaaaaagagaattttagacccatatccctgatgaaaatcaatgcaaaaatcctcaataaaatactggcaaaccaaatccagcagcacaacaaaaagcttatctaccatgatcaagtgggcttcatccctgggatgcaagactggttcaacatatgaaaatcagtaaatgtaatccagcatataaacagaaccaaagacaaaaaccacgtgattatctcaatagatgcagaaaaggcctttgataaaattcaacagcccttcatgctaaaaactctcaataaattaggtattgatgggacgtatctcaaaataataagagctatttatgacaaaaccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcagttaggaaaagaggaagtcaaattgtccctgtttgcagacgacatgattgtatatctagaaaaccccatcatctgagcccaaaatctctttaagctgataagcaacttcagcaaagtctcaggatacaaaatcaatgtacaaaaatcacaagcattcttatataccaataacagacaaacagagagccaaatcatgagtgaactcccattcacaattgcttcaaaaagaataaaatacctaggaatccaacttacaagggatgtgaaggacctcttcaaggagaactacaaaccactgctcaactaaataaaagaggacacaatcaaatggaggaacattccatgctcataaacaggaagaatcaatatggtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaagccaaaagaacaaggctggaggcatcatgctacttgacttcaaactatactacaaagctacagtaaccaaaacagcatggtactggtaccaaaacagcatggtactggtaccaaaacagagatatagaccaatggaacagaacagagccctcagagataatacctcacatctacaactatctgatctttgacaaacctgacaaaaacaagcaatggggaaaggattccctatttaacaaatagtgctgggaaaactggctagccatatgtagaaagctgaaattggatcccttccttacaccttatacaaaaatcaattcaagatggattaaagacttaaacgttagacctaaaaccataaaaaccctagaagaaaacctaggcaataccattcaggacataggcacatgccaggacttcatgtctaaaacaccaaaagcaatagcagcaaaagccaaaattgataaatgagatataattaaactaaagagcttctgcacagcaaaagaaactaccatcagagtgaacaggctacctaaagaatgggagaaaatttttgcaatctactcatctggcaaatggctaatatccagaatctacaatgaactcaaacaaatttacaagaaaaaacaaacaaccccatcaacaagtggacgaaggatatgaacagacacttctcaaaagaagacatttatgcagccaaaagacacatgaaaaaatgctcatcatcactggccatcagaaaaatgcaaatcaagagtatgtctttcttattaaatgctatgtataaaatgttactaaaataactagtgggataaacataatgattgtctccttatcatatagatattcttataccagcagtacttcgataataaaggatacagagcatttagattgggatgtgtatgtgtgtgtgtgtctgtgtgtgtgttgtactttgtgttctgatatatagagaaatgcaaaattgtctcaattaactaattaaaaattaaaagcaatatagtcagtttcttccaaaatgtcttcaaagatataatattggaaaattcattctaaattttcaaaattgaaaaaaaaaatgtgtgcagtcctttccataatgagtttcttttctgaggtccatatggttggtcttttgcttctattttatggtttcaaaatttaatcacacattgactcgctggaaacacacaagtgattatcttggaaatgagaccgaatatatttggttttgtttttgaaacaagaagctgactctcggtaatctccactgctgttatttaggctgggcatgggcatctgcggtgtgttgggcactcaatcattttcaattaaatgttccaatgtcttgtgaaagtcccataagagcttgcagaatcacgattatagatccatagaggaaatgtactttttgaacatttccaggtaagcagttttcttgcaacaaaaagccaattattttgagggattatgtaaatattcactggaaaaccctaaaccaaacatgtctcaatacattgaagacaccattttggaatggtactgtcatatacgtttagtagatttttcagacatgcactcttttgcttatagatttaaaatttgtatttttaaaaatacattaatttttgagattacatttaagcattttactctttaaagtttggaaacattgcatatgtgtttatatagcaaattcaacaacatagtaattgtagaaagtttgcagaaaaatgaataatcactcaacattttaaaaattgaaatactatgattatttatgtatttttaaaagttagtctattgctctaaggctattcaataagatttgcacttttttttgcatttttttcgtaacatgtatcataaatttggaactaatatccctctagtagtcaccagtacaacttactgataaatggattattgtccacctattataccagctgttaaatatcttgactatcatttctgcataaatatacaaaggaaataaaatgtgaaaaatagatttaattcagaatcactttagagatgtgctattattttaattaataatgaaacttgaaaaattcttattccttagccacttactcaaaaaaatacatcctaaaagaaattttcttgcattacacatcttttttacacatgattttacaatatgtttgtaacctcaatccaggtatacaaaactcaaacgtatagaagcttctaaatttcaaagctaaataaaataataaaataaaataaaataaaataaacagcaaacaatgccagtgtttaaaagtatagaaaatatgaacatttacgaaaacctccaatgtgaataggcagactttctcagtgattgaggagggctctaaagcccaagtcttgcaaatccagagtaccacaagtgcttcaaggaaaagagaaaggaaagtaaaagataagactttataaagacggataatagagcagcacctatgataacgtggggccaggagatgtcatggaaatgtgaggcatggtggacttaagcaccaccactcaaaattgcaagaatgaagatagtgatgcaaccatgcagaaacaacattgaaaatataacagcaatgaagctcagggacaagaaaactcctaggatacagcactctcactgtgagtcactagtgcagtgtttttcaaattgcaaattgtggcttattaatgagttacaaaatcaatttatatgacttttttttaaaaagaaaataatagaaaaggaaaatgtagaaaagaagaaagagtaaagaaaatgtcacagaatataagagaaagcaagctattatttcttgtatatatgtgtttacatagtatgtatgcttgtcaaatatattttttattgtatgtcacaccttaaagggtttgaaaattgttacaataagcatatcagctatgagaaagctgggtattgcagaaatttaggggaaaaaatatgttaagtcttagttcctgtgaaacaacactatataaaaatgtgtgttcaaactaaagatatcttagctctagaaaacaaggttgtcaccaaaactcctctgtttaataacagagaagtttgatcctttgagaatgattacatctaaatgatttaaaaaataccttcaaaactttcagttttaagtttcaattatcttcaagctttacttattcagagcatttaatttttcagctatcagataaatgctatggactttactattattttctgaagatcactggttttaatattagaaatgaaacaaatcatgaagcagaagcagtagtataatgataacacagtgtttaatatcaatactagatcttataaggttaatgagcactattttatattaaaggaagtaatgggttgtaaaattactcttgtataaaaaataggacctcatcattccaaagtgtccttgaattgaatggtttataggcttctgattgattaggatgcttatagaaacattttatatagtgtcacattgttcttatgatgtacgcaggttgataaaatggaagattctgagaaatgcacactcataattttttcattatgaaaacacgaaaatattgcaaagagttctaaaataaaattttaatagtcaataattttcaaataagttgaaaacttttctgaagaatggttattgttaaatatattataaagattttatgcttaatgtacatatacacagtagatgagagaatgaatgcttactcaagatattttgatcttttaactgggaattaatattctgtgtttaccaaagaaaagaaatttaagtatagattaggcatgggtaattgttttgcttcagcagaaagtccttaagagattagcttaggcatttgtcacaatcttcaatatttttctttcaatgcaaaaatctgtaactccttcatgatcatagcaatcttatcttttctaaggataatcttttatttgttgtgccataaattggctggaattatacagtttctagtgcaatgtgactgctttgttttttgaaactgttaaaataatcatcaatgaacactaccttatcagtaaaaagtagttcaggatttaataggcactctaaaaatgccattattttcaagtcttctaaagagcacttacctctttcttgcataggttatttcctgtttcaaccacaagcttctaagcttggaggcaagaagtgccttaaaaaatcagaatcaagtagcacatgctgatattaatcagaatagaagtccattttttatttgctatcaaagtttaaaatctactggtgaaattaatatgcatgttattttcccctgtaaagctaaccgataatgtaatgagactcctcctacttgacactatactaatgtcataattgattttaaaaacttgtataagtagataaacttagaatcagcgtttcaatttacagtttaagggagtaagtaggcttgagttttccacttcaaacttcatttattactgcatgaaaatgtctttgaccctgtcagacagaagtactgatagtgatgtttgagtagaaacttttgttgttgagactggcaacaggagtctttgggattctgaaactataaatagaagaaaaaaagtctattgcttttgataaaatcaattgtgcagatatgggcaatgccatctcaatactgagcaaactctaactcatgataattgtgaggatggaataagaaactgaagaacatatccagaaatatttaaaacaaaagagtagaggccaatgagaagaaaagctaaggaaccaccttgttctttctcacacacaaatgcacaaagacacattaaattaatcaatacaagtaactgcaataggtgaaaaaacacagtgggaaatctataatttaaaagataagttgtttaagagtttacttcatctgggtaatttattcaatcctctccttccattttctctgtacatttatgcttctgtttcagtaccaagtatctgaaatgttaaaacacaaatccaatttaacaaatgagggtactaactatattaagatgcaaagtttttcaaacatgtctattttcaatattatgttaaacagctctgggacggagaaatgtgtatgtctaatcacacattcttaatgacattaatgataatacattgtgcatatttcaacagattggaaaacaacaacaaaaaacctccaagatacagtaatgaaatttactttggctttaaaattgcctttgtccttgctcttcatgtgcacacttgcatgatgacttcaaggacagtatttagtaaaacaaacatcatttaccttctcctttttctttagcttgctttgatgttgtgctaaaggcacagagaagatggaaaagttgggttcattagagctgggaattaactagataataatggatggagaaagggaaaaaacaaaacaaaacaaatctgattgactggatcctaagactggctaaggagggaagtgaacgggagagggccattaaagaataaaggaaaatagtgggcccctcagttaagactggaggttttgatgatatataagaaagtagcgaactgaacaaatagaagtttgtaattagaaaaaaaaatgagacttttatggaagtaacaatgatgacaatgtgaagtgtgtcatcatggcggaggtggagctaacaaaataattattggacaggagaaaatcagagaactgagaagtcaaggtattagtgggattataaagacaaacattcaggacaataaattttgaaataatttttttcttgctccaatgacactattctcttgattttttttcttagaattcttagactgtattgccttttcttattttctaagtgagtgtattctaagatgttcaatgatgtgctcttttgttttctttctttagcttggaaacatggttggcacctgtctctgtaaaaattccagttctgccctcttccctgatttctaattatttatttaattaattgctggatcaagatgtatttcttggttttcttgtaacacttgaattcagcatgttcaaaatggaaatcatcagtttttccctctcggctttatttcaatctcttttctcttttgtttaattgctttgttggttagtctttaaattgttgtttttctttttggcactacagttgcacctgttgtacagactagaggctgtaaagagagtttcttttatctcttccttaacaccatacactgcctagcttcagaaaagttgtatttactttttcagggctcttttattgtttattatgtgctttcctttattatttctctcccttatgtaggaacttgttatctgtcttaagaactgtatatatggcctctttattggattttccccagatgtttcacattaattttcttaaaggaaactgatcaggaatactcacttctcaaaaatcaaaataagataatttcatttttaaagaaagtctagattcttcagctggcactccaggctggctgtttcttactttattttttttttcttactttaaatgtacagatgtttcccccacacctgtaccccaaacttttcaatttctttgcttttgttcatgttgctcctgtttatgaccaaaactttccttcccacatttcattctctcttctatattggtgtaatcatcagttttctggtgttaaactaaaataatactttttcatgttctgcttttcgtcctatagactttctcttggactaagctacttataagcatacttgttcttgattcttcatacacaacttatagtttgccttttgcttttattactcccaactcaattatcatattaagtgcttttaaccttatcttttcttaatttgtaattttttgccaatagcaattttacttggtaaccctattctcacttctttcctgacattcccaatatttaaattaatcttttcaacattatggcctcttgagggcaagcattctacccagggcttagactcctattgagttggtgtattctatttctacttgtcaaaattctgctataattaaacaccgtaatcaagagttttatttttcataaagcctattagaatgtccctaatataggtgatgaatctttctgatgtttcataactcatttatgccacttactgtatgctaccaaatattatggttgatgacatatatcttatagaaactacttgaatataataccacagagcagatatttattttagttttttatacacctcacaatccctggttcaaaaacttgcacagatgtttttatagataattatttgataatttcatgcatttatcaagtacctattaaagaatatacagccatttttaactaacaaaaaagaaaattcattgatctcttatctgtcttaagatataagtgtagaataggacattttctgttaattaaacctgtggaaatacattgaagactactctacaataaatagttctgaagttttgtttttttctcatgcatacatgtataaagactatcagacacatagatgtttcatttattatattttaaaatgagcctaaattttaataagtaaaacactcaaatttaagcttgcttattctacaatttatttgatatttaaagaattgctgccataaaagtatgaaatcaataccaagaataaaagaaaatctaatttcattacaactaaattgcacaaaaatgaaatctgaggagaaaacacgggttgaggtacactgcaatgacctaaagcaataatttttcaataattaatatgactttacatatatgtggaatgctatttataaattatgtttagaaatatttacttgatcttcaataacaaaaaacccttagtgtagttttaaaatttgtaatgatcactgcaataaatagacccacaagtagtccttttgtatttcttgctgtttttcaactacatccttaacttctgacaggaagttattaaaaagtacatttttaatcagcttcacagttttcagaatactgctcttttagattgctttgtatttacattttaattttttaaaaaagctaccaagcaaccccagcttctaatatttctcctcttctccttttttcttcctcctcaattatttagcagtgtttgggcttcgtttagagatgtaatctcagtctacccaaaggggaaatgcctaagctaaagtttgttcaggattcttttttcctgaactcaataaactttaaatcttttacttgaacaattttcaaatccatttgtcaattaatttacatttacttatcccttcctttctctaaaaatatgataacataaatattgggtgtattatgcatagactcttactataatttcttaatcaaaaagtctttgcttaaagcagaaaaaggatcaagatgtttttgtaactcctatcaccttatttcactttccagtgaaaatatcacaggaaatagagagggattaagtttttaaaaaactccctggttttaaaactttaataatatttactgcccatctgtggaatttctaaactgaaataaagccagtagacatcttcctatggtgacatggtgcataaggcataaagttactgactatatgattctgctttgtcttaaaggaagtataagatataaatatttgaaatttttgttcatttttcttaagatagaacaagatgttgtcttgaatgtgacatttttttcaaataggaaaggtgacttttttttcatctaggaaaagtaagtttaattttcataggattaattttagtgctagaccccaacatatcctatctttatgaaaaaaaggcagcacgaatcccaagggggatatcactgtttggaaaaaggagagactggagaatttcaaattttgcatagtgtttaactctgtccctttccacaccaggaagattcttttcctaggagacctacatgatgggactcacttctccattactgaacttcttgttttttattcctgttaggaagcaagaacctaaaagaggggatgtgaacgattaaggcaaagaaagtttccattctcagtacctagggagtgaataatcccatagtttctaagcacagaaaagattagaagtactgtcgctatggtataactgcacagaataaatgccccaaatacaaattaaagaatttcactgaaaattagtaatcaggtttgtatctggttcaaaatattaaataaaaatcaacatctgagagacttgtggcaatacctttcaacagtaatttataaattaggaattgtgcaacatacaggtaatctcttattagatatgtagaaaacaaaacaccgagttaataggttttctaaaaaaaatctgttcagattgaaaacaacttcatcaatgaacgcctcaggatatttgagaataaatgtataaacatattttgtctctctttttacttttaacttttctgttgttctaggaagaaacttctgaaaaaatatctttagatataaggaaaaataaacatctttatagttttatagaattgatagaaacaaaatcaaaatgttatctcaaacataagttttccaactttttaattatttgggctggttaaagagaaacgttctggatggactaagtgttctcatgtaaagtggcgtaacgttatcgtctcacatctgatgctattttcactgtcctgttactcctggtgtctagctcctactcttttttcagccttatcatatagaaactgtagactggaaccacttttaaatgatctctttggatgcctgaacagcagggaagattgttcttcatttgtaacaagaaactcaatcatttctgggttccaattagagaaagcctagggggccctctttattaagatgaaacacaaattgtatcaagacttgctaaaccacttaatatttttatggtgatattaagaagcttgaacattttaaatactaattgggaatatgtgtaggctatttttaatctatgcataaactctaacctctatttcattaaatttgcatcttatgatgctattttgccaccttgaagatttatcacagagactaggatcaagaattcttgaaggatttagatcagtgtcagcaaagacttacacaactatatcctcctgttaaccaattttgtagatgctgttgttatttcctttgaggaagtttttttttttttttgaaaaattttgttttaaaatacagattggcaacttgaatactttatctagatctttacatttctatgtaaacaatttaaaaagacatatctgaatttaactacatatttacagagccatttgctttaagatgagacaaaaaagcttataaacagaactaggaaaaaatcatgacagtttagattttggggggtaattttgagtatacggaagtgtataaatacatgcatacaattttctctgtatgtttaaaagttcaaacatcaagaaaaggttgcctcctaagatactaaattacttcctttgagtagtattataaagatgaattctctaaaccccaaagtatcaccagtataacttctattttaatatgggtcttatgtgactttgtggaaagggcaagatttctacattgctacaaatcatagttttattttatcattttttgctgcttcaagagatgttaacgatgtacatagcacaagacaatctagcctgttataaaataagaattggtaaattcaaatagcagttaaaagatttaggataaatgaagcatgttgagaactattaataatttggcttttattaaggatactaggggagtgatttgtctatctaattgaacgatacatattattatatttttccaatatattatatttttccaatattttatatacctagtttcttcacttgttatcatataatgctctttcagaattttcatagatatagatctgataaaattatcctccctttttgttttttatcttcctgaagacagaaaaaaacaaactgtttactactttctacttacacatttactacaacacttcatctctgaccaccaaaatgtgtgttaccaacaatcagtttcccccaccaacaatcagtttttcatgagacaccaactgggtgtcatgtaattcaattcatgtatacgtcagactgcagattgaggtctcagtcccacaagattgcctcccatttcagatgccactcacatgcactaggctgttacctgtacttctgaccaactgcctacaaaccatgatttccgtgacttccttcttgggtgttgttaatttggtgggatagctcacagaactcagggaaacactttgcttattttcactcattaattataaagaatatgacacaaaactatcaaaaccctaggagaaaacctaggcaataacataggcatggtcaaagagttcatgatgaaaacgccaaaagcgattgcaacaaaagccaaaattgacaaatgggatctaattaaagtaaagagcttctttctgcacagcaaaaaatactatcatcagagtgaacaggaaacctacagaatgggagaaaatttttgcaatctacccatctgacaaaggtctaatatttagaatctacaaggagcttaaaccaatttacaagataaaaaacaacaaccccatctgaaagtgggcaaaggatatgaacaggcacttctcaaaaggagacatttatgcagccaacaaacatacaaaaaaaagttcaacatcactgatcattagagaaatgaaaatcaaaaccacaatgaggtaccatctcacaccagtcagaatggcgattattaaaaagtcaagaagcaatagatgctggcaaggctgtggagaaataggaacgcttttatactgttggtgggaatgtaaattagttcaaccattgtggcaggcactgtggtgatttctcaaggatctagaaccagaaacaccatttaacccagcaatcccattactggatatatacataaaggaatataaatcgttctaatataaagacacaaattcctcaaggatctataaccagaaataccattcgacccagcaatcccattattgggtatatacccaaaggaatataaatcattctaatgtaaagacacatgcacacatacgtttattgcagcactgtttacaatagcaaagacttggaaccagcacaaatgcccatcaatgatagactggatgaggaaaatgtggcatatatacaccatggaatactatgcagccataaaaaggagtgagatcatgtcctttgcagggatatgaataaagctggaagccatcatcctcagcaaactaatacaagaacagaaaaccaaacacttcatgttctcactcataagtgggagttgaacaatgagaacacatggacacaggaaggggaacaacacaaactggagcctgttgcagggttgggggtgaggggagggaacctagatgatgggttgatggatgcaggaaaacaccatggtacaagtatacctacgtaacaagcctgcatgttctacacatgtttcgtggaacttaaattaaaaaaatctatatctatatctatatatctatatatctatatctatatatctatatagctatatctatatctttatatctgtatatctatatctatatagctatatagctgtatatctttatctatctatctctctctctctctctctctctgtctcacaaaggcaactgatgaacagcgagatgaggagatggatagggcaaggtatgcaggaagaggagaggagcttccatggcctctcctggcatgcttccatcttggaccttctgcatgctctgcaatacagaagctctccaaaccctgcccttttaggttttatgggggcttcattaggtaggcataattggttatatcagtgaccattgatgatcatctaaccttcagtcacctcagctccctggaggttgaaaggaaagtgggactgaaagttccaacctgtatttacccagtaagctgcccaggagcccaccagaaacttctgattagaacatctcataggagcatctcagagcaaaagattctcctatcatgcccaagggacttagaagctctgtgtcagagtctactatcactcaggaaattacagtcatgcaccatataacaacactttgatcaatgatgcaccatatataggatagtggtctcaaactattataatactgtatttttactatacattttccatgtctatacactcaaatacttaccattgtgttacaatttgttccagtattcagagcagtaacatgatgtacaagtttatagcataatcaataggctatagcatattacctaggtgtgtagtaggctgtgccatctaggtttgtgtaaatgtagtctatggtgtttgtataatgacaaaatcacttaataacacatttctcaggctatatcctcatagttaagtagcatatgactgtataaacgtcttaggagtttcttgccaggaaactcttgcaagggtaagaagctaagtagaacaaaaatttctgctatcaccactatctattggggcttcaggagcactatgttaggagctgggggagaagacaaaatacatatttcttatattacaagatcacactctccaagtgttgtcagtacttaaacacttgatcagttccattaacactgccaatcttcttgttttgatattgtttacaatatttgttattatttttcacaacttttatcccttctacaaaattttgttagaatggtatatatccttcctcttagaaaggatgccatacccatagacatcacttactcagtgcctctgttctaattgtgttcacaataacataaaataaattcaatatttctatcaaatttaacaaagcttttgagaaaatgattccatgtgataaaattatgctgaaattagaaaactttccatactaagcctagaaaaatattcatcatgttagaaagcaggaggtactagatgaagcatcaactatagaggaagaccagggtttgaatacttctctcatctatattcttatatgcagcacattttaaaaagtgatattcatcaaagtgttcttttgagaattacagaaaataaatgtaaattacctaggataacaactagcagatggtaatagatattattaacaactatttctatcattaattattacagaagactgaaatttttgaagaggggaatctatggttcatttatccttcttttctaaaagcatattttgagatagggctcctttgcaggaattttgttaaaagaaaactcacagtaaaaacctctaaaagaatgagaaaagcagcagaggtgaaatggaaaagattcaggtggtttcaagcaaagctgtgccacaagggtggctctaagtgcaaagatttttatcttttttatatttattttatgttttatattcttattttatatgtatttgtatgtatgaatatgaatacttatatatttaatattatttattataataagtattatttagtattcattattattatatatatttatactcatattttatatacatatttataaaaattatatatttatatataaatataaatatttatatttacttatatccaaatacatctgaggaagatttgccccaatagcctaagggtagtcttccaatgtggggtgtgagccattagcagcagaatctgggccacacgacttgagcaggggaccagaaatgactgctactgggactcaacaaattagtctctgaatacatatctgcttagttaaatagaatagaagcagattatatttgctatacctccgactcttttgagtgagtgtgtgatggtccttttggtatcttatagaagttagcatatggttgtgtacaaaatacatgttaaatattaaaaaattgatttactaaatttacacatatttaacatttcttatttttgctatctacatgcatgtttcaatccaataggccagaacctgttttgtggacaaaggatggcggagaattaccagatcctgaccgaatggttgtgagtggtagggagctaaacattcttttcctgaacaaaacggataatggtacatatcgatgtgaagccacaaacaccattggccaaagcagtgcggaatatgttctcattgtgcatggtgagtaaattttggaaaacattatatgtgaaaggatgcataacttgaaaaactatttaaatatatcagaattttaagtgcagtgaacaaaattatatggtttctttttacttcaggacatcttatgagatatttaattatgagatattatatttaatattaatatattcccagtcagactgataaaattgtaacatacataaaatttttttttgtaaaaagctttctcaattataaatatacttcttacatgttggctcgtaaactatattaatgattgtctttattttattttttattttttttggagacagagtcttgctctgttgcccaggctggagtgcagtggcatgatctcagctcattgcagtctccacctcccgggttcaagcaattctcgtgcttcacctcctgagtagctgggattacaggcatgcaccactatatttttagtagagatgggctttcgccatgttcaccaggcttacctcgaactcctggcttcaagttatcagcctgcctcggcttcccaaaatgctggaattacaggtgtgagccatcacacccggctgattgtctttaaattctataaataaatgtgttcacttataatccagaatcatgaaaattacatttcctttaagctaatttttattgtattatcataaacatatactttataacttctgtaatttggtttcacaaagaatgacagtgtcattgaaatgcagcaaaaatgggagtgtacaatattagcaataactgcatcaatttcactgaacaataatttaaagttcctacagactttttcttgactctatttacctcacaatttgagtaaatataacaaaatcacagaaagaaataccagtcgccatgagtgaataaaatttctgttttttccaactttcaaatgccacaatgggtttttcataaggtagcttcttttagatattgttagatggagatgaatttttacgagattgatgaatattgcaataaacaaaattagtcaggtttctttactacagtacttcccagactttattgtatatgtcagggtgcattgcgaatctccactaggaagagccattagccaatgtaagattttcatcatatttcaccaagaaaacttttctgggactagtattatattcaacataatattacagtatactaaatgagtgttatacataacacagtgctgtcataaatcgtggatcttagaaactatggacaaaatatgtttatttgatatctttcccttgaatgcatttatggaatactaaaagacatatgtgtttgttccatacctttccaaaaagaaatttgggggtctagtatatttctttgtaaagagattaattttagagagaaattaatctaacaagtgttatttttcccaggtattcattttgttcattttgccaaagttggaaaaaattaatatgttcagtcaatatacagttttcctattttcaagttgcattattgtataaaatctctcagtacttaatactgctttgctatggtaagcaacgaaaggctcacaatgaataggctattcatgtaaaacatctagaaaatagtagaactaacagttgaatttctagcacttcatgaattgtacaaaattcaactttggaaaaattagcctaatccaattagactgataaattgtatttaaatgtggtaatccctgtagacagaccctgctggcctttctgccagagagaatgttacaaccactgggtgtgtcaggaaggtaagtgagatccttagagcaggatccaagagtagatttcagttgatgctccctggatgtttagatcatgcagtcatgtaaggaaagtgtagtctatctgattcaccttaattttccaagtgcttctctcacctaacagtttctgagcacctggggatatgttgtatagcatgtcacattgtgtcaaaagcaatatgacataaaatattgagaattagaagagaagtgacagaaaaaataatatacctaaatgaaaagtatatcatttttttaaagtagctcatcaggaaaattcgtatattttttcagtgcttgcaagctagccaacagcatgatttcctaaatagccaagctacctttaggtagttggcagttgatgtatttctaataaatacttccctaagcactttgtgagaagtcatttttggctttgctttttgaactacaattcatcaaaagcatcccatagattaatgctattcatgctgctagataaatgctgtgaagttcaacagtggtttacctaggattattgacacaagtaatgagaggctcgatgaaacagtgaaaccatattatgctgtgtttaaaaggggcgccaattgggttcatggcaaaataaaggttttttcccctttgcacgctgggtataatgtttcattagtcactagttgtataaatataaaaagctactctcttcttttaatggtttggctgtttcaaaaccttactaaatgatgaaatttgagtggcatttcgatctataatgaatgctgtatgcatttttggaatggagtgataagtgatcatttgtgagaactttacccttttatcttttacaccaaggttgattttacgttagtggtgataatttaatatagctctagtacagaggatttttcacgagctgagacccgtgtctttgactctaccacaattgcttagattctattgattcttaacttgatggagttctgagcactttcctgtgaaatcatctactatctggatgccgtcataatagttagattttattgtttgggtgtcagtgcattatttaagtgcactattaagcattattaagcattatttaaatgctaccacatttaattgttaaaaccactgacattttgtgttagaaacactggtgattcccccactccctcctaattacacctttaaaattttcagcattaggatcacatgtagtaatttaactgccagtctaaaatttatcctcaatgaaaggcctacccagagtcaccatactaatacctgtaagattaaacatcttgcttaagaaacatttgcactgtgaaggttccattaagaaagaaagtagcacattttatgaacaagcttggcaatggaaaaatttatctgttaaattggtagccataattatactaattaattcctctgagcacagtagtttctattttcttctttataaaaatgttgaagtatatctcttgtgattattgtggtcatactatttatttatttacaatggatgattatatccatagttttaatggctttgaatatcttgacccattgctattcttaacatgtgaagaactaggatcaagataaaaactaattcactcacccaatagatatatagtacttatctaccaggtacaaaggagcaaagataaataacaaacaagaagattatagtttaatgtggaatataagctaagcatttagataattgtgacacaaaatagaagagttatagggagctatagtaagatggtcatacaatgtggcagatgttcacactttgtgtagttccaactgtatggaatgtttaaaaatactaacatataactattatttataaatattataaatataaataatcataataaatatttaaatataaatattatgataaatattattacaaattaataaattcatttataatatgacatactttgtaaatggaattactcagcaaagtgccagttatacagatatataataaattagactattcttactcttatatttctagtagtcttattataccaaggacaatcaaactccaagggtctggtaagaaacttgcccatgagttgcatacagttattgctcataatcttccctgaaagctaccggaacataaattaggttaacgctattgaaaaatgagaaaactctaatttttttctatgagatagaaaatgtcttaaaatctcaacaatgttaacacattgaccatgtacaaagcaagacataagttatagtcacccttgttctctaatgcaacattaagttcagaaaatataggttgaatatcttgtcttcaagcagaaactacccgaatgtgcatccattcactatagagaacataacagatgataccattttatcatgcaaggtatggatctagggaatgaccaatggtattatgctaattctgttttgtgattggaagcaatgcatactcttctatttatcatcaattgattaaaaatacactcataaaagtgacagaaatgtacaggacctggaaagctttgagaaagaacatctacggaaagtgagaaacgcaaattaccacattccccaaaccctaaacttcttccctcttaaccttcccagtgtctcttttacctccctttaaactcattagagaaattaataaccactgctcaaaatacaaatgggaaatggacagatatgctgcaactctttaatatcacctccattctcaaagcctccctcaggatctgggaagaaatacagtaataccagcagaaaaaatagtaactaatttctccttctgccaatagctatactatcaatggcaggtccagattgtagacaagggtagcaaggataatgtttagagctttggaggggaacccatgttgtctcacagttatagcagagttgagatgcactattccataaagtttttttgtaatattcccctttccttttcaaatttattttttcttttaccgtagtaaccctatgtgagtgttaaaattattttaccactgtgctaacttattcccttacttcattattttctccttgtatgaataagttttataacaattcatcactcctttattatcttaactcttgctatcatttagaatgaaattgcccactatgcacctttccacagatttcgttttctttacatgtatgtattttgcttttctagcaaatttgacctttacaaccatgtaagataagtaaaatctctataattagtattatgatactatatagtaagttagaatcaagatttgcttatatttctgtcctgctaataagcttatcacgatttctgataatcttagtctctctaaagtatcacttgactgttacggtttgttttatttgttcatgtgtctattaaacagtgatggaaatatgatactgctttttatgtttccaggataatttacttcagaagtaacatatatagagaataggatacgtcatattttattgttagttggtaggatacattattttaaaaagagtgttctggagttttagaattttaatagagaatattactgctagagatctctatgtgctttgatctactaaaaggtattaagctattaaatgtgcctttctagctcctaagaatcaataagattgctactttcatttcactcagcttttattgttaataataaatgtcaaaaaacactcaaagacagaaaatcgtacacatagatattatagactgctggatcaagccaaacttccaagctttgttgctcatgtagacacatatcgttttcagagactgtaggtaaacacaggttccctcttccatcctgggtagtgattctccatttcagttaacttgcttactatgggagaggaaaaattgagtcatggatggtatcttttctttcactttaacagacatttccaatccatctatcatatttttcaaatatgtaacagatgtgcaaaatataaattcatttcctttagagttgtcagtacttgaccctaaatttagcaaaataatatatatgtcagtgaatgcagcaatcattaagcaacagattaggaacatcatagagtaataccttaaatttgcttttaaaattttcttgccatagaactaagcaaatattatataataatacatccctaatcttagagagatatatctctcatgtattcatgtcatgattatcaatgatctgagaacttcatcacaatacaatgaaaaatgtccttttgtgcttcatagtaaatgtgtagctaggccggaagattgccagcccctgcaacgtgcatttactattaaattatccagcaacgaaacatctagcagtattgagaggctacatgatttttttaggcaaggtgatctttacaggtcacactgagaactaggagagtacatcttctagctcgtatgggtggctggggaaggaaaaaaagaagcctggattatggacagatgtaaagcctagcaaacattaaaaagggattcaactaaaatctgttctttcacatggaaacagacctaccagttggtaagttaattctgtgtactcgtaatgagcatttttcctttggagcatttttcttagaagcatagatggaaaatatacagtggagggaaaaaaggatggaaaaggcatccatactgagcaacaaacagtgtgctaatggaagagccctatggttgctgctctcatctctggttgagagtttccaggcagtaactagttggatgattcttaaaacagtatcttctttaatcgctgagataaaacgctatcatttctggacatgaataagcagggagagctctgatgcctgtaggaaaggtgtacctctgactggatgaatatgctgttgaactctgcagagagaaatggaatggcataaaatagtagagacaggagcactattttcattacaaaacattttaaaaggtgtatgtgtgtgggcacactcaacacagagttaaggcttaattatatgtctctgttttaagatgagcataaagtaggtacactaaggtttctgcttttagagtaaaaattctgttgagagatgccattctgaaataaatatttctatgtgctagatgaatcacagaatgaaatgtacataggaaaaaaccgtcattcctgccttctatcactaaacaatttcatcattaaaaaaatattttctcaacttatttacatataatattttctctcagttgcagtataaaataaggtaaagagaaggatagaatctgtggcactcggtccttctatatttgtttatgtggaaataaggccaggctgtagctttaccaaaatgtacagagctcttctacccaagtatatgtgtgttaattggctcatttgttacagatttcaagcaatatgcaatggcccatgggaggaaatgttggcattagttttcagaaacaatggcattcctaaatagaagacatagatttttacataaaacctgctttgtagctttttacagtatagttttcacacatattgttacaacatatatacttgtttcggattctaaaatttttccttgattctattctacccttctctccaattcatcacgaagttccatcaacgttgcttccaaatcacattcccaaagtgggcacttctctccatcatcctctctggcttagactagggtcccttgttccacactcccacaccttcaatctctttctcacatagcttcaatatataaacgttttaaatgcatatctcttcatgtcgtttccccatttaaacttatacaaaggcatttcatcatccttagtataaaagccaaaccctcattgtcctacttttccaagtcctgcattttatggctgctgcctacatcggtggcatctctcatcactcttcacacacccacttctgtctctctggtcctctttcaactcctctaagttatcaaggtcattttctttatagaaattttgcctctgcttggaatgcttgtccaagatgcacaagaaatgctgccagaaatgctgatctttgcaagattgatttcttattcagatctcagattaaaagggatttctcagtgaggccttttttttccattaccatctaaattgtcccccagtcacatatcacttcaattaaatactctacaagacatatatcattatgtgatagtttagctatttgtgtgtatgtacatgtttgtgtgtctatatatacatatgtatatatatgtacacatatatgtatgcatctgtatatgtgaatatattatatgccctcacactagactatgacctcctaggaaacagatattttatgcatcttatttatttctataccgctagctcttagaacagggtcttctaaatagtaggtgctcaataaatatttatttaatatttaaatctgtttctgtctgtctctcccgctgttttcaagagaagaaactttagtgaagcaatacatacacatatacacatatatacacatacatacccatatctacatatatacacacatatacgaatatacaggggtgtgtttgtgtgtgtgtgtgtgagtgtatatatatatatacactcatacactcacacacacacacaaacagccttgacttctggataaaatcagggaaataattgatattccttggtcaccaaaataataacctttagtttttatcccatattgaaaaaaaaaaagacgtgtttacttagcaacccaggtgaaatgtgccttacttatagaattaagtgattcaaaacataaataactgtgcatagattaatttttctaataaaaatttttgcaattaaagagttatgcaattgattccaagtatgtgttttcatctttttgcaaagttaaatgactttgctaactgaaattcaaccttttataagagagacctggctgctcgtgagagctctgaccattagaaatacaggtgataggagtggatattaaaagtgaagctcaatagatgcttattcacaattattcttaacattatttagttttattcagggattgtgttctaaggatatgtcaaagtggacctattcattaatatgcatgtgcaaaaattacctgtaaatagacattcatagttttcttaaattataggttagcaaggttataataacaatctttgaaacattattaccttatcatttaatttttatttaactaaacttttgtatttcaatatagaatattgcatttggattcacgttattacttttaaaaactggcagttaacaaacatttatgtcaaaattagaattcactaaaattagtgccgtgtgcatagtactctcttcaccctccaaaatgcagcacagtttagttaatcctcaaaaatgttggttcaggattctggaagctactttaatctttgatgaaatttatatattaaatgagaagcggtatcaagataaacctaaaacatatttcgggtaagttacatggtgataaatctatagagtaacataaaaatataacctagtatgggttaagcaactattttacagaatgaaagataaaaatggaaaaaaaaagtcatgcaagaaatcttaaaacagtttttaatcataaggatattatatttaagtatgggtggattactgcaaaaagtgatttttgtattctgaaatgttcactgacgttaatatttttaaaataacatacatattaagatcattttttctagtatacatgagattatttttcagttgagataattagagaataggaggcaacaaatgtatttacttcattgcattttgaatctgaaccaacgcccttatggactctcgtatgtcctgacgtcatgtgcaaacgttttttcatgtatcattttttgagtgaaggtgttttgcttttagaagatcaactctgatccatcactggttaaaaacttggtctaaaaggatttatataaatgaccaagccgaaagtcttcagtttttagatgaggaagcatagatgcatagaggttaaattacatgcaaaatggctctcagctactttatcacagagcctacatgaaaaatcaaaatatgtggatttctcagtcagtatttttctactatatcacagttctccttgtgtttattcatagctgatttacgtttttcttttaatggatgacagtaatattctcttacattttcacagaacttaaagtattggaccaaatcatgtgatttactttcaggtagagtattttaaggaaagagtaggaaagggctcacaatattgaagtaggcggagctaaatgatataggataatccacttcaaaagcatttttttcatacttgaaatttcactttacttttgtcagtttggaatgtaaaaaagtattataaaagaaaaaatgcatacattttttcaaataaagcattgattttattcatgaagttttcttgtaattacatagaactgacagttaccgcctacagtttaaaattgcagtacttttcatattttaagaacagctttttttttcttgtataagcattccatttagtatgagaaaccagtggaagctatcagagggatgaaaagggatttattcaaatataatttttaaaagagttcctttttatgaagcagatggggttactatatgactgttgaggaggaggcgtgtactggtgagttgggaccttctcaacctggtggttatcatttaagtaagagctttggtgctgttatccacttttacactgtgatccaaataggctgctgcatgtagctgagcataatgggagcagataaatgtccttctttttttgtacaggcaaaagcaaataaagtaaactttcctcttacaattgtttccaatgtcagtcagtgcaattagtagtaaggaaaactaccctattattttttaagatagggaaatgtgagtacctttcaccaaaaaagacacatcttaccataataattctaatgatatacctcaagttctaacacttctacatctccactaataactcttagtgtttatttattctttatcatcctgggaccacccctgggggaggacattagtgacataaagcagaaagaaagtaaacatatggattccagactaaatggtaacaatttttctccctattgaacactagtccttggagagaaacaagcagcttgggcttctgggactctttagacttaattttgtttcgaaaatccattctgaatgccatttttaaaaagataaactgccagaaaacaaaacaagttgacaagttagaaattattgtacactgcatttgtagagaacagaacatacctttaacctgaaaagctcgttattggaaaaaaggtgctgtaccactcttcagtttattgtatacagcgcttgttggaagtgatttccttttgacaaggttatacaggatctgttgtgctctaataagctccaataacaaaatgtggtggcattttctaaaaaatccttcattagaatataaagaaaaggacacttttctgttgtttttaattggatgatattatttagagctctaacacttttaaaaacactgaaaacctgcgtttagaatatagaactattctgtatgctgcattttaatttttttaatactcctttagactggaagactcttaacaggaattatgaaaaatcatctcacacatgataaaagggagagcaacttttttcagggattaaccatgtataagcttctgttactgattcatatttttaagaatgatactattgcctatctactggtatcattatcatcaggagtgatgttattgataaagcacctgtcatttctagaactgtggtccatccctgtagtcccagctactcaggatgctgaggcagaaagatcgtttgagtttaggagttcagaaatgtagtgcaccatggccatgcctgtggatagccactgcattccagcctgggcaacatagcaagaccccatcttttaaaacagacaaacaaaaagcacctaccacattgaaagcatagagctagccaccctgatgaagtgcaaaagtttaccatgaagttcattctctctattatcttattctcatttgttcaggaaacaaaaatgcaagcaatatatgttaagtatcaaatgaatgttacagcttctcaatttccaatcccagattttctgaagagctttgagttataatcagtgtactgcatactttattattaaaaagagctaaaataatagagtttacaaactgattatgtaaactagagcaaatttgaaaatgttattataacatcgcacatttttaatttgtgttttctactgagggacagaaatggatatagagctagtgggacacacataactgtgggtcctcccatagcagtatgtcatgaatggaagcattattggtcatggggatttgggtgggacaaagtgaaggaagcagtagataaactcaaaaagtacaatgggtggtgaaaggaaattaggtgggcttagctggtcaaggaagtcttcacaaaccaggtaggaatcaggctgagatgtgagagtagcattttgttaggtatcaggaaaggatggctattctgaaatgaaaagctaatgagggattggctcagagtatatttgtctaagacaaagtgatattttaaaagacaaaaacatgttaatttataaggctgagcctacagtttattgggagagggaaacacataaatataaacatgtacacgggtgtctgcaaaatgcttaaaagctcagagaaggaagatattaactctttgcagaactgggccatgctttccatatgagatcctatttgaaccaggatttaaaggatggacatgaatgagataacaaatgtgaaacagggtgtgcctctgagaacctacagcacaaagaacaggaagagctatgtctagctctgtcaagggggtaaagcacttgtgtcagaggcagatgtcttcttgtatgctaggcttaagcttctttctctacattaacttggcacttgaaaaattaataaaacaagccagacatgtatcctatgaggaactctagcccctgttgtaataggaaaccacaaagttatggctacctcaacacaatagtgggtggtgcagttttggagttcctatcagagtcacgcaggttaagcaggagagatgatggactgatgaatttatcatattcaagtttagccatggtcctgtaaacagattttagtttcctgatttggcaaatgcgttgttttagctgaaattatacttctgcatgtgactaagttcttatagaagtactcagattatttacattgcatttattggcaacccagcgttcactcacatgaataacttttgcagcctagttagactgtctgcacaattatgaaattgttctattgacttgatttaggggttctgtctgttattgaaataccccaaaattttccttttacatgaaaacagtactttatatatgttataagtgaaatgaaaagtataatttattacaattcaaactttatgtgtaggcaaaattataagaagatattttcatatcttggaatctttacttttctcagcttcctgtcaataaaaaggctcacactgccttttaaataaaacttcttagatagacagatagatagatagatagaggtccaggatttacataaaatgtgtacatatataaaatatatgtataaagatatatttaaagtttagatcatgaacactggatctgtatgaattcatttcatatcctatctaaaaccatcaatttattttagtgagtattatttattttaatataccatgatatgtggtatttagtatgtggtgagaataaattggctaaataaatttaaaacacataattatgatttcataatttcagagaaattgtcattacacattcctatatattgtgattaaaacttttaacagcctgaaaactattgttagattagatagcaaacaaatttcttattaatgagagtattttaaattctgattttgatgaacttcattgaaatttatcttgtttggatttaaattgagtctaaataatttatgtataattactaatttctccgatcagctctagacaaaatttactttcacttagttcatttttcaaatatcttttttattagaacatattttatcaattgctgactcttcactctttataacttaacatctaaaaatacaaactacaaatatataatacgacacaattaatttcttttgtaaatttgaagtgctgaacctatcatttataactacatttttatttcaggcaattgcatttatagttggttaaattaatacactctccaaggaacacacaaaaaaatgagctcatcttttgcaatgttgaattcagaggtgaaatatacaaattgagctgtgtattggatggttatcatttctaaattccaatattcataaattatgcatcacatgccataaatttgaccatgttttatttatagttgtcttggtgtctgtgttcaaatatcatctgattaatcataggatgttaccatataaggcatatattaagacactctgacactgccatgtcatattaagcaaattacttaaaatattagtataactgcagattatcttgtcctatggaaaaaattaataagttaatgttgaaccagtatttaacatttttatgatgtatgtgtgcatgtatataatttctctgcgtatgaattagtatttttcaatattggggaatattttaagcggtatcattttacaagggataaaatgggctgcagtttccaccctgtaccatatttgatggagtcttcttttcattaacagtgtaagaggtttaaaaatgtacaggattccaggcagagctcttctcttgaagacctgattgtctagtgggacactgagagcaagaaaagcagagcgggtggaaagtttaggtagaagacagacgtttcatacaactgttctggtctttcagagaatttcaactaattcaattgatcttacatcgttcaattttagttgcttcccattaatattctggtgctgaatatttaggttattttaacttttactatttcacaatatagctgaaataatggggtggtctttaacaaataatgaaagaacagaataaaaccctcaaaattattagaaaagcaaaaatgttttaaatgttttaaaacacatagaacaaaatgaagctagtagtagttaaaaacatgtaacagtaacaggcatcggtttctttatgacaagtcattttttaaacccaattgtcattttggcactttccaccaaattactttcagtcaatttgtttttagccacatatgatgtcagagaggaggataagggagaatgctgaacagataaaaaagaaccaggctatgtgtaaataataatttgtaatgttatttatttgtgtattttaaaagattctaaggatgttgttttgaagtggattaacaattattaaaactactcatctttttaggttatttgaatattaacctatggaaaaatgtatgcttaatgcgtttttacccttgtaagaaataaagatatggtttgctttatacaagaatgctcctagtacttgaaaatatatagactgtctttaaaaaattcaggatttattactgcctatattggttgacgtggtataagcggggcaaggttggggggactccaaatactactataataataataattattattattgtaaataaaaacaaaacaaaacaaaactaaactaaaaacaaaaccaaaatcctgtgatttgtattccttctcttaataattcagtgatggggctgattttgaaagactacttttcttattagaataagatccaatgcaatagtatttgaactgattatgtgataggaaataaaccaacatgttataatctgtgataaatttggaaataacagatcatttacatggagttttaaatgcctggtattattgtttgttcataaatttgatatacttggaagatattggtctttgcagttattaaatgtatatattttgagatcctaatcagcaaataattttgctaacaaggtattattttctattttagataagtataaaagttaaaattacacattttttaaatttagaaaatgttttcatttacctccagtctgcctaaactgtttaagaaatcttaccttgaaataaggagttattataacaattagtaaacaagaagtatctttgtccatatacataatctttcttcatttataatgtcgttaaagtcagttctactttatgataatggtagatcgcactccaggctttacccattttccctagtgattaatgcagcaccactgagttttaagaaggttgttttcttaatctgactggccaggaagcattttccctgtcgaaaaacaggtgtaaacatcaatattcaagataagagagcgatctcatgctgttttctggtgtatccagtgtagaaaattcagcgggtagagtctacagagtgagtagggctatttatcagcagtaaagtactagaaaatgtttggtgtgactcaaagactttaactgagagaatgacaggaaaccttttaatacaaaataatctgtcaaacactcggaatatatgagggctatgtgacaaacatgtgaaatcaaacctcagcacagtaattattggtaatttggaaactgtttctaatttcctcactgtgtagattacatgcctattcactttagacaagatttgactctctgaggatctcactgaagttctcatagcttgacactggctgtattgtttcaatgttctctgtgctgctcttcatattttcagctgatttttagtgaaaggaaagaggatttgggcattaaacactattctttctgggttttattttttctgtatttgaagctacacttaacttttggcaacttaactaattatggattagaggttcaatgttacacttcaagtatatgttcagtaacccctcctaggtatgccgtattaaaataaatcataaacctttcagaatatcgggtgccatgctagttgactcaatacttgttaaagactcctaggtactgcaaaattattagaaggcgttaccagttaaccagggtaagaattgcaagactctaaactgtgcattaacctcatttgtgagaacaggagaagcaaaataacaataataataacaattggcttcttttgtttgtttgtttctaaagattgctctcatttcctatcattaagtcttcctaaaagaagaaaaaaatcaaaaagcatttaacatgcatttacacattgatcgttaacattttgttaatcttatatggtggtatatgtgtttatttctgtatgtgtcattctgtttacttctttgacaaagcatgtcatttttttttacctacatgttttttgctactgcatgtcaaactttttaaatgactcagtgaacaaatgaattcttgtcattttacattttactctaaatattgaaaataacctgcttactctcaaacattgctccaagtctttgctttgtgttggagcatgaaaaagaagtgaaaaaaatgacaagaattgtgtgacacagttttgtacctgatattctgttaaagcttgttaaagttaaacctcaataagttatatgtatttataatttgaatcatttgtgtttctcttttgtttgcatgatatgattttgtttatattttttttccactcaccagatgttcccaacactttgcttcccactactatcatcccctcccttaccactgcaacagtcacaaccactgtagccataacaaccagcccaaccacatctgcaacaaccagcagcatcagaggtacagtatgtttctttgttatagcctggaaagcacattaactggagctctgtagaagtttttagaaaggttaaaaacattgagattcaattttacttaattatgagaagtaattaagtcacctaaattgctatcaattagggttattggaatagaatatgagaaatgatggtacattttattttttttagtgttacttaagactattatcaaaatcttgcagaatatagatttaaaatatatgggactttaaaatgttggtcaaatttaaaatgttagcatgggacacagtttttgcctgtcttgagaggtaaacaaataaataagatgttcatgtgtgcagaggtagcttttacttttttaaaattctagtttaatattaataacttgccactcctctgcaactatgttaaaatatctatagttttgaaattgttctaaaattgacatagtccatggggtcagtataaattattctccacatagaacttgcaagtaaatattcaaaatacatgtatcccaaagtgatttgctgagtgaagctacttattctactaatagaatgttctaaaagtaaatatctgttgtctcagatggctccatgagtaatttctgatatcattatacaaataagaattttatttcaaagaaatcaaccttaaaaaggtgggaatatccataaaggcagaagaagtaactatgttgtggttgagaaatataaaaagtattcctgagcagtcattaagtggttagcagctgatgaggaaattaaaaaaaaatgaagccattatagaaaaacatggtttaatttctacataagcagtgctcagagagaatttgtcgtatttaagtctgtctttttcttatttcttatatatgtttcatgtcaccttggctctactaatatctgtgaaatttaacaatttaacttgaaattaatgaggactttatattattatatttaattcagttgtatgaaggttatgtttagcattattattcataattattaaaggttgttcagttagatggttttcttggaattttaattaattctagatattaagttgatttgccgtctttgatttaacagttataatagtctttgtttcagaaaaaattctaatgtctgataattttccattttttaataatgacatcaactatattatacaatgtacaagattgatgactaaataagtttaatggtagtagcaataagaatttctcagaaatagctaggtatgtttttgtatgactgaactttatttaagctaaatctgtaagtgagaagagtgtgaaggtctttcttgtaaaaaattatataaaaatgggaaaagagacataatgaaaatgaagaaaaagttagaagtgctttataatattatgtaaaatgaaagttatctaaagttctactttgctttaatttgtgatgctctgtaaggtttttcacaaacggcagtctaaataaaatgtaatcattgcatactaacacaatatctgctatactattaagttctgactatataaacaaatcacttcaatgggaaaggagggagatatattgactttttttaaaagatccatttgtaacacaaaaatctaatattcaattatgccttcttcttcaacaaatatgtattgaatatatgctatatgtatggtgttatgccaggacctaaaattatgacaactactggcatctaaaatcactagcaatcaaatgtatacatttctccccacccccaacaaacagtttttgtgcttaatctttattgaaaagtactattgttctttgtgggaaaatattacatgtggtcttccggtcttttgaaaaaaaaatccatagtattttgcttcagaggactatatatatgtatatatatataattctgtttcaaaggactaaatatctatctatctatgtaatttcaaacctacacacacacatttacacacacgccattatagactattatatgagaaaaatatttcaaagtgaaactaacaacattcttttacattggttcacatgaatcttaagtgggatttggtctattgcattttttttccttccaacttttattttaggttcaggagtacatgtagaaatttgttacattggtaaactaaatgttgctgggatttggtgtacaaattattttgtctcccaggtagtaagcatagtatgtgataggtagttttttgatcctcaccctcctggaccctcccatcctcaactaggtcccagtatctattgttcccatccttgtgtccatgtgtcctcaatatttagctctgacttataagtgagaatgtgcaatatttggttttctgttccacattaatttgcttagaataatggcctgcagctgcatctttgctgctgcaaaggatatgatctcattctttttaatggctgcgtagtatttctaatgcatatgtaccacattttcttcatccagtccaccactgatgggcatctaggttgattccatgtctttgatattgtgaatagtgctgcaatgaacatatgtgtgcgtgtgtctttatggtagaacaatttatattcttttgggtatatactcagtgatgggattgctggatgaaacagtagttctgttttaatttctctgataaatccctaggcttcttttcacagtgactgaactaatttatattcccaccagcagtatgcaagcattccatttctctgcaaacttgcctgcatctgttatttttgactttttaatagcagtcattctcactggtgtaagaaggtatttcattgcggttttgatttgtgtttctctaatgattagtgatgttgagcattttttcatatgcttgttagccacacacatgtctgcttttgagaattatctgttaatgtcctttgtcactgaactaaaatcagtggtttactctttctggtaaattcactttttttcaggtttcttaacatgtttttgtaaactttacaccatggatgcttaaagtgctcagataatttatttttcccttaaacactcaaccaacctccaagaagacacacatgcgtacacacacaaaaagatatgaacaaaaaccaatccctcttttttaacttaaagtttgaaagataacatttttaaagaaatcacacaaaaatatttttttaaaaagtttttttgtaagctgggaagttcatattatctattttaaaagaaaaaaatagtagcattgaattttaatgttagcctaacgcccatttttccttctatcctcatcaaacatctgaggactgcctaagtcaccagactcacctgcatcattaatattctagttcataactgaaagtgtggaggattcatttagtatgtaaacaatgttatcaattttacactgtattctttcaaattatgtgacgttgtttctttgtgaattgccttttaaattaaaacttttagatgcaattatatttgaaaatcatttatttataagtttgtgaaagatggttcaaaatcatgattaaaaaggattcataataagaatatattgcctacgaaaagctgagacctaaacagaaagaatattttcaacttgcagcatttctttttggtttacttatttcattcctttatcttattcaataatttgaaatcaactaaatgtatttgattttattaggtttaaattgtatttcttcaaatttcataaactatagcatttatctccatatttttaataaatgatcacaaataaatcactgttaatatctccatttacacttttacaactcctgctattgctggatttttcatcctatgatatgttaaaccaatttaaaatacatttaaagaatcacagctgtatctatattaaaaatcaagatgaaatggaatgaaagaaactacactggattgacagtgtcataaacttgagaatttgcgcaactcttcagcttgtgtttaaaatgcatccctatttggaggaagaagaacttcaaccacatggaataaaaacaggcaattagtatcttattacaaataaggatgttaaaacacagagaaatgaaccaacttgggcagctatgggaaagagctggattgagccctggatacatctttggatatgagtttcagttattttgtttacaagatgtttgaccttcgacggtgcaccaaattgagcatcagtgttttcatcagaaaaacatgaagcacaggtttgacttgagagttatataatatctaaagttatgaaaacataagcaatactcaataaatgacagaattattttttcagttcgttttagtaaaacaaacatgtttaccagcagttgtatcataccattaatgaaatggtagattttcccctataattacagttttaatctggcaaaattctttggtgttaatgcactaattactttttcatttcaattctatttttttgattgtatgaaacaaacattagatgaaaattatactagagcatatggtaccatttatatctatctgtctatctacctatctatctatctatctatctatctttcatctatcattcatctaccatctgtctgtcctttgaagtataacagttcatatacttttcatgaagtttaaagtattcttaatctatatcattttaattgtttcagcttttggaaattgcgtaattttttacagtggcctaaccaaccttaaaattcagattatatatatacatatgtgtatatatatgacacacataatatattatacatattatatatgatctatcttatattatacataatacaatgctctgtattatgttatatatgatatatgctttatattacatatgatgtgtacaattattccgattatatattatatatcatatgtgtacatatatgtgcacatatgtacacatatattatgtatgcacatatattatacatgttacttttttaggtcattgtgattttttaattaacttaatatagtcatttataaaataattccaagtgactttgatatgatttctagtattaatataagcattattttagcatggaatgtttaatttaataacgttctcatttttatcatataattttaatttcataataaaccatgtcataatctagtaatctttagtagcatcctcattttatagatgatgttaacttatttcaaattcaggagacatatgaaacatagttatatatttaagtggttatgtttatttatcataatttttaaataagaatttataactgaacttttatacttaggacagaaaattttctaagctaacaattgatatttgtttttacctgcacaggacagtaaatgcactaaatgtagagatgatctgatagatatggaaagatgtaaaccagtatacactgtcctattactaagagtggattcaaatacaccatacatttcaatgtaccagatagggaaagaaatccaaaaaatggtgattaaagtgtttacacaatccatgtaaaacttcaaatgaattgttgattcaaatatagatttagttttacatcagtctttgaaatggtagaattataattttgtactaacaaaaactacattatttgtctggtaatctcaacaaatttaattgtaatgagattcgttgcaacagaaccttagttcaaaatggtacggcacacaggaaaaaaaaggatttttttaaactgaagaaatcaaactgtcaaaatatctagaactagagttatattgacaaaactcacaacattttaagatgtgtactcaattcttaacaatttaattgtgcattagttgccttggtctgtttggggtgctataatgaaatttaactcagtgacttacacataacaaatatttacttctcaaagttctggaggctgggaaagccaagatcaagtcatgggtacattagttgcctgttaagggcccattactcatagatgatgacttctacctgtctttccatgtgtcctcacattgtgcaaggggcagagcagctctctggagcctcttttatacaagtacatatcacgttcatgagggcttcacctcatgatttaatcacttccccaggccccagctcttaatatcatcaccttgagggttaggaattcaacctctgaattttcaggaggacatttgtgtcctcaggaggacatatggtccaacagaccacagcactactgttgtgacatatgtttaaaaaggtaacgttaactaaaatacttaaaatgattctcgaagaatagaatgatttttagtatacgtctggaatgactataaaaccagtctagaaattatagacccataatttttagcccatataatgccattgtatttttaaatcatgtgcatcagaaaacttaattctttaaatgtagatgaatttagggatctgtttgtatcactataatcctaaaacattgctttctgaaagatcttaataaataactactttttcactctaaaagcatttgaaaccatcttagtgacttgtaaaaaaaaatcatatacacaaagttgagctatataaattgaaaataaaacaaagttaagtacacactttgggccattgttgaaaggttgggatgaattgtcaaactcatatttaatgtggacattttaaatgaactacagttgcctaaaatgtgcactacgaaagagtttcatttatattcagattctcttacctcaattgtttcatttttctgacttcaaaataaaataagctaaagcaaacaccacatgacatatgtgcacttcaaaccactgtctgaagcatttatttaattaaaccaggttaagaatcaataatgttctatcctgcccttctattctctacatcctttatatcaaaagaaatcaagtctatctttacttaatttttatttggtttcattactgtgtctctcttttccttcttggtttaaatgctttaaaaacagaatacaaagaaataaagaaacatcagaataaaagaaaaagcattccagtactgagggaaaaaaatgaatggaataaaatcattatagctctgagttaatcaccataaatgtactcaaatagaacatttggagtagtagaatatatcatcttgacacagttaaatcccaaagtgtgcaaatcaagaagttgtttatgagattctattatgagtgtttagctattaaaaatcttttttgttttattggtggtaataaaacacaatttgcacaatgttgtgagcttttaaaaattaagtgtcaatatgttggggtttcttttcttgacaaaaattaagtaattattcaatatccagatggtccatatagagaaacctgcttatctacaaaaagactgatttctatgtttagggtacaaaaatagtttaattttcactagtcttttaaaaaacaatcatgattatgtttagttgattaagttttaaaactaaatatctaaaatagttcatagtgaaaacaaggtagaaatgcttaaggaacaagcaccatatatgttctataggtggaggtactttcaaccttgctgcgagtatcacatcgtacatgcttttggagtggctgcaggcaggatgtgggtaggaatactggcttgggggtccaggatttttagttagccatggacctaaatatttgaatagttgcaatgtatcaagttgtgttatttcaggttagcatcgagtgctaaagtttttatttatattctaatagaccttatttggtctattagaatcaacatatataacatatcattggttatatataaccatttccaaaactaaattgagcatttccatctgacttgaatgaagttgaactctgacacaatttgaaaatctttaagtatttactgacttgtttgctgcatttggaaaatatctgagaaaaccttgtatttatattttctttccactattacctattaaaggaagcagaacatttatgctctcttctattttctaagggcactcttgtgacttgcataatttaaaacatcaaacattttttaaagtttcattttaaacttatttatttcttcagcttccatcaatttaaacagaaatcttcattctattagctttcatttcttttaaataaacaggtctatttatatagcaatgaaaatatattttcactgctctacatttagaagtgtcttaattgattttatagtagtaacccaagatttaatataatctaacagtatatatgttttctgaaaaacaatccctaagaaagaaaaaaagttccccagtataaaccattaaaaaattcatttttatataatatacatgttaaaataaataaaattgttataataaattataattattataattaaatattataataaaatatgtttatatttatataatttataatataaatttatatttatataaaataatataataaaaataatatataaataattaaatataattattataatttcagaaactatgtttcctatgaaatatcgaggctaaagtgagttattattaatctgttctatatttaagaagcatattctacatatataagtaaatgtatttctagaacatctctaaatttaaaaaaaaatcattaataaactggctgtatctttcttactaaccagtgaattaaatttacaagctgtgcctttgaagctgaaaagattgcaggcactgcccttgcttctttgacactccacatgaaacacagttaataacctcctgtataagcttggtgaaacaccgaattgatactaattataccaactttgggatagaagatgaccttgacttcagctggaactttctgccaggacaataaataagagcaaatgccacaaagcgtgacttctgagaagggtctaatacaatctattaactttcgggagttcatggaattccaataagtgttcagataattgtaatattttaaaacatctcttgcttcaataatacagtagtttcttatttctctagacttcaaataatcccccattagttttctatactcatttaaattaagctatggccagaaaattaaaagctacttgatggaaagtgtgtataaggtaactacaagacaaggaagcagatttttctgaataccttctgaaatatgtacataacatttatacagttttagtatcagaactgcttttagcgaagctatgacaacactgtttcttaaataaagaaatatatctattaaatgattgagaaaaacgactaagaaaaagaatttgccccagtgagtccacaggtttaaactattggaaaaaacctgtcaagatcaataacgtgtagctgtgtcacagttaaaattttgattttaacagagttaaaaaagaaagggtcaataaagttactataaatgctaacaggtaagaacagaaattaaactctcttcaccaatattgtttaaagaattacgtttgtgtccagagaattctgttcaaatggttcagttataataaattaaaatacctagtttaggtccacttatttttcatcttagaaaaaagagatggactcaaatatgcccagagctgttttgttactgactggtaagcaaagaaggctgaacaatgagtgtttacatgggcaaaagagaaagcaactgtgaactaacatgaaattacatcagagtcattgagaagcatgtgttttcaaaaacatttaaaccaattttgatatttaaaaagcgggttctataatgaaggacaatggtattctagggtagtctggtttacactgggtaaagtacaatgctcttagtacaatttttttctcttaaagtcatcttttaaaaatattaattttaagccccattcctccactctgttactctggatgtcagcaggaaactaatggccatctcaaaggggtggagccaaagtgtgtaaaataaggagactttttaacagaaggacaggcagtttttggaaactaataaagtaggaaaagcacaagagaactgttggctacagtaagatgctattagcagcactaggccaaaagagccaaaggaagtgagtgaagttatcctaagcaaagaaaaactggagccatttttgggtaccacttaaaaggagcagcagtcaagcaaggacacagccagtatcagaacctcaagaaaacgaggacactgggggacaggggaccaaaattcagaccacttttttctcttgcctttcaataggatattctgttaattgaattcatctgaaaatcaaggtcattgcagagaagtcagcattctagagcacagaacagggcaaaacaggacgaaagatggatttggagaccaaatggagaaggaagaacagagatacgtgtgctccaaatatgacacccaacttctttactcagagcagttacatgtcagattatattttagtttttcatttctcctataggcatacatactacaagtctataatagaaaactagtggctgggcgcggtggctcacgcctttaatcccagcacttttggaggctgaggcaggcgatcacctgaggtcaggagttcaagaccagcctgcccaacatggtgaaaccccgtgtctactaaaaatacaaaaaattaactgggcatggtggtgggcgcctgcaatcccagctactcaggaggctgaggcaggagaatcgcttgacccgggaaggggaggttacagtgagctgagatcgcaccactgccctccagcctgggcgacaagagagaaactccatgtccaaaaaaaaaaaaaaaaaaaaaaaaaaaaaaagaagactaataatggagttagaaatggtggtaaatggaaatacttaaaaacacttaacaattcactttaatacagatggtctccaaattagatagtttcatttaagatttttttgccttcacgatggcacaaaagtgatacacgtcagtagaatccatactttgagtaccaatacaaccattttgtttttcactttcagtcagtattcaataaattgcatgagatattcaatactttattataagataagctttgggttagatcattttgcctaactgtaggctaatgtaagtgttctgaaaatgtttcaggtaggctaggctaaactgtaatgttcagtaggttaggtgtattaaatacatttttgacttatatttttaacttacaatgggattatctggacataacgccatcataaatttaggcgcatctgtatgtgattgcttattgcaggctgcgttgggaaaagacagactctagaggatagaggacgcattatggaacttgataaggctgctttgttagtagatactaaccttataatttctaaaattaaatatgtttatgcatttcacttgcttaaaacaatggctggttcacaataaataataagggttagcttttataataattattcacaattttcttaaaattacccatccaaaaaacagaggataaaaatgactttgttcttttgtgaatatcaatgagattatctggcaactgctaggtgaaggctgaaatctatcgtagatagaccatcctttaaagccatgcgaggcttcttagaaaattaagctatgaatatgtctctcttgatttcaagtaagtagttaagtgtggcacattatgccaaccccccaaaatgccattttgtcataaggattattttgaactaaaggcacttgagaaccagtaggtagagaaaggacactgatctcccccttcctccctttaacaggagaaaaggaacaatctatcaccagagatgggagataaaccctggtgggaaagatgccaatccctgtagcagcataaaagaaatattgtcacagggactgggagttaaggctaagaaaaatctgtacaaacacagcttgttaaaataactcttatcttcattatccccccacacattttaattatttttgcactatggccatcctttattcaacctactgtataatcacttgggttttctcacttctttggctcctcattttccgtgatgacttccaaatacatgtaaaacaaatatttattcttttattctgtttagtttgttttatgtcaacttaattctcaggcccaattgaagactaagaaggcagagataaagttttgcctcttctatagtaggataaaacagaattgcattgtaattcttaattattcaatttaatgagatcagttatcaaataaataaaaaacaatttttaaacaaaagtaagccatttataagtaatctaccttgccaaatattaacacacccattgcaataataagttaaggtaatggcctttagtatcagaaataatctggtttggatgccaagtgcatgatatgcaagttatagtttaagatttggcttctccaactctaaaattattacgagcatcaaaataagtaaggactacaattttcagtcattatcataatatggctgatattctaaatacgagaagctattactataaaaatttattaaggatatcgatttagcttaaggaatttggacttattaatattaattgataccattttcgtgttaaaatatatttcattatcatttgctatcattgatttataaaactcactactcatctttgatatattgacctatgaagtcgcttatttgacttaaaacaatcattactaaatccaattgattgaaatacactaaaactttttcagtaaattaaataactatgaaatgtttgggatattatctaaacatattcaagattaggcagaaaaaccacattagttaaattccaaaaagttttcgcttcttacttagtgtatttttcattttaaataattgttcatcacagaaaaattagcttttaaaatactaaacaaaataaaaaagagacttccttatcctgcattattgaaataatctgttacattttgcaaatattctcagagattttattttaaacatatgcatgtgtactgcttatacaaaaaaattgatgtgaaatatttttattttgcatgctttttatcatttatgtcatgatcatcttaatatgtcaataattgtaattctgtatttcttaagtttttagtaagttttaatgaccttcctctgaatatgaaaatattaatatatggagtcattttatttttctaaatttataagaataataattttacaatattttttgcatttgttgttaggtataaaactatagtgaaacatttgaatacagataagtttaagttttcatgtgtatatttaaagtacaggcatgctttggagatatcatgggttcagttccagatcaccgcaataaagcacatattacaatatcatgagtctcacacatttttgtttgtttcttagtgcatataaaagttaactatcccatagtctattcagtgtgcaatagcatcatgtccataaaaacaatgtacgtaccttaatttaaagttgttttattactaaaaaatgctaatgatcgtctgagtcttcagtgagttgtaatttctttgctgctggagcatcttgctttgatgttgatggctgctgactgatcagtgagtgattgctgaaggttagagtggtaaggcaatttcttaaaataaaacaacaataaggtttgacacattgattgattattcttttcctgaaaatttctgtgcgatttctgtttgatgaaattttatccacagtagaactgctttaaaaattaaagtcaatcctctgatacccttccattgctttatcaactaaatttatgtaatattctaaatcctttgtgattatttcagcaatcttcacagggctaggcacagtgacttatgcctataatcccaggacttcgagaggccaaggtgtgaggattgcttgaggccaggagttcaagaccaccgtgggcaacatagcaagaccttgattctgcaaaaaattcaaaacaaacaaaaaataaaagcaaaataaaaacattggtcactgtatcttcaccaggagtagatttcagcttaagaaatcattttatttgctccaccataagaatcaactccctatccattaagtttgatgatgagattacagtgattcactcacatctttaggctctacttatagttatcttgctatttttaccatatctgcacttacttccaccactgaagtcttgaatgtctcaaagtcatctataaagtttgggataagcttcttccaaactcctgccagtgttgatattttgacttcctcccaggaatcacaaatgatcgtaatgacatctagaatggtgaatcatttccagtaggtttttaatttactttgcacagattcatcagaagaatcactgtcttggcagctatagctttaaaaaatgtatctcttaaataacaaaatttgaaagttaaaattattccttgatccatgggctacagaatggatgttgtgtttaacaggcatgaaaacaacattaatgaccttatacatctcctttagagctcttgggtaactagatgcattgtcaatgagcagtaatatcttgaaaggaatctttttttttttctttttctgagcagtaggtctcagtctcaacattgagcttaaaatattcaataaaacatgctataaatagatgtgctaacacccaggccttgttataacattgatggagcacagattagatatagtatatttattaaaggccttaggattttcagaatggtaaatgaacattggtttcaacttaaaatcaccagctgcattaacccctaacaagcaagtcaatctgttcttagaagctttgaagtcaggcactggcttctattctctacttgtgaaagttataaatggcatcttcttccaatagaggactgtttcatctacatttaaatgctgttgcttagtgcagctgccttcattagtgatcttaggtagatgttctggataacatgctatagcttctccatcagcccttgttgcttcaccttgcacttctatgttctgaagatgacctattttcttaagccttatgaaccaacctccactagcttcagactttttttctgcagctccttcatgtctttcaatcttcacagaattgaagagagttagggccttggtctggattaggctttggtttaagagaatgctgtggcagatttggtcttaatcaagaccacttaaactttctctatatcagcaataaggctgttttgctcccttataatttacatgtccaccggagtagcacttttcatctccttcaagaactttttgtctgcatttacaacttgactggcacaagacgtgtagctttcagcctctcgtggctttcagcatgccttcctcactaagcttcatcatttctagcttctgattcaaagttagaaatgtgtgccacctcctttcatttgaatacttagagatcattgtaggattcttaattggcctaatgtcaatgtctcaggaactagggagcctggaggagagggagaggtggggaaaacagctggtcagtaaattagtcagaacagacacgtttatcaattgtgtttgccttcctatatgagcatggtttgtggaatcccaaaacaattacaatggaaacatcaaagattattgatcacatatcactgtaacagatatagtaatgatgaaagcttgaaatattgtcaaaatccccaaaatgtgacacagacattaaatgagcacatgctgttggaaaaatggtgccagccgactaggtcaatgcagggttgccacaaatcttcgatttgttaaaaaaaaaaaaaaaaaaaatcattatctgcagagcacaacaaagtgaagcacaataaaatgaaatataggctacacaaacagacaacagctgttagtgttttaaggtctaagacatttatgagaataatgaacattgtggtaaaatagtactttgcctctttacttaatggaatattttaaccaaaattccatatttctataacatcttaatatttcaataatgtgttatttaatacatgacacaatatacagattttggaatgttctcttttaaaaagtcatattggtattgatttacaattaaagtgagaggtctgcattaaaattatggtggaaaaatagtataaatgattttctacataacatgaagtcactcaatgtaaaactttattcttaagtgacactcaaggtatgatgatatattcatcatatgctaagtttgtcataatacccctgaataattttaaattcatttggaaattttaaaatagtacaacagaatgaaagaagcagccttcaaagccatttaacctactttctgcatcgtattctaagtgaagaaatggaaccccagagaaaataagatatttacttatgaccatacactatttatttctataagaagcctaaaatattattctcctggatcatcctttcttccaaaatgattagtgataggtattcttttttatatagaaagtcttcagttgatatattctaattttatacatagttcaagttacaagactcagaagagatggaagaaaggaagactttaaaaataaaatacggggtgggcacagtgtctcacgcctgtaattccagcactttgggaggccaaggcgggtggatcacgaggtcaggagatcaagaccgtcctggctaaccaggtgaaacaccgtctctattaaaaatacaaaaaaattagccaggcgtggtggcggtcgcctgtagtcccagctactcgggaggctgaggcaggagaatggcgtgaacccaggaggcagagctttcagtgagcccagatcgtgccactgcactccagcctgggcgacagagcaagactctgcctaaaaaaaaaaaataaaaaataaaaataaaaataaaataaaatataagattttgttcattaatattgtaagacaaaagcagagggatcaaaatttgaagatttatattatttaaatttactttcagacaatgccactaagaatcattacttattaaagcctgaaaggccttgccaagttaaaagcttccattttttcatttacttttttttttttttttttttttggtctgagacggagtctcactctgtcaccaggctggagtgcagtggtgtgatctcagctcactgcaacctctgctcccgggttcaagtgattctcctgccttagcatcccgagtagctgggactacaggcgcatgctacctagttgcaaaattggaactaaaattcacatacatataatccaatttactattctgtaaatccttcttcatagtacaacagttaatttagaaaatcaaattaagaaaaacaatacgtataatatttttctggaagcacctataaatgtgcagaggtgttactaatattattttaataatacatagataatacatttgatctagtgaaaactttattgttctgaaatattctaagaaactttataattcttcttcatcaaattcagcagatgtatattatacattatttactatacatccccattccaacctttttggaaacttgtttttaatctgagaagacagttattgagattagttattttaatggcttttcctaaacatctagttttagtgattatttgaccaagtcttaaaacaagataaacaatccctattttgatgcttttgaaattcctgttcttacacttcttcatcattcctaccagtctagtaactttctcttctatccccattctggccctgaaagcctcatctcatcagaagtgctaagtgatacatcggtcagtgtggaggtgtaattgctttgtcttccataaactactttgctaaaatctattcaaggtcaaggctgtcactttcatctctccgtgcagtttggctctaaaatgaaagtgttttgtttaaattatatttgaaggtttaggtgttcaaaaactaaagggaatcacttctcaagtttaatctatgagacacaccaaaaaagtaacacaaacataattgcctgagcagcagtcaaatttaagcctgcagaataaaagccctgtgtattatttgcataactataacttaattttattagaaccatgaactttaatactgtgtccttgattattcattcataatctataagctgaggaacataattatggatatggagctgttagtgtattgcaaattactacaaatttgtagtaatctcatcactgttttattttaaaacttttccttgaactactactggccacaaatcattgatttctttaactgggaaaatggaaacatcactattataagacaatgtcaaataaaaataataattcatctttttggaaacaacctatcttaaaatttagtaaagtgaattttttatcccactatgtttgatgaattttagatttcattgggatacttgtgcaattgtgttataatagtataaaatagggaaaagatgatgttttcacgtttcctacacaattcatttttagttctttgtttttcatgcatttctaacttgctgttataagatgaaatgaacacaccatctagaaatgcaagctgactttgcagcaggttctttatagggacagaactttggaagagtcaccgaattccatggtctgtcttcgttttggtcaggagaaaatttactatatcaaaaaattcagtgaaattaggctctgagaagaagaaatgtatcatttatcatcaattcattctgtaatttttttgaacttttattttgcattgaacatgtagtatgataagcaacatggatgacccatgaaaaggttttcattgagaaaaaacacctgacttagaaggagaggtgagggaagagggtatttaagagaggatttttaatagagtaatcccaccagacatagaaggtgttggtacaattaaaatgctggggtagcagggttgggggtaagagtagagaatcatagatacatagattttggatatagcatatgtatttttttaatttctattttgaaaaactattttcatactgtgatataacaactccatgactgatactttattttttctgtagttaattttctaaatgttgatagttttatgacatttctcgtagttacaattttgtcctctctggaaacctcaggaataatacggctttccttgatccttaaatatgatttttatttgcaagatacatgtcttcaaacacaaagaggaattggatatgcaaagaaaaaggagaggacagcaaaaatatataaagagagcagtacacatttagtttgcctagagtaaatcataaaaggtaagcagtcgtgaaaataaatatatatttatctatgcacttattgattgaatattcagtattattctatagatagaaataagtaaattatatgatatatagtaggtcacactcaaaagtttagagcctattcaggaagtgatgagaaacaatttaaatgaaatgataaaacggtacttaggcttttgaagattgctgtgatatagtatgatggatggaagattgagaaagaaaggaatgacaagaagccattggagaaatctagataattaacaatgagagcttaaagaaagacagtggccaaaggcatggtaaaaagacaattgttccaagatattatttgggaaagtaaaattgacagattttttaaccaattaagtaagaaattttattttaaagaatgagagataccaaagaactgatgctaggattttagctttggtctctgggtgtttggtgcaatttatcaaagtaagaaatataaggggtaagggttttatggaaaaaaaataatgtattccatttaaacatgcagagttttaaaaagctttgcaatagccaagtgaagatatctaattaacaagtaggattgagtctagggagggaaattcttagcaattacagcaagactcatagcaccaaatgtttcagagaggccaagtgtgataacctgaaaagtacttatttaattttgccaggcgtggtggctcacacctgtaatcccatcactttgggaggccgagggttggggggtggatcacttgagttcaggagttcgagaccatcctggtcaacatggtgaaacccccatctctactaaaactacccaaaattttcaggcatgatggtgtgcacctgtagccccagctacttgggaggccaagacacgagaatcacttgaacccgggaggtgaagcttgcagtgagcccagatagtgccactgcactccagcctgagtgaccaagctagactctgtcaaaaaaaagaaaagaaaaagaaagaaggaaggaaggaaggaaagaaagaaggaaggcaggaaggcaggaaggaaggaagggagggagggagagggagggagggaaagagagaaagagaaagaaagaaggagaaagaaagaaagaaaggaaagaaaaaagaaagaaagaaagaaaaagaaagaaaagaaagaatgaaagaaacttatttaatttttatacagggagtggtgatgaatttagaaaaatcagttttaatgaagtgattagataaaagtcagactgcaggactttaaaagtcgatgggacataaaatatagagaaagtcactgcattctattattttaagaatgttgtctgagaagaaaatgagagatataaaacagatagaggacaacgtaaattcagttaacactttcaaaggatggcataaattaagcatttttaaatgctgtgagaatgctagggagaaaaaagagatgttgaatatattgtttaaaaaagagaagctgacaaaataaagccactaagggttcaagatgtcatggaattccttttttaaaattcatacattagccttgaacacatggcatcattctgtgtttaatgagtctgaggagagaagataagtttagacaccagtttgccagaaaagggggaagtactttcagggaaagtgggaaattaacagagcttttacttgatgacctgtattttctctataaattaagaggggattgttttctaaaaaggatagaaaattagcatggagggtacctttaaaaaagtggtgaagtttctaaataatggctgtgcaaatgaaaaagagggcttagtaggaacttaccatgtttcctgaaaaagattttctcattcattccttgaataattattatctatttctatcaggtattattgtaaactctggggaaagaataaagagcaagatggatatagtcaatgtttttataggaaggtgagaagataagtaatctttaaaatatatagagttctctgatttgctgtacaaggtcatcataaaggactctcctagggaagtgatatttgctagatatgagggacttgagtaagatgtgaagttggggagtggagagatggggaagaggaaggagtctttcacggataggaaatagcaaatgcaaagttcctgagtggaacagaaagaaaaaaaaaaagcttagcctgctcaaaaaccctgaaagagcaccaataagggtagaatgccgattgtcacaaaaatgatatgaaaatatgtggtagttgaattagaacctgcagaactttaaataatttattttaagaatttgagtttttatcctaggagtgattaaggaagagggaaagagagagaggagaggtcctaattggttttttaataaaatagaaacatagaattctggctgcaggggagcaaatgtgtaagaaatataccagaggggatggtgggagaaagtttagggagctactgaaataattctagtgaatgctgataagggtttagactacaatgtcagaattatagacagaaaggtacaatgattaatattagcatgcaaaattcacagtttttgtgattgtttgactatatggatgaaagaatgagaagatatcacaagcttccagccaaccaaacttaatggtgggtgttgccattcagtgagataggaaacactggtgacagaattatgaatttgttttgaacatgttgagttcgttgggtatttgatatctccaagtgaaaatttaatattgagtgaagagttggatatacagatctggaactcagatcaaatagtagtacatataattgatccaaggcaagcttgggttcatgccagaagaatatacaaagagcagataacatagtccttaactgaggttagaaaccacgaacttgtagcagtgcaaatttacaatgtttaaattatttttacagttcccagtagtccatattttaaatggatatgagtgctttgattgagaagatataggattatgattaggcaagtacaatgaaaggaagaaaccaaggcttctagagagtgatggtctttcatctgtaaagggggatgatgggctggccaaacacagattaatttaaaaagatgagcagaacatgaaaggaaataagtgcacagtaaaccaagaatttgttgccagataaaggaatactagaattaaaaattctgcagtaggaaactaggtgatccagaaagtggccagatgagtggttagccaaattgctgtgaaattaagaaaggtttttaaatgatcaaatcatagctaaaatttaatattaaagagaaaaatatacaaatctggagctatgaatttggaagtcattgctgtataattatagatgtatagatgtctctttcatttggatactggaatttcccagggtcattatgggacttggtatggaggataaaattatgaacctgatagcaaaattggtcaagaaaattggaagattcaccagtggatgggaacagatgagtggatgacagcatgagccaccaaggagaggatgaatataaaatactgatggagcttaggttactgattcaatccagggcacttccttcatgatgtcaaagtagctgggattattaatcactaattataggaacacagattcaaagtaagaagatatataaatagatagggtgtattttatcaagcctgcatttgcctggtgagctgtctatacccttccagatcttgtacagtgcaaatgaggaatcctttgaatccacgggatcgatgttgctctttgttacagttctgaattaacatgcaaggttattattcttttgagttcccctttcatttatgccattttgacagtgccatatatgttaatatagtatattccctgagtagacagatgtccaattttattctttcttaattacaatcacaattctattgtgccaccctagggtgatataaaagtcacctggattcaagtccagttgtgaaaggcctcattcaccaacttagagattatccttcagaactgtgtaatttttagtttctcttcaagtctgcacatcaggcttacctgggaaactttctaaaattaaattccctaagtttaatatttatgctacctctagagattctgatacataggtctaagtttgactcatagaatctatgatatttatagctctttggaacagaaagttttgaaaactattggttcaaaatcggttcataaaaggtataattttaaattgtgtttcagtggtttttaattttatcacagagttcaggtgtccatgaaattttatggatacctcgttctgacccctatctataacctataactggtcctctagttaggatttgtgatggaatttatcactttgtaaaattattcagtgtgagaaaactgaaaagttatttgaaaacaataggcttaaagcaatgctatgtattattttctgtttatcactcctctccatcttaacccattgtggaaaggaaattccccttcctcttcaaggagggaggaggttgttcatgtttagtgaacaactatagaaaacagagatagtatcctcctccttaacagagaccaggttgactgctcagtttaataaagatgatgctttactctagagaaaatggcaaatgagtgccacgttttcttgctgtccattataaatactaggatttctaactcccagggttcttaagctgtgaagaaaactgactacgtgtacctgcaaccacctggcccattccccattttccccatgggacttgggccataaggggaaccaattcaaactgatgctcctgctagttgcaatagagtaataaatccttttttctctaatccaataaccccatgtcttctgccagcatctatgaaactgtggaagatcagcttaacttgcaagcagggtaaaatctgactattcaaagttcttgacacgtctataaataaaaattaagaaaacctacctcatagaattgctgtgactacaataatattgctgtgagcgtaattaataaatgtaaagtgtttagaataatgcctattatatatggaataatctcaaaaaacttatctattagtattaccagtattcataactgagaaatatatccactgtctgcatcactcacagatacagatccatggcatagacaatagtcacagtaaaacttcatacctttaagaattcatccctacattaaagtctttgtcacactaagttagaggcaaactcaaatgactcctgggatcaggtaagtgagtggaaactgtgccaaagtggagagcaaagattacttcagaagggggtggcccaaagcattttctgctgattattactatgtagaaaaaattgcggacccagtgttgccaaattaccagattttaaaaaggaattcgtaatatcacaataggacttttttaaaggttaaatatactttcataggtacttggagccaatggctccaaataaagtctgggccacatgcagaccatggatcctttgctctattaagaaagataaggagtattgatattcttttataactctaccactgagaaaggaagatagtggttgctgcatgagggattgatggaggagaatgatcttgttaaaaacaaaacaaaacaaaaaacgaagagtttccttatacctttattttttaatgccaaagtaaataacattccagttacaatagcataagagttacacattgttatctttgaggtacttgtgtttagtcaccgcaaacactaaaatctgagattaatggcatcattggaagggatttggtgcaatctaatgttaaaaccctgaactatcacaggatagtagctcatgtcaggttcaacacatgtcactatgtctttgtcaaaattttaaaagatcctgtcatttttgtgaggttactgtgatgccgtggggtgcctcagctcacagtgagggcgccaaactctgacaccatgctgtattcctgtgtgcacagaacatagcatgacaggatgaatattacgcctcatcaagaattaaatatttaacatttcccgggcttttagtctttacattaattttgtcctattcataggttggatctagtccaatgcttagcaaaatgataataaatatagaagaaaaattatccctgctgctggctatttctgcaaagccacttaacttttcttcctgattccatttttatttcttctctcctactctccatagcagcatgtggaatgcataaaatgcaaatccaagcaaaacctatcaatgtcttgtgaccacctttggactgaagttcagtggtaacttcctacctgggcattctgtgccacacaggaattgccctttactgaccatgctatatacaccagctttcctggctcttgatctacagaaggcctttcagtttctccctaaagcccctctcatatctgggccacatgctttaccatgctggaacgttcttttccctctctcttgttaattcccagaaaaagcaagagtcatgtcttgctccatttattgttactgcttttcccagcaccacactcagaagagcacctgctgtacttgtagatataagactctggaggcagttataagtggttttctacttgtggctctgcttttaatacattatgaataatgcttagttcagtacctaatgttaagttcagtaaaaaatcatgtaatctccaggaattattttatttattttgttttttaaataattttgtggccgggcgtggtggctcatgcctgtaatcccaacatcttgggaggcctcggcaggtggatcactaaggttaggagtttgagaccagcctggccaaaatggtgaaaccccattcctattaaaaatacaaaagttagcagagagtggtgacaggcgcctgtaatctcagctactcaggaggctgaggcaggagaattgctggaacccaggaggcagagattgccgtgagccgagatcacaccattccactttagcctgagcaacaacagcgagactccgtctcatataaaaaaaaaaaaaaagtgagcatataataggtgtatatatttatgtggtgtatgagatattttgatacaggcatgcaatgtgaaataagcatatcatggggaatggggtatccattccctcaagcatttatcttttaagttacaaactattcaattatacactttattttaaactgtacagttactattgactatagtcacactattgtgctgtcaaatagtaggtctttgtgctgtcaaatggtaggtcttattctttctaacaattttttgtacccattaactaccctcacctcccccgcaaccccccgacaggacccttcccagcctctggtagccatccttctactctctatctccatgagttcaattgttttgatttttagattcaacaaataagtgagaacatgcagtgtttatctttcgtgcctggcttatttcactgaacataatgatctccagttccatccatgttgttgcaaatgactggatctcattagtttttatggctgaatggtactccattgtgtatatgtaccacattttttaatccattcatctgttgatggacattgaggttgcttccaaatcttagctattgtaaacagtgctacaacaaacaaaggaccaggaattattttactacccaatttttgctaatttttataagcagtattttttggaaaatgaccacattttcaaggaattaatatgggatgttcctctcttgaaatgtagtctagagctttaacagaaaggtgtcatccttgatgacagaatagtcaacatgatggcaggatctgggcagagagagtttagaagtacatatgtcttggtattacatgggcaatcccttctccaccaacagataagctgtgtgtgacctgctgaatgtgtggagcagcactcaacctgttgaaggctttgatttctctctgtgctagagggtaataaatgaaaagaagatgagactttgaaacctctaaggcaggcttgtctttagtctgaattttcttttttctattaggaataagctgccacatgtaacaagtgaggactccctagagcttcagatacccttgcctgggaactactttgacctccttagagacatgagtagggtgttttgaggaccattctgctccacaaattccttttgtggcatctttctagagcactgggtcttactaatttaagtatattggctgggcgtggtggctcacacctgtaattcctgcactttgggaggctgaggtgggcagatcacctgaggtcaggagttcgagacaagcctggccaacatggtgaaaccccatctctacttaaaatacaaaaattagctaggcatggtgacggatacctgtaatcccagctactcgggaggctgaggcaagagaattgcttgaacccggagatggaagttgcagtgggccgagatcacgccattgcactccagcctgggtgacagagtgagactccatctcaaaaaataaaaaataaaaattaattaattaattaacaaacctattgactattgacttttctcccacccccaccccctcaccattatctctctaccacaatctccattctcccgaaattcttatgtcctggtaactgcccaggaacaggatggtctttactatattccagatttcagcaatttaatcacgtttatgtaaagtatgcctctattcaaagcagatttgataaggcttattaaaatacatatagtaaaaatgattataacaataatggtgattaaaaaaacagcagccagtgaagatgtacttggacagagaaaagaaggaaagaagaaacaatatgacactggggaaaatgttaataggttgcttttagcacattctaataatctgtgcactgattgtcatgaaacatataaactgaactttccagcagccaaggtaaataaataaatatagaatttcacgtggggatggaggagcttgccaggttgttctattgcaatagcctgtgaggtactaggtttacctctttttgcctaattcacagtaatcttttgctaagcaaatgccatttaaaagacatgaggactttcttgaaagggcaaataaaagaggatttggcagatattaaagtgctgtggctggtgattggacctctccagcttacacaccctaaagagtgcaatactatcaagaccaaggaaatgtttacattactatggagtttctggcttctctacgactttcagttttaatgtcctgttcagtaagtgtggaaaaaaataatgaaaggccatggcatttttataacaaaccataaagatggtatttttatcttaaatttcagatgagcaatgtcttgttcttcgttttattgaacatttgcaaattaatctcaaacagatcaaaatacagctaagaggaaaattttttaagtatagcttagaatttgaaagcaaattttcctaacatggctaaccagttcataatttgggagttctagattcatgatgtcatgaaattccagctaaccacagcattctcaaatatcaagtgtaagctaatttgacatgtgaaaatcaatttttttttccaaagttgagggttattctaaaggatagtattgcaaaatgtaaaactgaatatcttttctagtcaaggaaaatcttactttgtagactgggaatgaaagacacgtgcagcctgtttattccttcatacctgtagcataaaatacactggctgctgtctttagcagttacataaccaaacaaaagaaaaataggacaccaaatctttaggtcatctatatagcacattgactattataaccatctgattgaaaagtgtgaaaaaatataagtcagtttagaatcattctaaattatgtaatttgaaaaaatgaaatttgaactcttatcaaaacattttatgtgcattttattttgtttatttgcataaataaaaacaccaaaaatttttgatgcgtaattcaatgctgagatgatgtagaggaaggcaatacgtaatctatgcaaactgaaatgacaatttcaaaggatagcagaaaatccagtcaccaaagaggatttagagggctaaattttaatttggaatcttgacctgtgctaattaaaaggcaaaatgaactattgaatgcttttttctagttcaaaaactatttggttatgtatttgacacagatgaattttttataatttcattaataaggttatcttctctcaaattattgagaaatatgcttttaaaatgctattaattttgacgattttttccagttttcaattatatggattatcatctataaaagttaaattaacaagtatcttctcaatgcatttgatgtaaaatgttctttcttttccccaaatgttctctttttctatgagaaaataaaattattataacgatgcagggtatttggcagtgtagctctcgctgaaaataaacactaaatagtattgactgcatactgaaggctgaagagattgaaacttacaagtttaataaatccagacttggtgttatagtgtgtgtgtgtgtgtataaatatatatatatgtgtatatagatatatatatagatatatatatataggtatatatataggtatatatatgaatatatgtatgaatatatatgtgtatgtgtgtgtatatatatatatacatatatatattctttccagtatttaaacaatcaaaagcaaaatggtatatacgtacctacaatgatgacattacctatttgcatgaattgtaaaaaatatttgtttctctggaacctgatcctcaattatttcagaaatttaagggaggaaaatctgtttggaaggctttggaaaatttatttcattgttttttactattattttaggaagaagatcacttatttttggagtgccagcaccctctacttcagataggatacttttaaatgaagcgatgaaatcgtattttgttaaaacttgaaacaatagttatataacatattttgtaggttttactatgctttgccatttttatcttatgaactagttgacaatgtaactatctaatgacataaactgatacttctttctcaaaacataaaagcttctttctcccccatgggctgttaaaaattattatttttttatggtcacattaggattgtgtaactagtttctaatgggatttcatgtgtatattcttgaacttttaaaaattattttttaattgacaaataatatatattttaatttatttaaaaattgtgtatatacaacatgatgttttgaagtatatatacattgagaaatggctatatctatctaataacaaatgcattatgtcatatgattattttgggggtaacacaacacaattttcgatatgttgtgtttaggtagtaccctaaatgacgccttttttacttgttgattgtcttggtgaaatttgctgttccttctaggcctacctggaaagtccgacattaactctgctctatttaatcttctaatcatttaatttaaagtaaatagcaatgacgaaataatatttcatattgatgacagtatgaattacaaagatagttatttgaaaccacatatgtaatattacatattggaaaaacatatagggaattacaatcctggacaggtcaaataatattcatctgagtaaactgaagaataacaaaaataaagtagatctgatagatgtacatacaattctgctcttcaaataaaaaatataactgttttttcccatgtaggagtaaacttgtttgtttgtttttaaatcaatattctgttgagtagtaaagaaataacaatcagtaaaagaaaatgtaaaagagttatgcacactattttgtctggcactaatttaataatcctataatgataatagaagaaaaaattttaatggcaatataatgaatatttaggaataacctcttgagacaaatatacaaaatcttcaattaaaaaatacctagaaataacagctaacctaacaaatatataagctctgtttaaaaccttatttaaaagaaaatttatgtgtcaaacattttcactggtgcaaataaatattgaaagaaagaaacaaatattaagaaaaaataatgaaaaatttaaaaataaatagaacataataaagataaaattagaaatcaaattgtaaagcagactttagaatttataaagtcagtaaaataatcaatagctctagaatcactagttaatccaactaagaaaagaaaaataaattattaatatgcacaaataatcaagaaattaattgccaataaggatgaaattaaaagaatagaaagaaaatgcattttataactctaggcatagatatctgaaaatctatatgaaataaatacacttctctaaaaatataagttataaaaagtatttattagaaaacagaaaaattacagataatgtggaaaatataccttttatcgtatatctactagttgtatcaaaatgtaaagaaactgatccattttaaaactgattccaggcatggagaagaagcaaagcttcccattagtttgtataatgtcgccacatcagtagcaaagtcttataaagacagcacagagaaagaaaattgcagatcaattttactgaaatattaatcaattttactgcaatattaatgcaaaaatcctaaatgaaatactagcaaataatatacaatcatatactaaaagaatcactaatctttaaaaagtaagttcattcacactaattcaaatttgtttaatattaagaaatccatctatataactaaccattttaatcagttcattgacttgtaattatgttcatcttaatagatattaagtagatatttgaaaattggaaaactccattcaagaaacaaaacaaaacctgtataagaatatgtataccaaaggccgttgccacaattagtggcaatacccttgcaatctacctattaaaattggtggaattggggcgataagaaaaaggagaagtaggaaaagagagatggagaagaagagaaggaagagtcagaaaaaggaagagcaatagtaacagggtcctaaattttagaagtccttgcacaattgggacagccaatgccaattgtattttacaagaggtgaatctgtcattctttcttgttggtataattgaaaatgagactgtccaagagaaatatgtaaaaaaagaaaaatgctagaaataggtagagattcagtaaggtggaaacgtacgaacataaatttaaaatgtaatagcttagaaaccataatgggaatataagtgatttaattgtaagaaaaaatatataaaaaaccttagagagaaataataatgttgtataaactttagaggaattcaagtatacaattaagtaattaattaagaagatacattttagtattggatactattaagaagattcattctagtgtttaatattttatgtgttataaaatattatcttatataaatatactcatatggaaatatttattatccttagtttgtgactccgtaagggacatagcaaccagcattctgttaaatacatatgctttccacataactataactcatattaaaataatatatacagctgccaaaatattttctattttaaagtaattggtgtatctcaatatgaaacatcttctcttttaagcatttatgtatgtatagttattttagtaaatcagtacaatgcatattataatagaataacatatatgaaaagatcctggtgtcatcttgtcaatatgctttgtttcaattctaattcatgctcttgttgctttattgtcttgttgtcatggtcacacacaataaattacaataaagttgggcttctcgcccgcccgcccctcgcccgcgcgccggccctgcagagccggccgacctggctctcctccgtgacccggaccagcgggcggactgccctgaggaggccgggagcggagggctgggccagccagcgggcgggcgaagatgccgaacttctgcgctgcccccaactgcacgcgaagcgcacgcagtccgacctggccttcttcaggttcccgcgggacccggccagatgccaggagtgggtggagaattgtaggagagctgacttagaagataaaacacctgatcggctgggcgcgttgactcacgcctgtaatcccagcactttgggaggccgaggaggtcagcagatcgagaccatcctggctaacacggtgaaaccccgtctctactaaaaatacaaaaattagccgggagcggtggcgggcgcctgtagtcccagctactcgggaggctgaggcaggagaatggcgtgaacccgggaggcggagcttgcagtgagccgagatcgcgccactgcactccagcctgggcgacagcgagactccatctcaaaaacaaaaacaaaaacctgatcagctaaataaacattatcgattatgtgccaaacatgagacctctatgatctgtagaactagtccttataggacagttcttcgagataatgcaataccaacaatatttgatcttacagtcatttgaacaaaccacgtaagtagacacagaaaacgaataaaagaactgagtgaagacgaaatcaggactgaaacagaaaaacattgatgaaacttctgagcaggaacaaaaacataaaccaacaatagcaatgctcagaaccccagtgaagaagagggtgaagggcaagatgaggacattttacctctatcccttgaagagaaggaaaacaaagaatacctaaaatctctatttgaattattgattctgatgggaaagcaaaatatacctctggatggacaggaggccgaagaaatcccagaaggtctctttaccctagataactttcaagcactgctggagtgccagataaattctggtgaagaggttctgagaaagcgctttgagacaacagcagttaacacgttgttttcttcaaaaacacagcagaggcagatggtagagatctgtgagagctgtattcgagaagaaactctcagggaagagagagaatcacacttcttttccattatcactgacgatgtagtggacatagcaggggaagagcacctaactgtgttggtggggtttgttgatgaatctcatagcctaagagaggaatttataggttttctgccttatgaagctgatgcagaaattttggctgtgaaatttcacactatgataactgagaagtggggattaaatatgaagcattgtcgtggtcaggcttacattgtgtctagtggattttcttccaaaatgaaagttgttgcttctagacttttagaaaaatatccccaagctatctacacactctgaacttcctgtgccttaaatatgtggttggcaaaatcagtacctgttatgggagtatctgttgcattaggaacaattgaagaagtttgttcttttttcccttgatcacaactgcttttagaacttgacgatgtaatttctgttctttttcacaacggttaagaaaggggtaaagaactgaaggaaatctgccattttcagtggacacgcaggcatgatgcttttgaaattttggtggaactcctgcaagcacttgttttaggttcagatggtataaatagtgacacaaatattagatggagtaactgtgtagctggcagagcatttatactctgcagtgcagtaacagattttgatttcattgttactattgttgttcttaaaaatgtcctatcttttacaagagcctttggggaaaatctccaggggcaaacctctgatgtcttatttgcagctggtagcttgactgtagtactgcatttactcaacgaagtgatggaaaatattgaagtttatcatgaattttggtttgaggaagccacaaatttggtaaccaaacttgatattcaaatgaaactccctggaaaataccacagtgttcaccaaggtaacttggaatctcagctagcctctgagagttactataaagaaacactaagtgtcccaacagtggagcacattattcaggaacttaaagatatattcttagaacagcacctcaaagctcttaaatgcttatctctggtaccctcagtcatgggacaactcaaattcaatacaccggaggaacaccatgctgacatgtgtagaagtgacttacccaatactgacacgctctcagccaagcttcactgttggagaatcaaatagaaacacaggaggaaagatatagagcttccatccaccatctatgaagccctccacctgcctgacatcaagttttttcctaatgtgtatgcattgatgaaggtcctgtgtattcttcctgtgatgacggttgagaatgagtggtatgaaaatggacgaaagcgtcttaaagcatatttaaggaacactttgacagaccaaagttcgagtaacttggctttgcttaacataaattgtgacataaaacacaacctggatttaatggcggacacacacgttaaaccctatacaagtaagtcagagcttcccacagataattccaaaaccatcgaaaatacctaggagagttttaaaaataggccttcttatatttgatattttaaagaaaagccatatggtgtatgtaaacctcttaatcactaaatgtctttgcctatagaactccattgaatacattagccattgataatgtacctgtttaaatggcccctgtttgaactctcaggctttgaaaacctacctgttcttccagaagagaacattgaaagtgccatgtttccttctgcgtgtactctgctgatggcactctggaattgttttagttaggtcattttagacatagcatttattatcactgtggatctctacttgttgggtgttacaaattctttgaagaagtatgttttgaagaggtgcgggaggaaggaatacattttataaaatgttatagtgacacccacagttgacctttgactaataggagttttaagtatgttaaaaatctctcctggacagttacaagaaattaccggagaaaagcttgtgagctcgccaaacaaggatttcagtgcagattttgtctttctctaacttaaaggagcaaatgacagttaaaatttgaatggaagagcctggcgttgttctacatctcattgttgctgtttacattcctttgtggagcctacatcttcctaagctttttagccggtatatgttgaacacttctgtttcatggttaagacggaatcagaggccatgggtactgacaactgacttgtctgttttctttctgtctttttccatgactcttacctactgcctcatcttgatttataagcaaaacctggaaaacctacaaaaataaggattgtggtttatctagaaaactatggaaaacattgctgttatttttgatgaagaaaatccattttgtatagtttatttcaatcaaaacaaaatgtgaattttgtttaaaaatggaaaaaagaaacttaatcattttattcactaaaggaaaataatttacgagcttctagaaattttactatcatgtaattaactcatgtcagtcttttgatacactatttttttagtacattctaatactatagtggtaaagtacataaatggaaatttatgtatattagggtgaaacaagtaaacagagggaaataatatataaaacatgttatatagctactacttgggaatgtatgcaaacatctacctatatctttttatatttaattactaataagcatcttgcatatgataaactgttagaattatttcttgtaccaatctatctcttaaaagttttctagataagagaataagagaaaattgtgcaacatattttctaactttgctgaaattattttgagttaaaggttaatgacatgtaaggaaaaaattatgatgaaataagaggaaaatataattaaatgatagtaatgtgctaccagttgtttaacttccacctcttttttcctttaggaaaaagctagcacaaattttgttaatcacaggccaacacattatccttctctgcggaagtttcaaaggtgcggggaggtggaaaacttaagttgaccctttcattgcctctgaaagtaatttctataatcttaacctcctgaattcagtctctggcattttatgataatgttaacacttagggaaatcatgttttattcatatttaatgatgattaatatgtcgctgctatataatcaagataaaatagactagtttccaaaagtgttcttttttataacaaagaaaacagaaattactaaggattcaatgaggggtttaaaacaactttaaattcaacaaaagaattattttaaaactttcactgatttttttaaaaatctgaactttgagaatacttagaaaaacaaaatttcatttgtttcaaaagaagaaaatcaatccaatagaaaaatacaataatcattttctaaccactgtatatcaaacagttgtgcttattgctttaagcttttacagacccatttctgtgccatcaagctaatatgggttcatactactctggacaagctggaaaaaaaatgtgtgtatatatatgtgtgtgtgtgtgtgtatatatatatatatatatatatataatttacactatatagatatgaggcaatatgttacaataacataagtatgggacaatctggaaaatatatccctttgagtcctcaagagttctatgatttggtcaaatagatgttattcctaagctcctagacatgttttactaattatttacacaagagctcaaaattatttgatttctgaagaaaaattataaaatatttttacttgatcataaaataatttagcaagtactgttaggaagaaaagtattttttggctggtcatggtggcacatgcctgtaatccagcattttgggaggccaagacccgcagatcgcttgagccaggagttggagagcagactgggaaacttgaggaatcccgcctctacaaaaactgcaaaaattagccgggcacagtagcatacacgtgtagtctcagctcttcaggaagctgaggtaggaaagtcacttaaacccagaagcagaggctgcagtaagccgagactgtgccactgcactccagcttgggcgacaccaggagaccctgtctccaaaaaaaaaaaaagaaagaaaaagaagaagaaagggatttcttttgtgtgctaaattgcaattggcttaggaaaaattatgttatgtgtacccttaaaaacttttttcttttttttttataaagtcttttatttattttattttatttttattatttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttataatcctttgggtatatacccagtaatgggatggctgggtcaaatggtatttccagttctagatccctgaggaatcgccacactgacttccacaatggtttaactagtttacagtcccaccaacagtgtaaaagtgttcatatttctccacatcctctctagcacctgttgtttcctgactttttaatgattgccattctaactggtgtgagatggcattgcattgcggttttgatttgcatttcttgatggccagtgatggtgagcattttttcatgtgttttttggctgcataaatgtcttcttttgagaagtgtctgttcatgtccttcgcccactttttgatggggttgtttggtttattcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcacatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgaggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaaggcattggtagcttgatggggatggcattgaatctgtaaattatcttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagtttactcatgatttggctctctgtttgtctgttgttggtgtataagaaagcttgtgatttttgtacattgattttgtatcctgagattttgctgaagttgcttatcagcttaaggagattttgggctgagacaatggggttttctagatatacaatcatgtcgtctgcaaacagggacaatttgacttcctcttctcctaattgaataccctttatttccttctcctgcctaattgccctggccaaaattgacaccctaacatcacaattaaaagaactagaaaagcaagagcaaacacattcaaaagctagcagaaggcaagaaataactaaaatcagaacagaactgaaggaaatagagacacaaaaaacccttcaaaaaattaatccaggagctggttttttgaaaggatcaacaaaattgatggaccgctagcaagactaataaagaaaaaaagagagaagaatcaaatagatgcaataaaaaatgataaaggggatgtcaccaccgatcccacagaaatacaaactaccatcagagaatactacaaacacctctaggcaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaagagtccaggaccagaaggattcacagccgaattctaccagaggtacaaggaggaactggtaccattccttctgaaactactccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccattatcaagtgggcttcatccctgggatgcaaggctggttcaatatacgcaaatcaataaatgtaatccagcatataaacagagccaaagacaaaagccacatgattatttcaatagatgcagaaaaagcctttgacaaaattcaacaactcttcatgctaaaatctctcaataaattaggtattgatgggacgtatttcaaaataataagagctatctatgacaaacccacagccaatatcatactgaatgggcaaaaactggaagcattccctttgaaaactggcacaagacagggatgccttctctcaccactcctattcaacatagtgttggaagttctggccagggcaaaaactttttttcttttgagacagagtcttattctgtcacccaggtcacacaggctggagtgcggtgacgagatctcggctcactgcaacctccgcctcccaggtttaagtgattctcatgcctcagcctcctaagtagctggaattacaggcatccaccaccacgcccagctaatttttgtatttttagtagagatgaggttttgccatgttggccaggctggtctcgaactcctgacctcaagtgatttgcctgcctcagcctcccaaagtgctgggatttcaagtgtgagtcaccgcacctggccaaaactgcttttttgtatccatccacttcaattcccctttcaaaccctttaatgccatttaattatgttgcttcccggaggaatatatttccttctgtcctatatcagtgatgtaccttagcttaagatagaaattcattagtgtagacatggcttaagtagtctctaataataatttttaacagattatctcatcatttctcatatctacaaaaagtctgtgaaaaatatctttattggatcaataaagatcccatttagcttaatgtatggtttcaagtaaatgatgtgctactcactgtaaaaatttctcacttaaaaatattggattattctttctgttaagtttattgtcctccaggctcatccatgttggagcaaatggcaagatcctattctttgtgagggttaaataatatttgattgcatatatgtaccacaaaatgatctcacttctatgtggagttttaaaaagtattcaactatacaaagatagagaacaaaacagcagttatcagtggcaggggatagggaaagaaatggaaagatataagtcaagagataaagtagcagatatacaggaagagcaagtctagagatctaatacacaacatgagaactataggcaatatacctgtaatgtatatgggattcatgctaaatgagtagattttagctgcttttgccacacactcaaaaaaaggtaactgaaataatgcaaagtgttcatttgctcacagtactatctatatgcatttttactgtctatatgcaccttataatatcatgttgtataccttaattatacaaaatataatttttatgaaaatatattggattatttttgagagaatgaatctttacaaatacacataattgtcattttagctttttaattataaatacacatacacacaagcatgcacttagagaatgttctcattttctgaactacagatggttctttagtaaatgtaacctaggtgattcaataataacatgattttaaataactataagcctcagttattccttgttctcatttaattcagtttccatgtctcccaccattagcctttgtaatagtttaatagtgcattctatctctctccttctctttcaaacttattttgtaatgactcaaactttagaggacttcttgagaatggatcaatgtctgaaaaacttgacaattagatagcattaacattgacacaaaagcttaaacttgtttgtaatattcaattattttgtctttttatcattataaccttgcttttgtcaaaactgtaaatgatgacctgtttctacagtttgagtaaaaactgatacctttaaaaatatgcataatagccattttagcttttttattataaatacacatacacacacatgcacttagagagcgtcctcattttctgaactacaaatagttatttagcaaatttaacctaggttattcaataataatatgatttaaaataacttcaggcctcagttattccttgccctcatttaattcagcttccatgtcattttggcttacttttcacagaaaatatgcatatgcataaacgtttgcagaatcaaacataatatggacattctattgctacttttttagtaacactaaaacatccatatataggcatcttttcatatacctgcccactgagtctatacttcaaaaaataaaatatatagcaaaaaaaagaaaattatttctctggttgagatcttcagggttctagcattttttacttcattttacccagtcccccttttcccagtttgtgtggcatggcaaatagtataaaaagggaggaaaaagcaaatatcaaaaatgcaatgtgctacacacattgaaaacaatactagcagatattgagaaaattttttctttcaaattccaatacgtataaacaaatgtaacacaagtaagtttgtacacactgccctgtaaattacattacttatcctctggtcagttctcttacagattctcaccttagaaaaattcacaattcaaaaacagttctccagaatgaggttttttgtttgtttgtttgtttgttttgttttgttttgttttgtttttttgagacagagttttgctcttgttgcccatggctcactgcaacctccacctcccgggttcaagcaattttcctgtcttggcctcctgagtgcctgggattccaggcatgcaccaccacacccagctaattttgtatttttagtagagacggggtttctccatgttggtgaggttggtctcaaactcctgacctcaggtgatctgcccgcctcggcctcccaaagtcctgggattacaggtgtgagccgccacacccagcctagctcttttttaacctttgggagaaggatacgtctttgccttactcttaaaacaaatgcaacacctatcttccatggctgtggttcttttgaagttctatttctcactgcagatgacactgtttacctggaaatagcttctttttagactgccaactctgtcttaacttcagccccaatcttcacttcatcactctgacatggatcagtattaagaaaaattctgaagaattcaaggtttgatttagctccttgtttctatttcccactgaatcttgaattactggaagtaaatttattaagcactttcacattctgtccatgctcccatttcaatcaaaatttacgttgactttccccattcacccagagttctatttcaagcttgccaaagaaatatttacaatttgatcaactgaatcgcattaatatgcaaatatgacagtgttcaccttaagatcttccttcccccaaatagcttcagtgagatgtagccattggaaagcaatgcctcctttacattgcctatttgaccccaccatagtaggctgacccctttaacaggcctaagccatattacacaagttctgacctacctttcattggcaagggacagatcaggtatctaattttatcatttcaatgtatgcatattcatattctgaaacttataattttttacttgttctcacttagagcacaagtaagcgagaatctctattgctgagttatacattagaattttcaaagcgagcagtaaataaaatgaaagacaattgtatttctaccaagagatactttatggagtattaacatatcacatcttcaggtacaagttgaaattatctcaggcctgaggtctgctcaaattagtatgttgttagtaatttggagcaattatatatgtaatgctctgccattaatacattgaatccacaattatgcatgttctgtaaatgatacatctataaaaacaataaaaacaaatttggctttaccagataccagcaaaacttttatcacattgtgggcctttggaaatatttctgccatcaagcatatttaagatgatttccaaggtcttgcaaaattgactacatatgttgaagaccgaataaaaatgaaggatgctctattagtgtcagttttcttaatagtagtatagattattaagctccactaggatcttacacatgtatctttacattattattattattataatatatattttttctttcttgagacagagtctcactctgtcgccctggagtgcagtggtgcaatcttggctcattgcaccttccacctcccaggctcaagcgattctcatgccttggccttctgagtagctgggattacaggcatgcaccactatgcctgactagttgtttttttttgttttgttttgttttggagacggagtctctctctgtcgcccaggccagagtgtagtggcatgatctcagctcaccgaaacctctgtctcctgagttcaagtgattctcctgcctcagcctcctgagtagctgggactacaggcgcccgccaccacgccagcctaattttttgtagttttagtagagccagggtttcaccatgttggccaggctggtctcaaactcctgacctgaggtgatctgcccgcctcggcctcccaaagtgcagggattacaggcatgagcaactgtgcgcagcccattatttggcaaaatagttttttgaaaatactcttttgttataaggctatgaacaaagtaaatatcttctaaggacttttttttttgttaattccaagcttgtagtcacatacagtttaaagtgttcttatttttttaaatctttatacaaatgattattccatgtctttcattcacatcttcatctggcagacacttccttcgttggtgaagttaagataaaataaatttttattacacttggcagaccttgggataaggtggcgtatagtgagataagctgcttattaggagaaggtaggcagatattagattataaattcatagagtaatttattatgtaaatttaaaaattaaatgtaacaaatatgacttttattgcacaatcattttacaataagtatttgtttattcctctgaaatttattttatcttaactttgtaataatctggaactaaacatcaggagtacagaaaaaaatacttacttgttcctgaggaatttaaaggctaataatagaaggaagagtcaatttaaacaggtgaaagtaatataatgtggctcaaaggaatcttgaaaatgttttacagcagtccaaaagagaataattggctctctttgaataatatgcttaagcttattatttatatgcttatatgaaaataaatatattaatactgataaataagaacagctatattaatttaatgtttattgtgtactagggaatgtgctgttttgcacagttttaagttgggggatgctcttcattgtgtggaattagaaacagttttcaagaagttagataatagtttcaaagtctcacaacttgggaaaaatgcgattcaaattcaggtattttgttacatttaactgtgtttaaatttaaaacatggaaagatggtactaggggagaactctgttgtggagagagtgtcagtgtgagtcaggaaactcgaagttttagccccaactatgccattttttttttggtttttttttggccttatgactttaagtcacaatttacactgagtttgataaattagatataattatactcacatcctgtatcatggattttttgtagcattggtagatgaaaccatgtttaagcaagaaagcactatagaaattaaggtattttacaactccagctaatatcactctccaatgattttgtttgttttcaatttactggtcatactatgctttgttaaatgctactatcaggtatgtctttctctaccttgccaactgacgcctattcatccttcaaaacctcatgaacttttaagatcctctgaaatgcctctttcattctcatgttgtatgtgctcattgtacttgatacaagaggagaattatagcacgtaaccactccgtgttggtgtgattgctcttggtctatcagatctgccactagactgtgagatgattactttatccccagttcctggaaaatactgaatacttcatgaattggtgtagacataaaaattaagatttcaaaataaaatatattggttcaaatatatgcattcttatggttaacttggttaggcaagaaccttgtattacagtctgtaaacagtgagaatgcctttcaaaaggagaaaatggactttgattattttcaaaaggatattagatttataatactcaagaaaaaaagacaattcagaaggaagaataaaattatttttgctctgaaaaaagagagaatgaattaacaattctagtaacagggttcatcatcatttatttttaagtttgctatttgaaaacttttttaacttaattgtttagtgtggattccctacctcatcccccaaaatttcatatttcactattctttccacagcattagtttatgctcttagattttcttggataactcagtatatatctctttctgttaaatttaaaacatatttattatcaacattgcataccgtatattggaaggcaaaagtattttcccattatgtaatgttatttataaaccaaactgaggaaaaccttcacagcctcagtagagaggagataatagtgtttttaaattcattctttctgcatattttatcataaatcattttaggacacacctttttaatgcacagatgctcttaattagatcagcattgtcatagaaactatgctctctttttgactattgccaacagcagcaaaacatccatttccttataattgattctcaagtttatttaaaacgttctatatgaggcatagcctattgaaatgactcaccatgtttatgggaatactggaggataagagttatttttgaatgattttatcatattaaatgtagaatagaaatataaactttgaaaaatatgtaataataatttttactatatggtttcaataacttttcaattttaaaagtattgctctttataacgatatgagtagttaaatccaaaaacaacactgggagagcctccatgaactaaatattggactgggctttagaaatatacaaataaatgaaaacttacctgttttctcaggaacatcccgaatcagatcagtaagtatctgtattgtcacattacttcacagaagttcaaaagatccaggatacaggtactctcttctaacttatttaagaacaatgagaacacatggacacaggaaggggaacatcacacaccggggcctgttgtggggtggggggaggggggagggatagtattaggaggtatacctaatgttaaatgatgagttaatgggtgcagcacaccaacatggcacatgtatacatatgtaactaacctgcacgttgtgcacgtgtaccctagaacttaaagtataataaataaataaaaaaaagaagtcaaaaaaaaaaaaaagaaaattctcatttcaccattcttcaggcaaagaaattgcaattcctattgcaaaggtaaattcatttatacacttaacaaatatttgggtttccagtaaatgaaaacacaaaaatgggttaaggggctattaattattttcaatgcttccactctaataaataacaatggctaacagttgctataaaatagtgttttaacataccaagaaccataaaaaaagtgtttgcaaaatgaatagatcatatgagagagtttcaaaaatgttttttcaaaaatgtttccccaaaatatattttcttcttttacactcctctcttttagagaaaatcttctctttgaagccagagcagtggattttacaacctgtatatttcacttctttctatcttttgtgcactaaattacctcctgttactttcaagtctgttaaacagattgaaaacaactgctttaaaggaaaggccatcacctttgaagcctgacatggctggattacaatcttcacttttattttctagatgagtgagccaattacataactttcttaatcctcagtattcacatctgtaaaatgaggtgataatacctggtttaccctggattaaattatgcagtgcacttatagcacctagtaaaatgtcccagcactttaatggctgcccttttatagcatgattttcaagtgggacattaaaaagggattaataaagtaattataagtacaattggactagatatggctggatagggatacaatgaattgtaagtgccatggtgaaaagcgtgagaaaagagccataaagtgaaatctccctgctctagtttgattggaaaagaaaagctgtgctttcaagtgagggaaataagcctggagggcatagtttggaacattcttgtgatgggccttaaatgccaggctgagaagtgacacttaccttgctgggcaattgaaagctattgaacattttcagacacaggagtaacatgatcataattgtcctttaagattaaaattgggttagcctatgaatgaaagagaatggagagaggctggaggctgagaggcaatttaggagatgattactcaagtcaaagttaataagaatctgtcttagactggggaaatatcagagaaaaataggaagttgatagtacatgaatgattagaaggatttaatagatcgttatttgtggggaacaaaaaaaaggaatggttttggggggaaaaggtgagaagtaggagagagtttgggttagaaaataacaggatttgggactccatatttaaacagtgatttgcatttttttttctgagtattttcgtgtcttttcctgggcctaggataataatatcaaggaaagatcattgtctcaatgtatcggagtgcataaaagctaagaagataagtgacttactcaccatccctcagctaataacagactttaaatttctggctcctacattacaactgtattcactactctgacttggatgttgacaggacagggaacacctcagagggaaatgcccagccttctcctgatatttaagactggtattttgaacttgggagaggtaaattgttatatgagtcatcaaaattgttatatgagtcatcaagatggaatccacagtcaaggataaaattgtcaaagggatgagtactaaaagagaagcagtttggtgtggagcccttgaggaacaggtgctttctgaaagcaagcagaggagaaacaaacacaaacaatttaatctgaatgatcaaaagtgatttcaagtaaggcagaaatgtgtaggttaaggaagggggatctttaaaaaagaaggaaattagtatagagaggtttaatgaatgaagcttgaaaaagaccacttgaatagaaaactcctgaagactttaaagagaatgtttttattatactaatgggagataaaagcaaaattaaggtcatattgtaatgaaatctagagacatagaatacttaccctgtgagttatagtaatatttatttgtattcgagtttctgttttaaggcaacagacatttgtatgatttttatgttataaagaaagaaacaatgtcactgttgaaatctcagaaacactaacaaaaataacaaatttcagtttttttctttttcccaaagaaatacctggaactcttaaggatatttatagacatgtaattcagtgtaaactctatttcatattgtaatatttatgatttattatacttttctgccaaataatttcatatttactcttccttaggatatatgtccatatcacagaatgtggtaattaaatatgaatgttaaattggtttactgattttcagatttgcccacacaagtgagcaagaattcagtgactgaaatcttgctttgtaagctcagaaactcaattttattacattgtctactgttggtaaaattgattatataaggtcaacgctataagggttgagaccatattttcttcaactgtgaatctagcacaaggtcttgtacatagcaagtgttcataaatgaattgataaataaagaaaggcatagaatgtatactaacttataatgtagtatacaaggtaataatttatttctaaaactactctttataaatttcaaatgccagttactttcatctgccaagttactcaataagagtaatttgtttaaaacattttcttctgtgtgtgttagtctgtttaggaattctgattaaaatttagaaagtaagcaagtatagtttaggtagatttggacgttctttgacttaataatttataaattttttcttagggtgggcttctcttgcattattggtatctgtatcattctaaagatgaataaacagacttaggaaggttcaatagcatggattaaattacataagtaatatgaaatgtagatttagaatgccaaatacatgattcccatgaggcattcatgcacttgccaaaaaatgccctggatgggtttaattacagataacaaatgaccaagatgaaaattgataaccagggtcatatcttgatatcagctaaattagaaccccaagacaagttctgtcattactgaaaattaaaatttcaaattataaacattaagatatgaaccatctgagcctgaatgtgattatctaggctttcaataaagcaagattatgtatttgccctgttcttagattttgtgcttgttttcatggtgttttcaaatttcaaccagtagtttcaaccacatgtttcaaaccttgattatatatgaacatactatactgatccttttacattaaaattaaagatgaacaaattgaatgtataatgtcagttaataaaactacataggtttatttttgtctttacagagtaaaattttagtcattcacttatttatccttatacaggtaccttccaaaagaatagctcatagatattttattttcggaatgaaaggcaattacattgcttgggaattacatgaagaaactagtgctttggatttcaaattttttaaaaaatatattcagtcagtgagatagtcaacaaagcgagagttagagtattggtgtacatgtcctctagggaatattgaataaaaattataagaaaaacaacttgaaaagatacccataattgaaaccaggaaaataattaattaccctaaattgtaacagagaactaattggggacaatttattaaatgagaaaggaagaaaattgtaatgatagtttgaaacctgagtggggaggatgttgacggatcaagagtaaattaattgaaacaatattaaccaagatatttttttcttctctatgtgtcaataaataatgatttttcctttactttttaaatttaatttataatttagggatggacactgatttaatacaccaattaaatgagcaacatatagactcttatcacagtatggtttaaatacactatactatacaaaaaaatctcaaattcctttcgtccaatttgagatatacaatgccttgtttttctgaataaaacttctggtaatttgtatgccagttatcaaacaggtacataaagtttaaaaacagcttttgtttcaaaggacatctgtgttatggctagaatagacatcgaacatttagtaaacaatgctataaaatataaactaggcctttaaaggataaagggttcttttgtgtcttaccaatttctgtaataaaatgtatcagaaagcaatagctaaaagaaaaccttttaatgcatttcagatgtgtcatatgtagttataacatatattaatgattttgaagaaattaaagtcaatgaattatataactatccttgtagtaaaagcataagatggaattgacttaactctatacttgtaaccatacttaatgcaggtttattattagataattcggatatgaccaaaaatgatattataatcagttattgttttagaactacactttgaaatgaagctcataggcaatcaattttacatttagaacttataatttgacagaattctaactgaggaattaaacctcctcaaatatttggtaaactatttgcatagttacctaaattttgtatgaaatagataatttttttcaaaattcctttaaaaccaaccctgcctttctcattctctacagatttcttttcttattttcctgaaaaggttgaagttctttgatgagagatttcttcatttcctttgtattttaagatcactctatagcaacctttatcaatctcttttcctttttcttatctttcattgaacaatcaaaacctttccccaaatttcctcttttggctccttctttccccacctcatgctgccatctaaacctttggataatttattttcactctcagttgctgtacaaacacgatcatcttctgtcactcctgaattcagtggttgaagacagacctacacaccactccacaggaccacctcactcatcacagtcaccaaagacatctgtggttctaaatttcatggtctttatcttacaatacttgacaaacttttctaataatgtagatatgtacacatgcatcacattactgttcctgttcagatgtaggttaaaaagtcctgttgtaagagaaaaacttttttgaatacttgattttgattgaaattttatatataagataccattatttcctctcaattgttggattatcagtggatgatccaggaagacatttcttcccccagcatcctctgtacagtaggtgggtatgcatacataggtgtggggagttttattttaactcagtaacatccttaaatagtcttgaattgttctacacttgtgttctgtgaaagaatactgctttagttttttccttccaatttttctggcctctcttttagtcttccttatgggcttctgatccacttcatttcaagtttatatatatgtatatatatatatatgagatagttatttgttttatatatatatatatataaacttgaagtggatcagaagcccataaagaaatatatatatatacacattaattatatatattatatactgcatatagtatatataatatacataattatatatatttatatactgatgataattatatatttatatataacaaatcccttaatttttcaagtgttttaaaaaacaattttatacttaaaccagccttgaagataagcacaaaatttaccagtctacattgtttttgaaaccatggcaactctagcacccactctgcgtatagcactattctaggtagaatactagggaatcctaaccttagaaacatgatttcactttctggaattgcattatttccgtttacagagattaaaaataattagaaccaccatgcttactacttacttactatctgccccagccccttctgattcaaaggaagtctcatttctgccaaattcttcttctcattttactacttcctggtgaatttcatctaatttagtcatttcaatgaggctctgatatggactgagaatgtgatattttgtgttcccataaaaatttatgtgttgaaagttcatttgctgtgatggtattagaaggtgaagcctttgggaactgattaggtcatgaaggtggtgccctcataatagaattagtgcttgtataaagggctaaatataagttctcaccttccacgacatgaggatacagtgaaaaaagtccatcttgtgaattaggaagtgagtcttcaccacacactaactctgtgagcaccttgttcttggactttgcagctcacagaaccgtgagaaataaatgtatgctatttataagccaccaaatttatgttatgctgttgtaacagactaaatggattaagacagcatccgtgtactgattacattaaacctctatgttgtagagaggtaaactcttaacttttaattctctagctttcagctgcagctttgtgtttttagtttcccaatggaaatctatgctattctatataaagaaatatttcacactcaatatgtcctaaatcaaactcatttatgctgccccaaactgattctacctcttgtattgtctctgaatgaatagtgacacctttcactctatctttattaatcagatactaaatttcttaatgtttgttctttaatatctggccaatcttttaccttctctccacccctacttctgctgctttgttgcaggctttatttgtctctcacctagatgacttcaaaagcctcctgaatgttctccctgcctcaaagtttattttcctctacatgtagtcttcatgttatagacagaatagtctttagattgcaattacaattatttgtattgtcatggagtaaaatccagacaataaaatctttagcatggcatacaaaatcatttgcaacatggcttctgtccattttctgtcacgtcagaaccacactttgtgttgttttctgagctccctgaactcttccccataggtcgtgatctctcttgaacctgagacttttcacatgtggctctctcagatattaatcatcttcattctccattttctacctctagtattctatttctccttttcaatatttagcttaaaatccaagaaatatttcttgatctttgtaggctgacctagatgtttgttctactgcttctgttcatcatctaatggtaattccttgtatattggtttgtgttctcaccttcagtgatcagttctgagatcacgtttttcacctcccaaataaagattaaaaaaactacctcacacaaatgttttaaataagaacgcatatatagtatactttgcacagtgtttgaaaaatattttttctaacattaggctcaggatctctgcttctggtggcatctcattaaggtttctctcaaattctgaccttttaataatcccatttatagctcttgatttccagctcttcataatgactgcttctttgctgttagtcccaaaatattttctgatttcttccattcccaaatgtctaagtcaacccagcaatcttcctaacttaccattctttgttagtagctcaagttgctttaataaaatatgatatactggtggcttaaacaacagacatttgtttctcacagtttcagaggctgaaaagtttaagatcaaggtgctggcagattcaattcttgctgagggtcatcttctggcttgcagaaggccattttcttttcaccatattctcgcatgacagagggagaaaactcttgtgtctcttctgtttctaaaagcataaattccatcatggatgatcgaccttcatgatctcattgcaacctaattgccttttaacaatctcaccttccaataccattgctttggatgttagggattcaatatatgaatttgggggaacacaaacattgattcataacacatctaatctgtgtcatgaccttaaaaaccttaatatattaagtctatgcccacaggagaacttatttgtcacacattcattttaacctccttgtaatatactttgcatccttacttctcatcctaggttctctgcagaatctattggttcttttgcagttaatgcctttaaccattcagtattatttaataacttttgcaggaacttgtattttgtaccattcttctgagttgtgtcctaggcatcttcctgggtttctttctaaggttgaccttcctactcccccttgctaaatctcttctgcttttctctcttcagtctgccccttaattccaaatatagtgaaaatggaaaatcatttcttttcctagactctctctctctccaaggtgttggactgaattatcacatgtccacctgaaggacctccaggactccaaatttggcatggctaaagttgatgtcaaattcttcctccaacaactagatccaatttataaattcccttactagtttggtgatcatagtcaagttactcagcctcccagtgcctctgtctcctcaactgtaaaatgggaattaaaaagtatctaatttcaaaggctgctgtgcaaattaaagaagtcactttatgtgatatatgtgaactggtaccctggaaatagaacagatggtgatggtggtatgtgcctgtttgttatttttagcattccttttttcttttaaagcttaacactttttatttgatcactggcttcaatatttagttctttttcacctcagtcttctttattttattatctgccaaaatcttagttctggtgcttttattctgcatttcatattctatttctattaatgctgttaacttgtctctttgcttttatcttctaatttttaaccaggacaagtctaacttatctattttatgtttcttatacattcaatacactgattttaagttgagtatacagttgctgtcttgctaatgtattgcttttgcatttttttgtataattaaataaatatttcttggtttccatttttttctaccaagtgttagtttcactgaaatcacctccttgcccccatacttgctacttttgttaagcacaaatgtgttactttaatgtcaacgcttaacataaaataagcacaagaagaaatgttggcaatacttattacagcctccattacacattggttgttatgtatatgtaatggaaaaaataataacagtttatccacatgtgccgtttaacacttcagagatgacagcagtgactttaagagaggggggcagggcaagcactaaactataatgaaaggagaatggaagtagaattatggacacattttcttgggaaaaagtaagttaccaaaaatatattgaataaggcattaaaagggctgtattttcattatattctgcaaaaaacacacctataacatatgagcacacctgaaaggctaggttttacatgaacaatcaattattataaagttcttaaacatttattttaagtatttattgttaatatttaagaaattgcattctttactgatacacctttaggcaaaaattaaagtagaatataccatataccagacatacacttccaaaaactattagaaaatattaacttagggctaagagttctgttaagttgtggattttttaattttaatttttattttactctaagttccagaatacatgggcagaacatgcaggtttgttgcataagtatacatgtgccatggcggtttgctgcacccatcacttaggttttaaaccctgcatacattaggtatttgtgctaatgatctccctccatttgcccccaaccccctgacaagctgtggtgtgtgatgttcctctccctgtgcctatgtgttctcattgttcacctcccacttatgagtgagaacatacagtgtttgactttctgttcctgttagtttgctgagaatgatagtttccagcttgctttccctcttgttgatacaaaaaaaaagttagttttagaaaaaacaacaacaaaaaacaaaaactacattgttttctcaacttcttaacatgtgttaaatccatgaagttagctatcagaaatttttagagaatgaagacaatcaagtgagcatggaactcagaaaataaagagctttgtttgcctcttagaagttattggagagaatccatgcccaaggagatatatagagtatttttctgcttgtctctgaagctcttgctgagtcagtgacccttagacatctgattcagaggctaccttaacctggctttttcagaccttgccctctaaactccaattaatcctcttgtttgctaactccttcgaaacatgtcctactttactatagcctgacttcaatatagttcctgcacctacttcccctcacaggcatgtgcatggccagcagtttggtgtccaaaccatcttctcaataataaattacttataattctacattctattacatttttcccctgatctagagtaagaaagtagaacaagatgggtgaaccctttatataagtaaattcaattcacatatttaattgtcaaataactctgcatttttccttttccaagcttatgaagtaaatgtcactacttttattttacatgtaagggaacataaatccaaatttgttaaatgattttcctaggaatgtactgtaagtaggttgcataggtgagattcagtccacacctatatgagattccatcatacatttctgcctctagtgacagctgtttgaaaatcagtcttagaataaacatttagaaggagaatctggaaggtagaacagcaatgtgaaaattgttctttgctctcctctctatatgtccgtactcttttagcccctgttagggtctttctatcatttcattaagataatgtaaacagagggggtggagccaagatggccaaataggaacagctccagtctacagctcccagcatgagcgacgcagaagatgggtgatttctgcatgtccaactgtggtactgggttcatctcacttgggagtgtcggaaagtgggtgcaggacagtgggtgcagtgcactgagcatgagccaaagcagggtgaggcattgcctcacctgggaagtgaaaggggtcagggaattcctagtcaaagaaattccctttcctagtcaaagaaagaggtgacagatagcacctggaaaatagggtcactctcaccctaatactgtgcttttccaatggtcttagcgaacggcacaccaggagattatatcccacgcctggctcagagggtcccacgcccacggagcctcactcatcgctagcacagcagtctgacatcaaactgcaaggtggcagcgaggctgggggaggggtgcccaccattgcctaggcttcagtaggtaaacaaagcaaccttgaagctcgaattgggtggagcccactgcagctcaaggaggcctgctggcttctgtagaatccacctctggggggagggcatagccaaacaaaaggcagcagaatcctctgcagacttaaatgtccctgcctgacagctttgaagagagtagtggttctcccagcaggcagctggagatctgacaacagacagactacctcctcaagtgggtccctgacccctgagtagcctaattgggaggcaccccccagtaggggcagactgacaacacacatggctgggttctcctctgagacaaaacttccagaggaacgatcaggcagcaacatttgctgttcaccaatatccgctggtctgcagcctctgctgctgatacccaggcaaacagggtctggagtggacctccagcaaactccaacagacctgcagctgagggtcctgactgttagaaggaaaactaacaaacagaaaggacatccacaccgaaaccccatctgtatgtcaccatcatcaaagaccaaaggtagaaaaaaccacaaagatggggaaaaaacagagcagaaaaactggaaactctaaaaatcagagcacctctcctcctccaaaggaacacacctcctcaccagcaacagaacaaagtaggacagagaatgactttgaagacctgagagaagaaggcttcagatgatcaaactactctgagctaaaggaggaagttcaaacccatggcaaagaacttaaaaaccttgaaaaaaaattagatgaatggctaactagaataaccaatgcagagaagtccttaaaggacctaatggagctgaaaaccaaggtatgagaactatgtgacaaatgcacaagcctcagtagctgattcgatcaactggaagaaagggtatcagtgacggaagatcaaatgaattaaatgaagcgagaagagaaatttagagaaaaaagaataaaagaaaccaacaaagcctccaagaaatatgggactatgtgaaaagaccaaatcgacgtctgatttgtgtacctgaaagtgatggggagaatggaacaaagttggaaaacactctgcaggatattatccaggagaacttccccaatctagcaagacaggccaacattcagattcaggaaatacagagaacaccacaaagatactcctcgagaagagcaactccaagacacataattgtcagattcacaaaattgaaatgaaggaaaaaatgttaagggcagccagagagaaaggtcgggttacccacaaagtgaagcccatcagactaacagctgatctcttggcagaaactctacaagccagaagagagtgggggttaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaaacactaaacgtggaaaggaacaaccggtaccagccactgcaaaaacatgccaaattgtaaagaccgtcgaggctaagaagaaactgaatgaactaacgagcaaaataacgagctaacatcataatgacaggatcaaattcacacataacaatattaatcttacatgtaaatggactaaatgctccaattaaaagatacagactggcaaattggataaagagtcaagacccatcagtgtgctgtattcaggaaacccatctcacttgcagagacacacataggctcaaaataaaaggatggaggaagatctacgaagcaaatggaaaacaaaaaaaggcaggggttgcaatcctagtctctgataaaacagactttaaaccgacaaagatcaaaagagacaaagaaggccattacataatggtaaagggatcaattcaacaagaagagctaactatcttaaatatatatgcacccaatataggagcacccagattcataaagcaagtccttagagacccacaaagagacttagactcccacacaataataatgggagactttaacaccccactgtcaacattagacagatcaacagacagaaagttaacaagggtatccaggaactgaactcagctctgcaccaaggggacataatagacatctacagaactttccccccaaatcaacaaaatatactttcttttcagcaccacaccacacctattccaaaattgacaacatagttggaagtaaaacactcctcagcaaatgtaaaagaacaaattataacaaactgtctgtcagatcacagtgcaatcaaactagaactcaggattaagaaactcactcaaaaccgctcaactacgtggaagctgaacaacctgctcctgaatgactacagggtacataatgaaatgaaggcagaaataaagatgttctttgaaaccaaggagaacaaagacacaacataccagaaactctgggacacattcaaagcagtgtgtagagggaaatttatagcactaaatgcccacaggagaaagcaggaaagatctaaaattgacacgctaacatcacaattaaaagaactagagaagcaagagaaaacacattcaaaagctagcagaaggcaataaataactaagatcagagcagaactgaaggaaatagagacacaaaaaacccttcaaaaaatcaatgaatccaggagctggttttttgaaaagatcaacaaaattgatagaccactagcaagactaataaagaagaaaagagagaagaatcaaatagatgcaataaaaaatgataaaggggatatcactaccgatcccacagaaatacaaactaccatcagagaatactataaaagcctccatgcatataaattagaaaatctagaagaaatggataaattccttgacacatacaccctcccaagactaaaccaggaagaagttgaatctctgaatagaccaataacaggctctgaaattcaggcaataattaatagcttaccaaccaaaaaaagtccaggaccagatggattcacagctgaattctaccagaggtacaaggaggagctggtaccattccttctgaaactattccaatcaatagaaaaagagggaatcctccctaactcattttatgaggccagcatcatcctgataccaaagcctggcaaagacacaacaaaaaatgactattttagaccaatatccctgataaccatcaatgcaaaaatcctcaataaaatactggcaaaccgaatccagcagcacatcaaaaagcttatccagcatgatcaagtgggcttcatccctgggatgcaaggctggttcaacatatgcaaatcaataaatctaatccagcatataaacagaaccaaagacaaaaaccacttgattacctcaatagatgcagaaaaggcctttgataaaattcaacagcccttcatgctaaaaactcgcaataaattaggtattgatgggacgtatctcaaaataataagagctatctatgacaaacccacagccaatatcgtactgaatgggcaaaaactggaagcattcgctttgaaaactggcacaagacagggatgccttctctcaccactcctattcaacatagtgttggaagttctggccagggcaatcaggcaggagaaagaaatgaagggtattcagttaggaaaagaggaagtcaaattgtccctgtttgcagaagacatgattgtatatctagaaaaccccattgtctcagcccaaaatctccttaagctgataagcaacttcagaaaagtctcaggatacaaaatcaatgtgcaaaaatcacaagcattcttatacaccaatagcaaacagccaaatcatgagtgaactcccattcacaattgcttcaaagagaataaaatacctaggaatccaacttacaagggatgtgaaggacctcttcaaggagaactgcaaaccactgctcaaggaaataaaagaacggaagaacattccatgctcatgggtaggaagaatcaatatcgtgaaaatggccatactgtccaaggtaatttgtagattcaatgccatctccaccaagctaccaatgactttcttcacagaattggaaaaaactactttaaatttcatatggaaccaaaaaagagaccaccttgccaagtcaatcctaagccaaaagaataaagctggaggcatcatgctacctgacttcaaactatactacaaggctacagtaaacaaaacagcatggtagtggtaccaaaacagagatatagaccaatggaacagaacagagccctcagaaatagtgctgcatatctacaaccatctgatctttgacaaacctgacgaaaacaagaaatggggaaacggttccctatttaataaatggtgctgggaaaactggctagccatatgtagaaagctgaaactggatcccttccttacaccttatacaaaaataaattcaagatggattaaagacttacatgttagacctaaaaccataaaaatcctagaagaaaacctaagcaataccattcaggacataggcatgggtaacgacttcacgtctaaaacacaaaaagcaacggcaacacaagccaaaattgacaaatgggatctaattaaactaaagagcttctgcacagcaaaagaaactaccatcagagtgaacaggcaacccacagaaagggagaaaatttttgcaatctactcatctgacaaagggctaatatccagaatctacaatgaactcaaacaaatttacaagaaaaaacaaacaaccccatcaacaagtggacgaaggatatgaacagacacttctcaaaagaagacatttatgcagccaaaagacacatgaaaaaatgctcatcatcactggccatcagaaaaatgcaaatcaaaaccacaatgagataccatctcacaccagttagaatggcgatcattaaacagtcaggaaacaacaggtgctagagaggatgtggagaaataggaacacttttacactgttggtgggactgcaaactagttcaaccattgtggaagtcagagtggcgattcctcaagtatctagaactagaaataccatttaacccagccatcccattaccaggtatatacccaaaggattataaaacatgctgctataaagacacatgcacacatgtttattgcggcactattcacaatagcaaagacttggaaccaacccaaatgtccaacaatgatagactggattaagaaaatgtgtcacatatacaccatgaaatactatgcagccataaaaaatgatgagttcatgtcctttttagggacatggatgaagctggaaaccatcattctcagcaaagtatggcaaggacaaaaaaccaaacactgcatgttctcactcataggtgggaattgaacaatgagaacacatggacacaggaaggggaacataacacacgggcctgtcgtggggtggtgggaggggggagggatagcattaggagatatacctaatgttaaatgaccagttaatgggtgcagcacaccaacatggcacatatatacatgtgtaactaacctgcacattgtgcacatgtaccctaaaacttaacgtataataataaaaaaaaaagatagtgtaagcaaatatataggtacagcaaatgtacttattaccatgggaactgtcattgagcttctgtgcttttcttggtgatttaaatcgaatggctgatttgttctatcagtcttcctggaacttgaaggtaatcagatgggcctataatctctaggatcatcccttttcttcctcttttataaaggcaggcattacattggttctgttccacttcccagggactcagttactgaaaagagttgataaatgcactcagaatctaattctcaactgccctgaaatatgttaccatgtgctgtgaaattgaaccacataagcagatgttcctttaaaccgcccttctcccattgtttcagcagaacttgtttttagctgtttccacccatctatcagaaaataaacattttcttagactttcttttttgatatgtctaagtgaaattcttttctccatgttgttttttagctcaagacttttattttgcattttctccccagtaataataataagaacaataacaacactaatataaacaccattcttctaatgtgctggtcactgtgttaagccctttatataggctagtctattaaatcttcacagtaaccctgtacaataaataccattctcatcctcattttacacttaagaagtctcagggacagcagactcttttttgtcctctttcacaacttgaaagtgacagtgtcagattctaacagaaaatgttagcatagcctcatttttaaccattatgacattctttccagcctcattttcttccccaaagtccagttggatgcaaagaatgtagttcagttcaatactgaactgagattgaacaaaatgtagctgaattcagagaagttcaataaaaatttaaggactattaaattaaagttagtaagaagccagtttgataccataacgtgctgtattttatatacctagttaacctaaattatgtttttattttttcatttagcttcttacatgcttccagtttgaatattttgtttacatgtgccttttgtaaacatttttctaaaatttagaagtattttaattgtaatcatttattttaaaaacacgtagtatctatatatgccattttacacacattaagtgatttggatcttaaaagttgataatctaccatatttttcttctcattctccatagacgctgcccttttaagcatatttgcctagatgattgcttctggacagtcagagatttggcccccaagagacatgtggcaatgtttggggacaatttttattgtaatcacttgagggctggagtactggtatctagtggtagaggccaaggatgttgttaaacatcctatgaggaacagggcagcaccgcacagtaaaaaatcaccaagctcaagaaatgtcagtagggccaagattgagaaatcctgagtcctaaactatccctggggacattatcagcatggacaataggactgggctgtgcattcttccttttaggcaaatgtcattggttttattggctttatttttcctccgtcttaaacacccccaaccccccctcattgtgcttattagtgttttaattagaagtgagtgttagctttttctttcaaaacagaaatatcttggtgatgacagtaactgacaaaacatctgttaaatttttcacaaaaaaatttccttatttctcaatgttcttggaatgctgttgatgtttgctgaagtaaatttccagactccattcatttatcaaaatttgggtattctataatacaatcaaacatttatctagtatcgtaatttgcaatccctttagatgtaatcttcagtcatcaagagcaagttctaggctgctatgaaattaagttcgcttcttcaaattgtttgagcacgattgtcgtttagtaaaataaacatagctctattatttcttaatgtctttcttaacaagtataagattagactgcttctcacaaactcccattgggcagcatttaagaagtgagtaatatttctgtctgtttaagtcaagtaatcccaaatggaagtaatttatgggaaggcatcggggagagttacaatagacatattgcaatatgccactggaaatcaacatctccccacatgtttgatcaagagccagatggaagcttttatcatatttatttaatctgaaatacacatggtaattacactggacctttgattcaagtccttattaatgtctccagagaagtcaggaaatgagtttgtcagttgcaaactgatttagtcatgaccctctgggtagaatttacatctatcactgcctagattagagtagagctacaagtcactttgtgcctcaagaaagtgaagtaaagtaaaagcttagttaacgtgtgtaagaggagtaagaagctcctgctctgtccaaaatattgtttgtactatttttcattcatgctgctccagaatggctccctcctatgagtggtgtgtgagtaaagtagaatataaagtttatggccactatctcacaaagtaaaattaaccaaaacaccaacaaaggcacattgaagtgaaatactctcacatttcgagtcccaaatctggggtcttagacaacttctacaattaaacttagcagatgttagtatacatggagttttctttggattagtgataggaagaggaagatatcgcaaagatcacctttcaaaatgttacatttaggaaaatgtgagttagcaaaactttaatgttgaatgtttacattctaacttttcaactatgatgtttttacataataagaaaacatgtatcaaagatgaccagtattaatatgtataaaaaacattaaaataatatacctgttaaggtagatggagcttatttatctttggaggatgggtgtaatggaagacatcaactaaatgttatttttttaacattcaaaaacgtgcattatgattatgttattttattttcaaagttagaaaaacgaatatatatgtatttgtttaaagatttgtacatgtatatacgtgtgtatatatatatgtacagccttttgaaagtgctcacagaaaatatagcattttctgatatatttttgatgttttgtaggagaaaaatatgaattaagtttattaccaaagaataacaatagattgctattaagatgtataactaatgagaaatattcaggtaaatcacatacctactctgaaatgacttccacaattttattgcttgatcaaaatgatattaatggctattactgttgtcctaataaacttgcatagaattttatttcattaaattaaattaaaaagctattaaattaaatcctattaaaatttaaatggtaattaaaaaccataaaataatcctatcaataatttatttattatgctaagccaatatgatatatactacagctatcctgtggttatctcccatatttccattaacaatgttcttaagcttggttatttatctgtttccattgacatgacataactactgttatctccaataagtttacattgtacaaacaaggaaagcacatactgaacatgtattctgctggatgccctactaagaatgttctacataagatcccatctcattttcacaataaattttataagataagtgatcaacaaaggcaacattttacagaaaataaaacaaggcctctaactataaaagacaattaaaactaggattcataatcagggtctcgtttttatggcaagtcttttccgaaaaaaggtaaattttaaaatttttctttagtaaagaattgttgtacccttgttttttcctgttttgtatttataacaacaaaaacctttcatgtaatgtagtaattaaaatgtcttccatatgcaaagttaaaaacagttatgattcagtgaacaaaatagagaaccagatattaacacttctgattctaagtgagctgttgcgttagaatgtgactgtattagtccattctcacattgctatacagaaagacctaagactgggtaatttattttattttattttatttttattttttatttttttttttgagacagagtctcactctgtctcccaggctggagtgcagtggtgtgatcttggctcactgcaagctctgcctcccaggttcacgccatcctcctgcctcagcctcccgagtagctgggactacaggcacccgccaccacgcccggctaattttttgtatttttagtagagatggggtttcaccatgttagccaggatggtcttgatctcctgacctcctcggcctcccaaagtgctaggattacaggcgtgagccaccgtgcctggccaagactgggtaatttataacgaaaagaggtttagttggctcacagttccatgggctgtacgagaaatgcgatgctgccatctgctcagcttctggcatggggggcaggcatcagaagacttacaatcatagcagaaggcaaagggggaaggaggaaggtgagggtcggtgctacacacttttaaacaaccagatctcatgagaactcactcactatcaagagaacagcaccaacggggcggtgccaaaccgttcatgagaaactgctcccatgatctaatcacctcgcatcatgccccatctttaattcttggggttacaatccaacatgaaatttggtggggacacagatccaaaccacatcattctgtgcctgatgcttcaaatctcatgtccctctcacattgcaaaatacaatcatgcttttccagaagtcccccaaacttgtaacttattccaccattaactccaaagttcaaagtctcatctgggactaggcaagtctcttctgcctatgagcctataaaatcaaaaacaagtttgttactctcaagatacaacaggggtacaggtgttgtgtaaatactcccattccaaaagtgagaaatcagccaaaagaaaggggctacaggccccaggcaatttggaaaccaagcagggcagtcattaaatcttaaagcttcaaaataatctccttctactccatgtctcacatccagggcacactggtttgaggggtgggctactaaagcctcgagcagctccattcctgtgactttgcagagttcagtgcctgtggctgctcttatgggctggtgttgagtgcctgaagcttttccaggcacacagtacaagctgtcagtggatctaccattctgggatctggaggacagtgactctactcccagagctccactaggcagtgccccagtggggactctgtgtggggactccagcctctcatttcccactttgcactgccctagtagaggttcttcattatggcttggccactgaagcaggcttctgcctagacatccaggcttttccatacatcctctggaatctagatgaaagctcccaagcctcaaatcttgccctctgtgcacctacaggcttaacacatggaaccaccaaggcttaaggcttgcaccctctgaatcagtgacccaagttatagctggtcccacttgagtcacaattagaggtggagtggctgagatgcaaggagaagtgtcccaaggttgcacagagtagctgggccctggacctggcccagagacctaggaggacagaacgaaaccacctgtcatggagggcctgctgcaaaggtctctgaaatgccttcaaggccttttccgtattgtcttgggttttccacattatcttggctttttacttatgcaaatttctgcagcctgctttaattcctcacctaaaaatggacttttcttttctaccacatggccaggttgaaaattttccaagcttatatactctactttcttttttaaatatcaattgcagttattcatcatttcttggcttacacatatgagataggatgttagaagcagccagatcaaatcttgaatgctctgctatttagacatttattctgccagataccttacatcaacactctcaagttcaaagttccatggatccctagggcaggactcaatgcagccagtttctttgctaacacataactaacgtgacctttgctccagttcccagtaagttctttatctgtatctgagacttcctcagcctggagttcattgtccatatcactatcagcattttggtcacaaccattcagcaagtctataggaagttccaaatttccactcatcttcttatcttcttctgagccctccaaactttttccagcctcgcctattaccaagttccaaagtcgtttccacatttttaggtattctatagaaatgtcctactccttgataccaattttctgtattagtctgttatagcattgctataaatacccgagactgggtaatttataaagaaaattggctcacagttccacaggctgtacaggaagcatgatcctggcatctgctggacttctgcaggggaggaagcccaggtaacttacaattgtggtggaaggtgaagggggagccagaacttcacatggcaggtgcaggaggaagagagagccgagggaggtgctacacactttgaaacaatcagatctcaggagaactcactcactcactatcgttaaaacagcaccaaggagatagtgctaaaccattcaagagaaaccgttcccacaatccaatcacctcctatcatgccctacctccaaccctgggaattacaatttgacatgatatttggtggggacacagatctaaatcatatcagtgactttcaaaaaaaaactttgttatttgttattttcttgtgttactttgtaagacagttcgaacccttggtgaatgacaaattctagaaaaaaggaaaaaatggatttatttgaaggtaggagaaaagaattaaataaacacaatttgttatagaaacataaacaattacactaatttagaagaatgattataactacatgaagttttcaactgtaattaaaatatgatttattttaggttatgtatttaatgatatctatgaaaaacacagtctgtacctgtaaattgtatttgtattccttaagtagaggaaagctatagggttctatcattaaaattctgggacattcttaggtattaggtacggctttgaaaagttttaaaattttacttttattattataacatatagtgtggaatataaaatacagatattttaaggttgccatttaaatttttcttcagcacagttgaaatgactgtagtgaatgcatcttagagctttcagttaagtcttttcattggtatgtttggcctataaggttctgtgcaataattgttaaaatgaataattatattttatgtataacaagaatttaagtccagtgctttgtaacaatgatgtaggacaaaattttacatataattatacttcatattaacttgtaagggcagaattattttataggcatatttgccactcattaatatttaagtaaatttcttctgaagattttgttataggcttagttagctgcattttgcatacttatttctcacatttaaaaaatcacaatctattaattcatagagtatgcaaattttctgtatgcttaaatagaaagattaattactgttgtaatttaagcatagtatgtttcttacaaactttctttttctttctttttggaaaactaaagtgtattttatactcacaaacatgcacacaactatttctgtcattatatcagtgtctagatccatgactatctgatcactacattcttaatgataataaggtcatagcagctcctgataggtattaaataaatagctcatataaatagccaaatctccaagggttaactacactgaagttttataccagtattttcttctgaattcatgttataagaaatcaataaatttgataaaaccttcttccaaaattcttcctataacggagtaaattaatgtacttaacagatccaaaattaagtgacattctaagttggtttctgtaatacaatatttgaaatatcctagttcattttttattatatcctatcaattacattaagagactagattttccttgtaagtcaaacatttgaactctaaacatattttctacattaccttttgggtctaaatgcattttttgcgtgtacacttgacaaaaacttatccaccacttatacttttggtcattttggaaaataggttctggattgggagatgcggaagaaacccagtgatgtttggtctttgactattttcttccaatgtcttcgtggaatagtttcaggagagagcacagcacagagaacaaagaatctcaggaaaggaatcttctctgcaatttgggaaagttgttcacaagaacatgtgctcaggcatccataagccaaacaattactttttaacatgcagtaatcatggtctatcctcttgatagcaactttcccgtatgaaaattctcttatgctggtctaattcagcttgggtcaggttcagttttgcagttaggagcttggacaataacataatgataaatatttactaaaaaatctaaatttgttatgaaaatagtaactattttgcaagactgatttgtggttcaaatgagtttatgcttatttaataaatttaataaagtaataagaataatgcttttaataaatatgaactattatattttatgggacaagtattgtactaaaacttttgtatatattatctgatctgttatgcacaagaattttttgtgtcacctactattattatcctgtttaatagatgtgaaaactaaggtagagggaggttaagtaacatatctgtcatatagctagtgtataaaggaccagtaacagcaagatgggagtgattgagttacttcctatttgaacataacttagtacatgaaaaagcaatcagagaacatctatttaagcttaatattttaatatttaaaaaaaagcataagtcttttctactggtatgtgatgatctctttataatgatatatggaaaagacatatattcattattgtaactgagaaactggttcaattatcatttatagtggtttttaaaactcataaacatagttaatataacttataattatcatcagaataatcaattccaaaaatatataacagaattgatttgactatagtgactagtgttgttatatacattttagaactgacttgtttaaaaatatattttagtagaaatagtattgtgtgtctagtgtattggctcataaaaacttaatatgtttctaacaggtgatgattctaccccatttaagtgtttatttttccatcagatgtatttatacacatggataaacatcacagtcaattggtacagcctgaaattttagaataatgtggagtctataaacgatctcattggcaaatatttattctttattatactaagtatttaaaaaattcttctatactatttttgttgtttcctctgaaagcatgcttaatttaattataatcaagccatgtgtctttttttttcagcttaagaaatgtgtttacaactatattttactcttaggcgaaaataattgcatacaatatacttaacctccattctgcttaaacataccttaatttatctttttagattttcacagaatacattgccaaaatggatatatggcaatgtcatattgaagtcatttattttttttcttaatggttgttcctatttatttattttatgtgtgtggacagagaacagtgatgtgtgaagagtttggtattgttgacattgaaggcagaacagctccaagagagaaagacaggaagcaacagaataaaaagcagcaatttatatatatcacataaaataaactaggcactgtgaaatgaattttagcatatatttttttctgataaaagcaaccccaaactagaaaatgcaggcttgttgcaggatgtctaaccttatgaagctcattgttttatttgcatatttattgaacactttttagatatgacatatgcatatgtcctgtctttgtccatttggtctgctataacaaaataccaccaattgggtagtttataaacaacagaaatttatttctcacagttctggatgctgagaattatgatatcaaggtgcaggcagattcaatgtttggtgagggcctgctttttggttcatagatagtgtagtgtattctctgtgtactcacatggtgaaaagggcaaagcaatgcaactctgggcatcccctcttttttttttttttttttttttttttttggttttagagggattcttgctctgtcaccctggctggagtgcagtagcgcgatctcagctcactgcaaactctgcctcctgggttccagagattctctggcctcagcctcctgagtagctgagattacaagggcatgccaccatgcctggctaatattttattttagggcactaattccattaatgaaggaataactctcacgacctaatcaccttccaaaggctccacctcctaatatcatcacgttggtgattaagatttcaacacatgaattttggagggacacaaacattcagaccttagcagattcattataaactgattttttaacagtgactgttttgagaaaagcagagcaggtacctattctcatttataaacagagaaactgaaactctacactggtcacatggaaactagaatgaaatactatttgagatctctgagcttaaaaagagactactattttatgaaggaaaattagactctaagttatgtgcccaatggataacttagctgacttttctcagcagcaaatggccccatggtaatccatggcaatccaaaaacttattttattttccgtttgatcacctagatagcctttaaaaacatccttttctttcaccttcctcctgttatcacacaggtaatctcctcatggaaagttctctcactttatgaatgtcagtgggaaaggaggtgaagcgttttgtgaaggacccttagttctaatagctgcactgctctgctggttgagagtactctctggagttgttcagattcttcagagctaaaaaatttcctcacttgaaatagtcaaggaaatactagcctgcattcaccagcaaaaaagatcgctgaaaggaagagaactatgctagaacctacattttccaaaaatagaaataccatgttcggatacattttccatttaatttttgttctcaagaacaaacagggtatctttttcaaggacatattttatttgtgcccagcacattattgatcatgtataagtatagattaataaaatttattgtgaaataattaggatgtctgtaaataatgaagaaaggatgagcagatcagatcacgaaatgggacaatcttcccaggagggaagctgcagtccagtgcatgaaattagtgcacggagtggcaacagtttccttctgcactcctgataatcacattgcacttactgaaacagtttgtaaattgattgtatctctaagctaaacagccttggaacactaaaaacaaaccaaactaaaacaaagaaaatggtgattttataattagtatggcccaaaacgttgtgaataggaaacttatgtactcttacagatataaacatgtggggccatttgttttttatgagcttcatgggaaaataaatttgtgttacactaaatacattctgagaggaaagattaagttttgtgtttgcttggatttgctttaacccgtcattgaaaatctgttgtatgatgtagccttaatttaaaactcaaagtttctacacatattacgtatagttaaaactatgtgtaaatcactgcacaaatatgaagaattatatattttcatgttttctatctcttagatagtattcttaagcgtttttgtcagaaacagtaattgtacataaaattacgacataatagatggcccttgagtaagcgcagtgacgcatttctctccagggactttgcttatgtcaaagaacagtttattttttcccacaagttatgtataactgtttctaatgttgtaccatagtgcccctctttctgaagaattattctttttaaatagggggaagtgggcccttaagtatatggaaaaattctaatttaatgttagaatcaaactataaaaagcagtaattaagtacatatctggatgagtcatttatacttgatagtaacagttttattataatttagtattatgaaggggcagtgatccgttgctcagcacagcaaattggcatataaaaaacaatctgtttggaatttagcataagaatttaatattattcattcactcaatttgcttagctttaagaactgtgtaaaagtgctgttacaactatattacaagtgtaagaaacaacctttatcttcaagaaaacatatctttgggggaagataaaacttaaacaagtgaattaatctggaggagtaaactcctggactaaataattcaaggataattgacagagactgatcactgttgttcggactttgcatgcccagagggaaagaagtatgtcttacaggatgaagaagcataaataacaggagattatttagcatggatgggcattggattctccatcatgatagaaaaaaaaggaatacagactatgtggaaaaataaaatgctataaatgacctcaaccagctctcgttcccaaaataggagtcatcttagccatactaaaaactgacttccatagttaattttaaagcttttccaagattatttcaaaactagtttaagcaagctgtttcgagataactatgatttttctgagtacgtactttacatacattgaaaaaaattgcaatatattacatagagcctgacacagattaaatactcaacaaattattctcttatttaatcctcacccatcagactgccaccagattctttttccatctaatctcatgttatgcaaatctttctgtattaatattttccctaatctttcaaatagacacttagaatggttcacagttttcacatggagtaaattaaaagtcctgaatgagtcttttaaaaggctgaaaaaggaaacctatatttttccacatggcagcttatacgttccaactctcttttttttttcctcataaaactaacatttggatagtgcttcctttgtgtcagacattcttctaagccatttcagagtattgatacatttagtcactgacaatgctgggaaataagtattcacattctaaagatgagaaggctaaaaaacctgacctgtgtcacacagatagcagtaaatggtttaaggcttggtgtaaacaatttgtaaatccagagtttgtaagcagtgtcttccacttgaaaaattttcactgagttttctgttaatcaaaatttgactttgaaaacatatttattttaatatataataacaattgaataataatcactttctttgtataaaaatgtccttggaacttaattttaaaatattttaaataaaatgatttacattttaattatttcctaccattatatttataactgaaaatcaaatataataacttaataaagtattttttataaaaaaattttacatggtcagacgcagtggctcacacctgtaatcctagcactttgggaggcctaagcaggtggatcacctgaggtcagcagttcaagaccagcctggtcaacctggtgaaaccctgtctccactaaaaataccaaaattagcctggcatggtgatgcatgcctataatctcagctacttgggtggctgaggcaggagaatagcttgaacccaggaggcggaggttgcagagagctgagattgtacccctgcacttcagcctgggtgacagagcgagactccatcttacaaaaaaaaaaaaaaaaaattccaacactagaatgaaaagctacttgcattcatattttctacatactgttatcttaaaaggccagaaattcttcatatttgagtttgtaccttgtattttaagaacagaaaacacaatagactagacccttgatagaaaccccagcaatgatttcagagatagaattacattatgtaggatttctccatattaagattttaagtaaaactataaattagtgttatttttcactcgtaaatatttaaaattactgaacttaggtattataatttgacataattttctctttggagtctttactaagcatcaaataactctaaatgaaagttgttaagttcagaaagctttatgtttacaatatcttttgtgttttctgcattgtcaggtaaaagagattactaatgtattatcacatctcctgaaatttactccaacattaacaggctaatgccaacaaatcatgggctaatgcttgagaatgaaaaatgatctttaacaatacatgatgtatttatctgaataacaatgtagacacagctctctgttaagaaatttcagaaagctttacttcgtctttttattgctatgaaataggaggtagatgtgagaggaaatatgagaaattgccattgaaatttagccatttaaattatgtactcttcctgcatcattcaggtaatacttatcctcaatcccaaacatttgttttagttgctaagaataaaaacttaaggagaggctcttagttctaacagttatggggatttaaaaaaaagcatagccaaaaatattacttttttaaaaatacacttacttgtagacatataaagtaacttttctcatatccatattatctttaaaaccttaaaatcctatgaaaatatgttgatttactttgtcaatgaaatgaaagatggaagttgaagtatttccttcacagattataagaatgaataggatcaaataaatatgtgttataaattaatttcttcaaaagttatgttaatctatctctgaatgtatctgaaacaaactgaaaacaataatgaacatgataaatttaaattgatctacaacaaattttaacagatcaaatcgttttaatgtcaaaaaaaaaaggaaagagaaaatggcctatatatataatctgagattctactgtaagaatgaaggttacaggcaaaaaaaattaaatacatcaatgaaacctttccctaatagtgatctatatcctaagacactacctccattccattcactaggtacagatgtcatgtaattcatatttcagttgcaaagatagctgtacctgaattgatctactgcattaagaatgagcaagaaataccatcagcatcagaacagagagtctttgttcaagtcatcccaacagtaagatgaaaaatgagaaaagaaaatacaaggatatgtaaagattatttatttatttatttttgagacaggaactctgtgttccttaaacctctttttccttataaattacccagtccacaggtatggctttattagcagcatgataacagactaatacagaaagcatacaatttaattaaaaaataataatggccggatgcggtgactcacgcctgtaatcccagcacttttggaggctgaggtgggcagatcacgaggtcaggagttcaaggccagcctcaccaatatggtgaaacctcatctctactgaaaatacagaaattagccgggcgtggtggtgcacgtctgtagtcccagctgctcaggaggctgaggcaggagaatcatctgaacccgggaggtggaggttgcagtgagtcaagatcgtgccactgcactccagcctgggctacagagcaaggctatgtctcaataataataataataataataataataacagctttgaatatttttaatatgttaatatttaaacattttcaatgattaaaaattttgtttaagcacagaaaataacattaatgcaaacatatgacccaataccataaaactacacaacttactaaaagacactgaatgtttgaattgttaaagactcatgctgattatgtataatacactatataaagcaaaatgtatttataagtttataaatcccaataaataatctgttatattttgattcttccaaaatttttctgaacttgatagggggtgtttttagaagtccttcaactgatttttaaaaccataatactggtgtaatattgggcatacagatcactcatatagactagaatgtgcagaaacatataaaatatatagacaattattttatggtaagttacataaaattattgattaaagaaattctgtgggggacagctggctataaaaacagaagttatattttaacactttagcctcaaatcatagaccacaatacattttagaaggattaagatataataacaaaagggttagatgacaataaagatttgtatgcatataatcttattgcaaaagtgttttttattctatgacccacaagccacgtgtcataacataataatttaatggatttgattacataaagttgtaagactaatctatctgaaaataccaaaaatgaaaaataaagagaacttgctaaaaattgttaatctttaaagacagctgttaaagcaaaatttaaatagaaaaatgggcaaattgcatagacaggcatttcaaaagtaatgaattaaaatagctgaaaatatttagacattattatgttaacctgtaatttcattaatccaaaacatttaaatttagatgttacttttccacatcagaatggcaaaatattttaaaattatattttgatgttaatgcaatatggagaaaagaatccctcaggtgctgttgatggtggggggggggttgaatttgtacaattttttggcaatgtacattgacaatatttatcaaaagcctttacaaaatatttataccattgatccagaaatactttttagaatttaccttcagcaagaaagacaggtgcagagatgtatgaacaaaaatgatttctaagttctctaaaagagtgcccagttctgcaagatattcagcaaataaaatggatatgatttatgactgtctgtttatgaaaacttgagcaagaggtggatttttgaactgattccaaaggatatttcaagtaatacaaatagagaattcagaaatatgacaggtttattttttcctcatttttggagatttatgggcaatgatagaaatgtagggaaatacaagaaatagatattagagagctaaaattaactagtaactttaattttaacgtttaatgtttttaaagtaaagcttcccccaccccctcaccccgacccgcaacaggcatttcaaaggtgtattgttaggctgggtgcagtggctcacacctgtaatcccagcactttgggaggcctaggtgggtggatttcttgaggtcgggaattcgagactagcctggccaacatggtgaaaccctgtctctactaaaaaaatacaaaaattagccgaggctaattagctatggtagcggggcacctgtaatcccagctacttggaaggctgaggcagtagaatcgcttgtccctgggaggtggaggttgcagtgagctgagatcatgccactcactgaactccagcctgggcaaaacataaaacgaaacatagtgtgtattgttatttttttttttttcaggcagagatttagtgaccaatagctttacttactcctttgactctcttatcttcaactttcatctcctgagatcactcaggaggcttacatgtgtgaggtatttttatcggctgagccttcatttagttgtctagaacacaaatcactttgtttaatcaactgtaacagagactggaaaatgcctagttctaataactgaaagcaaagaagatgtttgttatcagctagaaatctctgccccaatatacccttctgatcaccgaatattttttcacctcgtttcctttacacaaaccactaccacatcccatctaaagaaacaacgtaaagttccatcaaaccaaggtatccaactcaaagctcaagatccgcagatatgcacaattctcttcaccatatctggtgaaaagaagtgaaaataagacaagttattaattctcctctccatcgcatacacaatacacatgatagaggagaagtacttcatgataataaatactcccatttggaattaaaccaagaatggtatacacagggtaatcagggatctgtagcaattataaaaacatgccaggctggcattacaagtcccctctgtcttgacaaggtttgttgttccctgaagaacctggattctcctctattcattcttttttgctttcccaaattctaccttctgttgagttcaacctagttagtcatagtccatgacatatttgaagtaggtgtcggggagtatgtcctccatcggggatacatagcttttatagtccacattttgcattcagcaagtttaggtgtctagacgttgtttgaagtttcaaacagtcagacttttttttctatctagacatatgatcctttgacacagcagttacattaaaaatacagaagactcacaatctatttgtcagattaatgttcctataatccagctctagtttttgaaggcattcttgccaagcctaatttacttctttactttcactgtccgttaaatagatctgtaaattataaatagctatcctgaggctatccgcaacaatgaacctgggagagcaggaagtacactcaatctgatctttgtcatagggctgagtcttagtggattttattgcccaggtcttcactcagttttatccttctataaagagctaattttccaaacttttgagtgcccaaatgtctgggtattcttttgaccttttcacttctttttttttaatatatatatatacatttttttattatactttaagttctagggtacatgtgcacaatgtgcaggtttgttccatatgtatacatgtgccatgttcgtgtgctgcccccagtaactcgtcatttacattaggtatatctcctaatgctatccctcccctcttcccccaccccacgacaggccccggtgtgtgatgttccccttcctgtgcccaagtgttctcattgttcattcccacctatgagtgagaacatgcagtgtttggttttttgtccttgcgatagtttgctgagaatgatggtttccagcttcatccatgtccctacaaaggacatggactcatcctttttttatgactgcatagtattccatggtgtatatgtgccacattttcttaatccagtctatcattgttggacatttgggttggatccaagtctttgctattgcgagtagtgccgcaataaacatgtgtgtgcacgtgtctttatagcagcatgatttatattcctttgggtatatacccagtaatgggatggctgggtcaaatggtatttctagttctagatccctgaggaattgccacactgtcttccacaatgaaaaaatgctcatcatcactggccatcagagaaatgcaaatcaaaaccacaatgatataccacctcacaccagttagaatggcgatcattaaaatgaccttttcatttcttcttgaaaactggccatccttttctgggctgatttcttgcctgtaaaatcctagtaaatgcagaacatgaaagtatattattaatttgtctctttccaatcactttctctagaatcacaagttccaccggcatctaaatcttgatgctgagtattcatcttcctctatcaacagcatttaacagtctcaacccctgctttcccgccaaaatacattcttccctttgatcaactacagtgttttctccaatatcgcttcctctctgaatgttctctccttttcagtctgcacaactggaagttcttcctcttcctgaattttaaatatggaagtttccagtggtcagttctcagacctcttattttctccatctagacaccaatgggtgaattagtcaatttccatagctgtaataacatttatataatgataagtctcaaattatcattttcatccccaggctttctcatgacattattttaacttgataacagtatagttttgttactcacaccaaagaaatatgcagacatacacacacatattttcagatggaggtgaggaggaaggaaaggtctatagctatacaaaattatatatgtatatttgcttatccaatcttttccttaaaatgtaagctcaatggcaatagtgattgatatatcaaatgttatatccccagataccttgtatattatatttgttcacaggatgactggtgtaatgcacgttaatgtattatttaacagaaattgtgttaattttcaaaataactcattctaatgcagttatgtattctgtgactaaataacacattaaatagaacaatattttcctgtcttttccagatcctaatgctttggctggccagaatggccctgaccatgctctcataggaggaatagtggctgtagttgtatttgtcacgctgtgttctatctttctgcttggtcgatatctggcaaggcataaaggtacgttatatttagccagagtacacaatgtgggcaaaatattctagactaacttcattataaaatatgatatcagtgcatatatgtttctgtacatgtgtagaatagggagatagagagaaatgctaaattatttcagcgaattcttaattattttacttaaatttaaagttggattggcttagcaaaataatgtttagccaatggccagatgtcatagagtaagccactggctcagaaaaatagaaaaaatatggaagaaagtttgtaatttatatctagaactgaaatccaactataactatttggttgatgtttttgtcagtttgtgaacatctgtgtagccatatttagtgaggaaaatatatattgtgcaacgggccaggtaccactttattgctgtaacctacttttaaagaagtttaccaaaagaaacggtgacaagtttgacatgaccgtttttaagatcttaacaaaatgtagtcccagctactcgggaggctgaggcaggagaattgcttgaacccgggaggcggagcttgcggtgagctgagatcgtgccactgcactccagcctgggcgagagagcgagactccgtctcaaaaaaaaaaaaaaaaaaaaaaaaaagatcttaacaaaagaccctgtttgctacagctgtaaggttcacattgattttatccatcattaaagaagtcacaattacttattacccatttcagtttggctcttgcctgtagtaaatcaagccataacttcacctgcagcgtacctgaaaactgtaagaaaacagtgcaactttagaagagtcaatcgggtagcatattaggtctcaaaaatctggcaaaagtttcttcctaaataatgtagctttaatgctgggtattttaccagtctcacagagctaacatatttttcttccaatatatgcaggaacgtatttaacaaatgaagctaaaggagctgaagatgcaccagatgctgatacagccattatcaatgctgaaggcagccaagtcaatgctgaagagaaaaaagagtatttcatttaagatgcaggccaagattctgagttttactaccaggctgaatgctggagaaaactggctatcatctttcagaagtcatttctaccatcgtctgctacccttattaactcccatactgtactgctatcagtagccagtgtataccaacaatcagctgttgaaagcatcattctttaattactgtaccatccataatgcaggacatttcttactgcctaaatttcacaccattgctcttttaacatacagtgcttgaatatacagccttaacaatgttaatcatctccttggatcattatattgagtggtttttatacattaaaaaatgtatgcagagtttttttcccccattttttcccctttaagtcatagaccttatcagtttgccattggacagctttcacaagtaacaggattagggaaggacataatgtatttaagaataagtgaaggttagaggtttacaattaatgttttctacatgtctgtcttcaaagacaacatgctttggaaacatatgtcctagaaaacataaaattaaaaaaaaacactatagtgtagtttttggaatgttggagattatactggtaaagctgtatcgatttgctattgaaatatagtatttgatacaggagccatgtgtacgaattgcaatcatgacatggtattttctataattatagagatcttactattaggatattgtagcttcatttaccaataaattattccaaatgatttactgcttttggaatcacaaatatttaattcatttctctaatttgattctataatttatttgcttcataaagattcacctgcctaaacaatattgaagtatccatagggcacaattttcagacattttagtatctgtatatagtgcatataataaatccaattaaacattatttgatacatatttaacttttttggctgtatgtaattcagtcataagtaagcattttctaacgtccattatatccctttaggtattacttaaaccaatattataagtagataacatgtattagtatttttgtctgtatgtcctagcactgttcaacaacaaatttttctagttcttgttaatttttatttgttatacaatggaagcacaatgttataaggaaaggtaattttaagctaacaaccagtgcacagcctcaggttttaaattacaaccacagttgaataataacctaaaaataaattttagtttgctaaaaatttacaaattttcattttgcagttccagagctgcttacctatgttggtttgccaaaaagaagtgtttaagatatgttttctgtataaatgaactaattctttatattaaattcctgtctatgcattttgtgaggtacaaactgatgaaacagtgagtgatagagaatttctgccatgcttttaactccaaagtgaaagtctctttctctggattattttaaaattttggcgtgtttaaccattaagaaatgctgtattcttaaatatgaaacagttaatctaaagtcttattatttcttctagtaaaataaaatattgttagattagttctcattaaatttattatatgctaaagaataaaactccagttagatttaaaaaaatcccatttacaagcattgcacctttaagaagaaaacaaatatgacagtatggtagctatacttgtgatgtctgacgcatgatggcctatggttttaaaaatagtattgtggaatatatttttgggtaataagaatggttgagtgcaacatcatgtattaatatcaaatgaaagacaagggtgctgtatctttgattatttatcaaaaaagtataaatcttttaaggaaaatgttagaattttaaagtttttttttgattgttgaagcatttatcttgttgatttcttacaaaagaaaaaggacgatgtcagtcaagcagcactttttcagaatatacagaacataaataatatgatgtggttgagtgttaacataataaatcatatacagtatgacattttaaggaaataagtctgcattgatgtgattgcatgcttgtttttacagttcactccataccatctgtggaaaaatgcaataatatgttaatatagtatggtagtttgagagaatcaggtaggtgctactagacacattgaaactagaataggtttataaactgttcatatctttcaatgcataatctttagaaagactccacaaagcaaaattcatcctgttagtacaaaatggaaaggttcttattacagaagtaagttgtacaaactgcatcatcaattactatgtaaagcctaatttcaggatgcacttacaaaattgctactcttcatcgatgccgtatttacatccctcttcatttcatctatattctacttggctccaacaactaaattgttgcctaaataactcaatcattatttatagcactgtaaaattagaaatccaaaattggttgcatttcatgatttttgactcttttaacccttcagagtaatataaaatctcattagaactcttataaaaccagttagctaaaacaactagattattatactagttataaatgctggtatattataatttgtgggatctaattaaatgtttgcctattaaatatagtttgatttaaatgagacaccatgttctgaactggagaaaacaatatcaatgaagtcatattttcatacctttaaaaattatttaattttcaaccaaacaaaaaataaattgtaaaaattatgctcatttctattccaacaagtcagaaaataatgacataatatttctaaatgagaatgatgtcaatttcattgtctggaacatgcacacttgtgtgcacatagagtcaatttctgtctcttctaagtgagcacagtaggtagggaactcaatggaagcagtgtgcacacacacacacccttagtagaatatggagcattattctttaccaaaagtagctattctctgccagtgtactgtttacagtgtaaattgattgtcctccgtcaaaatcaagtctaagcggcattttacttttcttttcttttttattttccatttttgggtgttctagataggattattatcaaaagtaggaggaaaaagaaatgtttgtgagtgcaagattaaagacagagcgcatgagcagagtactgatggtgtgcgtgtttgtgtgtgtgtatatgtgtgtgtataagagagaaagagaaatcgaaaagagagagaaatttcaacttgttttcttttaccagagaatccaagaagcagtttaaggaacctgatattggagtttaatctagaaactggatgatctcatattgattcatgatgcttaatctttcattgaaactccacaattaaaataacaaatagagaaagaaaactaactttcctaaatatggcaaagaaactaacacctcatttatttttatttctttgtaaaaatataaatatctcaatcaaaagtacaggctcatttgtaattatgtactcatgattgtaacagcattgagatttcatataggcacatgtatagcagctgtttgacagtgatggctcttccatgtaacatagcagttatcgtgtaatttagtgccacttattgcaaagtgttaccaaggggaacatttcaaatgccttttgtttttctttggacatcaaggtaatttagtggacaacaaatattaaattttacattatgctttttaattgtggagaaaatgcaaaacctcatgtcttaccacaactttcccatggtattgctaattacttagagtctctaaaattgcccaatattatttccctttgcaaatggtaatttctgataaaacaatacaaaacaaaaaaaaagcagtaatcacagccaaataaatgaaacacctaatgagaattactgttgagtaatgctttttattaagtggcacaaagtacacactaaaaactatgcaaaatataggtaactacagtgtacgtacatgtaagtatcttgtacttgctgtgtatggatgttggaaacccatgtaattataatatgcattttgaatattgggaaagaggaaatcttagtgtagataatagaatttgttttgaaatatacactggcaatattgaaatatactcagtgcaatatctgcagttctattgctggatacttaatgcaaagggattttaaagaattcttcagcaagatccaagaggttgctaatcttcacctctcacatactaaagcattcattaaaaatacaactaattcaaggacaagttaagtttttcttattaatgtgacacagtaacatttttatttggattagtttttggtgttattgcagagaaagaaataacctgagttttaaatttcgattcatatctcattgaattgggaattcttcaattttgtttgaaatgtgtgcatgttttcatagattgtagcaagtacaaatgtattcaatgaaagaacatagggtagttttaatagttaaagtcactatatcttaatgggaattttaaaatatcttttctttttctattcattttttccctttctctctctattctacccccaaacaagccctttgcactcatacccttccaaaggcaatggattgaaagtagcaagataataaagagagttaaaggggacaacatataacaatgggttctaaaatcatcagcatttttatgtattgagattattaatattgaatgcaatagttattggatatagctggtaagttctctgccatgcatacttacaataatccttctacctctcacttttaacatgggctatgatacttcaatataaatagaggaaataattatttaccagatatcccaggaagcattcttatggaactattataacagtgcactccccaccccctgggaaatctcaaaagccaagttcttcagtgtattctatggtgtatgaatctgcatttgtttttccttttctatcattagcttttcctaaaggcaaaatattataactttataagaatagtccttctcctgcctatttaatatttcaatgttaatataattgtattggtttttaaaaataattaaaatggcaacactttgcgatccaatctgatatttaatttttaaaatgtaacaatttcttataaattcatgctgtgttttaagtaaaaatcatgtatatgaattattttaccaagtagtattatctgcacgagacaaatttaagtattttaaaaatcatccttattaataaataatcctcatataatgcacagtattgccacaaatgcccacttcattttgtctgcatagacatattaagaatttttcaatgatgtaatttaattatcctaaaagaaatgacagattcttctgtaggaaaaaataaaaacatgaatatctcaaattataatggttaatctctaaaatatgcttaaagtaagatgtttctatgttatgtggttatgttatcaataatatttggttgatcttcacatattttatatgcatatatatatcaagaagttatatatatataactcaagaaactcaagttatatatatatgtcaagaaatgtatgattattttggagagaatgggcccaaatgtgaaaaagatataaaaaaaacaaaaaaaacaaaaaaaaaacactattttcccctacgaaatatactgtatatttcaaaagaagaaaagttaaaagatatttgaagattgcaggggcaaaacaaaaacctaccagggctcagcacttaagcacttttcccacatccagggtcaaagcagcagtaactacatggacttttaagtgcggtatgaaatgcaacattacgcttacaaacagtactgtcaaacctcaaatgctttctttcttcagatgctttttcgtgtacatgatactagtagacacttttctctttatatttactgatagtgaaaatcatacgcaataaaatattgatgtttgaaggcagtggtcaccaattggttaaaaaactatgaaatgtaaactgaattgttatatctctatcctttttgcttttctctgtgtttttaatgtatggaataaatctcataaatagaaagaaaaataatctagaaatttttcaaagctagtactctttctccttataaatgtacacaattttaatctttttacaaatttatttaactgtacctactgtacttattgtagattcaatgacgcagttaagtcatcacccaaggatttatgaatttgagattactgacctgttttcttcatattgcattcacatcaatatttgtgaatttgttgttcagcttttcattcaaacaaaaaatattccctcaagaaagctccatttttatcataaacatttcaacataaccaacattagaacaagtctgccatgttaaaaataatttaaagacttatctctgaaaacggtatccagaaacgcaggtgttcccagtaatgtagcttcaaaaataaaatgtgctatttatatgacatgaaattcataacttttggaagggtatatttatgacagcataaaaaataaattctgtgctataaagaagatccaacaaattaaccatataagcacagaaaatagagaaacacagttattgaatctactcttgtcattaacattttcaaaaaacaaaatgcatattgtaatatttggtacatgacacttgcatgttgatatgcctatatacttacaaagtattcaatgtgtacttagcggcgcttaaaatatgtcatgtacaactcttataaacatttttacagggttcccatttgcacttcatctttcagtaaagtcttgtcagaaaaaaattgtctgataaatatggaaaaataaaatttgaattttagttatctgttggacattactgaattgtctattcatttagtacattttcttaaccttgaaaacagacattgaaagatggaactttcttttttccagtgacaggtcattaaatcgatggtacaaaacatacttctttatgccaaacacattattttgaatacctttttttcaacttcatacattatccatccattttagttttcctcgatgatgcccattttctttgtaaatttctaagtggaagttttaaaaattaagcatcagtaaaataaatgttatcttatttgtacaacatttaatcgttattccttggaatatatgaaccttgtaaagtgatgactaagggtcaaaaaaaatgttgctgacttagggaaatttgcttgagaatgccaaaattttaaaactctgtaaaggtaattttacattcacttatgtgtgtttactaatgttgagtaggaacagaagcaaaaatacctaaacctattttttttaaccttcacactctaaccagtattatatatttcagctacctaagataatgcaattaatcatatatccaacctaagcttctgccaataaggatttcagataagcttttaaatttatggaggattttctttgtgtctttggaagttcacttaccataaagtattttatagtctactttaaataacagattttgttacacagggtaagccaaaggctgtacaagatttagtgtcattgggtctcatatttgtgttagaccatgaaatattccattaaaatttatctgtaaatacaaggcaagattttgtatctggtttattttattaaataacgttttattttatttttaattcacatttttccatttaatataaaaaaatgccctgcattacaggttaggaaatttgacactgtatcaaagatcagattcagcacatctgaaagaaaataatggtatttgaagtaaaacattcatccacatgtgttcttttttttaaaaaaattacccaaaatgcccactcttatgcagcttttcaactgtatacaaatatggaacccgtgcttgctaggtaaatccactctgttttcataatggcaattcttattctggtcaaataatgtatagaattgaaggcacactagaaattctggttcatacaattcactaaaggatattaagtctaagtgttattaataattgggttttgatgcctatgaaggcccttcattatatgataattccaggatattgctaatatataacagtatatacatttaaactaagaagttccaggaaatgtatggttttttttaaaatttcaaatcatactttatctgttttgtaaaatttaagaatttttatcctctagtgttttgaaacctagaaaacatacaaatggctagagaaaagattaaaggagaaaaacagtttctcagtttcatttcaaataccacttaggctgctctgtgttacatgtcatttaatcaacacatcactataggcttagaatgagggttaggcttaagtttaggaaaaaaagtagcacaagtattgaacacctatattgtcatcagttcacctcatgaactttaccaagaacctgaacatagtattttgtgctgatacctccataacttagttctgtaatataattaaattatccttccaagaattgttgttttcttcatatttaagcattcctatgctgaacggaggaataaggaaattcagtactttaaaaaaattgtaattatacaatgcatcttatgatttaagcaaacaaaaaaattacaaatgaatgacctatctttcaactactgtttatgatctgaagtttgatatttttctacatcgattaaaaaaaggtctgactaataagcacatactttactgtgctagaatatacagaaaatcaaatcaccttctttttttttttttttttgagaccgagtttcattttgttgccccacagccacctgggttcaagtgattctcgggccccagcctcctcagtaactggcattactggcatgcgtccccatgcctggctaattttttgtatttttagtagagacggggtttcactatattggcaggctagtcttgaactcctggcctcaagtgatccacctcagcctcccaaagtgctgggattacagctatgagccaccgcacccggccaagtctccttctgaagattggcccaaacaatcagtagaatgggtgacttactgagagtcctaaaaacacatgccttgtacattctaccaaaaccttcattcattttgtctttactgatcaaaatccttacacagatagaggatacatataatatgaacatacgggatattttactgatccattgttatggaagttagtatacaataataatgtaatttaggcacctttaaactaatgaagtatttctggaaaacatcataaccttggaatactgcaaccatttactctaaaatttgaaaacattcaactaagttatatttcagaaatatgtctttttacttccgaatgaaaagaatataaagaagtgaaaatttttgcaacctattgggagatcaaaaaggaattggaaaattcctaaggtaaggtttgtatatttggcaattttgccaaagaacagaacacattccaatatcctgccagagaatcagacaagctttagggaatgtattctcagatagttaacaagtccacaaattctggtgtctccgtgacaggaggatttaggatctaatgactccaattgttttttactatatagtctaccaattacatatttatttgcttaaaaaagtaacttttcaaaactagatttgtttccaggaaaatataaacccatcaaccttgtacctcttgctatgaattattcactcaccagcttcagactattttctgctcctaagcaaagaataagatatgtattgcctcatatgaccctgaagttccttctatggcctgtaggaaccatacaagttattggcatttaaaatcatattttgattactggtttttctgctaatctggtagaatcataaaataatttgacataaacacagtactttgcttagaatttggggcatattttaagtctaacatgaaccctaggctaagaaattatcaccatggcattgtaccaaaaatcatgtttcccatttctagaaacactcctcattcatgtttgtccttctttcaccaacccttctttcacctacttgtggtcttggtgttaagatgttggagtattcccaccgtgtgattctctgcttctcccaaataccttttgtcttcccagagatataaacaaaataccatgcttccaataaaagacaattttgaataaatcttttaaactatcacaacattttacaaaaaagaaaattcaggccaaaggtcacatggttatttagagaaagacacatatttaagatataaaactaaccactgaagtaaattgtccttctattatgtaattttgtgtcactgggaatatagttggattcttcctctttaatattattcttagagcattattagcatctgtcagtggcataatctttattgcagggatcttagagtcaccattgtcaaaatttgtaagattctgagcttctcttagtgttctcagaagtgaatgattgaaataaaattgagatataaattctatttagtgagttatctgacaggaggtaggaactgaactagaaatttatttttttaatgagggtgtgtagaagagaaagagacagtttggaaacaaggtaatttattgaggtagaactgaaaaactttccactaaagcactctttggatgctcaagggaagtgtaaggatgttagggagtacatggtaaaaataagcacattttcccaatttattgtacaaattgatctggagctttggaggtgaagccactgaaatgccactaggaataatcttgtagcatgctactgttggtggtcaaacccattactagcaaactgaaggaataatcacattttggcaaatgtataaacttgaatgagtcagagtttttcaaatgtgtaaaaatgaaatcatttaaatccaaatttgtatagctcatggctggcttatattgatgatcttaggcagtcctgtttcttacatagaatgacttgttagttgagttgaggctgtaatcttacacttaccatgatgcctgacttaatgggtaaataaccagtggagtgacacaggaccctgaactctgagtgggacctcatacctggggcttaatgctctccagtggccatcttgaagtgcttaaaaattttatctttgagttggttttgtaagcaaagtctgataggacaacagagcatgtgctgaaggcatctgcttatgttagtttctttacatataccaatatatagtttctttcagatatacctatatatgtatatatgtgtggttctgcctcacaccaatttgccacccagaataggttcttagtgaccatcttctccattcatacccgaagaccactgtagcccaaagcactcagcagaggtatagggaaattgagatcaggatgtgcttgccccaagtgtggatttgcggggcatgcctgtgatggtctgtacaaactgagtatccctgtgcccaggagagttcaacattaaatagcgtatatttaccatgcaagaaagaaaataaataccatactacaaaatgtttttttctgatctttgaacaaagagtgtcacactacatttggcactgggcctacctaggaaattatgcagttggccctgcttgccattggaacaatgtaacagcaatttattgttttcaaaatctttagactaacaattgaatatcttagatgctttaatttaattggcatagagtagcatatggaattgtagtttattccctttttttagctaaacatgttgcaaatctttccttttattatttcagaagagacacacaagttacattatggttcaagatcctaagtccaaagttactaaggaaattaacatgctcattttctctatgttccaacctctgtgaacaatagaacaactacagaaatgaaagatgtaacattcctttgaaaaaatccaaacaacatacatttaaaaaaatgtccaactactgttttatgtacctcagaaaagggactctgct

SEQ ID NO: 245 - DNA, 497034 bp, Homo sapiens
ttttttagtagaggtggggtttctccatgttgagactggtctcgaactcctgacctcaggtgatccgcctgcctcagcctcccaaagtgctgggattataggcgtgagccaccgtgcccagcccctctttttttttttaaattagattttaaacttattcatgttgcctaactgaaactctgtaccctttgactaacatctgtctgcatcccctaccccttgttcctggtaaccattgctctactctctgcttccatgaatttgacttttttagattccacacataagtgagatcacacagtatttgtctttctgtgcctggcttatttcatttagcataatatcctctgagttcatccatgctgttgcaaatgacagaatttcctttttttcaaaggctaagtagtcttccatttatatagacaccaattttctttatccatttatctattgctgggcactaaggtggattccatacgttagtttttgtgaataatgctacaataaacaagggagcgcagatatctctttggtatgcgtctttcctaatgcatgaaacaagatctagtggcagatctaataattaaggtaatttagaagcacttatcactcagaaatcataacaactgtaatgtgataggaaaatatctgatttccattggtcacagagtcacaaatactacaaatgctactgtaggttgctgcctcctatctccacccccatttaagctcacgaacctcttgagtcctagccaaactcttcaggttaagaagctcttctttgtaagaggacctgagcagaggttagagggtgatacttaaccttccatcctgtgtctgttgctaggactacactttaattctacatttttcttgtccgggtaccacctttattggaacactttttttttttcttttttgagacggagtctctgtcacccaggctggagtgcagtggcacgatctcggctcactgcaacctccgcctctcgggttcacgcgattctcctgcctcagcctcccgagtagctgggattacaggcgcccgctaccatgctcagctattttatttttgtatttttagtagagacggggtttcactatgttggccaggctggtcttgaactcctgaccctgtgatccgcccgcctcagcctcccaaagtgccgggattacaggcatgagccactgcacccgaccgggacactttttaaaagcaaagctgtttaaaatgcaatcttttaaaatgtcttaaatttgaaagaattgtaaatgcacagggttgaaataatcaaacaataacattaaaaataaattgaactgaaaaataaatctcctttccatctgaattttgccatcccctttcccagagataagcactcttactagtttcttctaaatttttttcctacatcagccattgctctcagttctcaacagtagaacttgacagcagaaaaggaggttacacagtagctcccagaatcggctgaaggctgggacacaggctccatcaggaaccaatggaacagtgatgtgaggcacagccaaaagcaaccatagggcaattctgcttgggctgctgctgctgggcccactcaccagtctccggatgcccctcagtgatcccgaggcccaggaaaagtccttcaatgctgccatgccttttggtccttctctcaagagtcaagattctgagctagagcatctggttattaggcacattctagttgtcaggggcagggagagggaacatcccttcctcttcagtttccatggatttggattctgggaagccaaaatgataactgttcatttgatttattgaaaaaaaaaatacacacacataaatagatttgcttattttttttttaaacaaatgggagagttctttaaatgctggtctgcctcttgatttttttttaacttaatgaaatatcagcaatatatcttgaacatttttcagtaccagtgcatatagatctactttgttctttttcctggctccattgtattccactgtattgaaggctggaatttatttcaccaccctagagagtcttccaaatccagcctggccaggcaatgcttctggcagtagaactgctaattctgtcttgctgttcttaggccaacattgaccacagactctgtcctgggttgcaaaagggtgattgtagcagataatgttggtgtcctgcccacctctgttaccacttcattgcaactgggcttgacttaccattgctgttcttgtacttatttgtcttagggctttctgtgatgatcagagtctgctttgcccatctgccctgcaagtctgaaatgctggaaaattaacattgcctgccctctcccccaatctgtcctcaaccaataatgaaaaagagttggagtataaataccccagctctctcactcctcaggaggaataactgaaaagtatgttctaccctggctcccagattttcccagagcaatcaaacttcagttacccatagtggctgccttgcttctcaatctttttcccccattcctctattagtgtttcctggatcacctcccaagtaaaccacttgcactagaattcttttcttagggtctatttctagggaaacacaaatgaaagcagtgatgatgaagaaggggagacatggaaagaaactcatttatttattcattcctttaataattatttactgagatccatagtcaaagacaagtaaaggagaatgtgaagaaatgtagacaaggggaacaaatgcttccctttcaaggcataaaagcaaacgctaaaaaatgaagtgggtagcaagaatacctttcttgacactgcttaacacattgctgcccaatccaccactgatcatgtgctgttcctttgggaagaaatggaataagaacggtgagtagcagaattcagctttctaagcgtagtgacttggccatatctatcatctgttcaaagcctgaaacatgtggcaggctcttaaatccttaagaaattaacagtaggccaggcgcagtggctcacgcctgtaatcccaacacttcgggagccaggcaggtggatcactttaggtcaggagtttgagaccagcctgatcaacatggtgaaaccccatctctactaaaaatacaaaattagacaagcatggtggagggcacctgtaatcacaggtacttgggaggctgaggcaggagaatcacttaaatctgggaggcagagtttgcagtgagctgagatcatgccactgcactccaacctgggcaacagagtgagactctgtctcaagaaaaaaaaaaaaaaagagaaagaaattaacagtaaaatattagctaacatttgttgagcacttagcatgtgtgccttttttttttttttagcacttcacacatagaaatacatttaatcttgatgacaacctgatgagcttataacaatgggtaatacctagggtatgattctatttatatcttacagatgagataactgaggcctagggaaatgaagtaattttcccaaggtcatgtggctaatgattaccactgatcatctgaaatctggatcaaggtcatcctgaccccagaacctatgagaacctatgctcacaacctcttccttctattcactcctgtgatacctgttgcccaatggtctacaaatcctgtggtctcttgctttcatctttacttcaatattttaaatagagtggtttgagctccatcctttgtaataacaagatctagccctccttattctcagagatcatctttctctaatttactgggagaggaatgagtgcttgtttcaagatcaactcctaagtctctagttccacctctgccctcagttcactttgtgaaagtttcttccctaggacagcaccaacttttccttgtgctctccaagagaatattaacccaagactgtgtgtatagcagccttgttacggaagtttgaagatgacaaagagtagatgcaacctgaagtttattaattgtcatttaattagggctcggaagagttcagattttccaaatacattgtgatgtcagtacccttcatatgccctggaatttttaatctataatcttgatgtcttattttaaaaattttattcaaagttagactaattgaaccaaaaaatactatggaggaatttttcatgctcaaaaccctattccaggaggtgttggaggcgactgagtgaggtgcatagttcagtggtcctgtttacaatgtagtgacattagaatttgaaacctagccatagcttccacataaactgtacttttcattgcaccaaataccaccagtatttgtcttcttatgttgcctttgattttcttttaaacacgttccaaaatttctgacactttctctgaaatttgtactatctttaatcacatgtttcctgctttaagcaaagccttgtttattctttgcaattgtattcactgcccaggaaacaagccaacttgtttttgatggacagagggaaatatgccaactgaaccatgtttacaattgcttttggccatctcaccatcaattcttaggaaataagaaaaattttatttgtgtactttttgcttgtcgcctttgcattcctcttaatttgtagttgtgtgtatgtattaattgtaatcgttttatccctccgttagctggtggctgtgattaatttgttgttcagtgtttttctttgaccttcaatgtactgtcagggtagagaactctgctggcagattgcaccatcgtcagcccttttctcatgttttgcttagttacaacaaatgctgatttacaactttagatgaaatgcatggtttcataagaaggaaaacagatgataattttagtatttaaatgaagaagcaaaacaaccttgaataaaagatgaatattgatttttaaaaatttgtttaccaagaattacagaattgtgcctcatttgacttaatttcagacttgttaattatgtgtctaagttagccacaaagagaacacacttattttaaattttaaaatttaaaggaaatgaacttattcaattttgtgcttaaacactagtcatacaactcttgtagttttgttgatttcctaaaatttttatagaaattcaaatttatgacagtatggttgttcatacctgcattgaaaattcaggtgaggtcaatagattttctaaagccatcgtgattccccatcttctttgtaattccttctttatagacagaatatattgcaataaatttagtttatgttttcttggtcatgatcatactcaggtgtatattgctgatgtgcacccattcaattcaaccaacatttattgagtgcctactacatgcaaggcaccagactggcatacagaaatggatacacagtgcctgacctcaactagttggcagtagtctagcagggagacagacacataaacagataactgtgatatagtgcagttagactgggattggatttggggtgtttcagaaattctttagtcacacattttcaaacagtcttttgggtcacttccacagatggctcatttcctccattatgttttgatccatcctaatttcatcctagattttcagtttatcttattttgctcctgtttcttctttgaccagaaaatctccttaaatacattacacccattaccaaagtactggtctatatgtggtctatatggtctatatggaaagtctatatgtgcagaggtacaaatgatcctatctatactgataaatggaaaatgtgatttgccaaatagtaggctcaggatgattctcatttatatattgggatcatttatatatatataaaatctccaatatacttgtatatgatttgaacatatttggaagaatatatgcccatctgttagcaatggctactttggggaaatgggtgttgggggggggaggcttgaacgttttgtttcatataattctgttctatttgattttttttaacttaaaaaatttctttaaatgttttgaaaaaattaaaaatagtagttagttcttggctatgcagaccaacaaacccaaactaagtggaactaaatgtcctcctttgacacttcaatctactcttcccatgacaatctctcccaacctcttgcctaagccttcccacgaagcaggctctcttaacacactgggcatattcattaatgtcttaagttaacatgtatatgttgagtgtttactatatgcactgggaatccaccagagaagagaatagtttcccatttctatgttccagccaagtggcacatcccctggcctccccatggtcttgttcttgtccttcccaatcctctttatgggctctttaaggcccatctcctcaaggaagccttcctttccttctccctcctctgagtcttataatatttagtttgtgtctttggaagattcatactacctatactataagttctacgagaatagcaacagatcatctccatccttgtactttcagccttcattattagtcatatatttattgagtaccttggggacagagtggggaagctggtatagcctgtaccctcctgaagtagagaaaagatatatgaaacatgtaacagtgtacataacccattcaggagtagtgtgaatgctaagaaggagaagtagatactgttatgaggatatatactaaggaaatagatgctgaactgagggtggtgtttggaaaggcttccttggggagatccagtttagtggggatttgatggatgagatgaggttgttcggaggtgggccccaggtgggaagaactacggtgcacagcaggaagttgaaggtggtgggtgtggatgaaccctgggaataagaggagtagagttaacagaagaggctggagaagtaggcaagggttggattgttcatggccttgaatgccaccttaaggaatttgggtttcattctaaggagaggagaacaattggaggcttttaattagaggaggaacgggatcacacttgcctttagaaaggtctctctggctaatgaagggaaatggaatagaaagaatccaggtgttcctagcacagtgcctgcctgaccagtatgtactcaagtatttgtggaccaattgttcataaagtgaacgcctatcaggttcacaatttccttgatagttcctacatctaactggcactttttcctgtggtctcttccttatcagccttcaaatagctctaaatttttccacttattaaaaaaaaaaaaaaaagaaaaaaaaagacttaaacaggcacttcacaaaagaggctatctaaataaaaaatgtacttagctctcctccagggctcctgaacattttcctacttgtgctaacttttatacactggacagatgctccctcttttactttgcatgttttaaaaagacttaaactggcacttcacaaaagaggctagctaaattaccaatacacatgttcaaaggcaatcaacttcatttggtaactagtgaactacaattataaaccaccacagcacttaccagaatggcaaaaattagagtgacaacacttaatgttgtcaaaaatgtggaacaacggagactttaacttgctgctggtgtgagcataactttgttcatcctctgtggaaaactggccacatcttctgaaaaggaaaatacctttactccaggacccagcaattgcaccaaaacatatgtacaaggaaattcatggcagcattattcataatagtcgaaaatgtaaaacaacatttttatatggataaatcaattatggtctatttataccttggactactatacagcaatgaaaataaatgaaccaaaattacaccaacaatgtaatgtagcgtaaaagaatccagacacgaaagaatatgtactgtgattgcaatgacaaaaaggttaaaataggcaagttggtattctatgccattagaaatcagatggtggttacctttggggtgtaaggagtgggtagagtttgggaaagggcatggacatagggtcctcgggggtcttcagtatgttctatttctcagctaggtagttgttccatgagtgtgttcactttaggataaatcattgagctgtaggcttagaattcatgcacttttctgtatgtataataaaaaactaaaaaagaaaaaagacgatcactcaagataccatcccaaagaaacaaaaaggaacatcaaagctgtcttcttgactttgcatttgtggtcagaataaactgaggccagcagtggtcaaggataacatggtcggtgctttctgatgtgttctgatgtcatttccttacccataacccctttcctagggttgctgggggtactattttacaggatcctcagtgcaaggcagtggaatctttttttgaaggaatttttaaatttaaccttggttttggagacaaagtcttttctggcttagttttcctcatgacttttacatcgtgccctttggttagttatctaacccattcacttagccttcctccagggctcctgaacattttcgttcttttgctaactttcacacactagacagacattccctctttactttgcatgttttaaaattgtaggccgggtgcggtggctcacacctataatctcagcactttggggccgatgtgggctgatcacaaggtcaggagtttgagaccagtctggctaacatagtgaaaccccgtctctactaaaaatacacaaattagctgggcatggtggcacacacctgtagttccagctacttgggaggctgaggcaagataatcgcttgaacctgggaggtggaggttgcggtgagtggagatcgcgccactgcactctagcctggcgacagagagagactccatctcaaaaaaaaaaaaaaaagataaaaaaattttaattgttacaagatatatgatttcattttgcaactcaaaatataataaaaatatgttttaaaaaatcttggctgtgccattctgacttaactgtctatccctgggcaatcaaagttttgtcatacctgaaagacatatccccaccatttgtattaatagttttattctctaatttctggattaatgcttctgcatagagttaactattgggcaagttagcgcaacccttttgaacttaatttcctaatctataatgaggataacaatagttctctcctcttatggtggttgtgagatttaaatgaggtaatacatgcagaatgcctggcatagcatagttgctcaataaataggacctctttttgtaagcccacaaaggcagaaagtactgttgccttgtacctgcaggcctcaagtaagcagagcaagacatgttgtctaaagtggttgttttgtagaggacaactggcgaccgttctacctggtcctattggaaaagtagctgtttccctaaagcctcagtcagcttccaggaaagatcagcctggtttagtgacagatgcaaataaagcaaacaaggctacaaaatgtttaatttcttacaaacctaggtgattatattgctgacagggcctgaggagcaagtagactactccatatcttagggaatcttttaaaatgctttaacaaatatataagaatcatatataattggcacacactttgtttgaatgcaaacactgctgttaaagtggtgcttaaaaacagtttgttggccttctcttcgtacaggagaaacatttctctcgtttacactacttacttgcttagcaaacccttatttatcctataatgcaagtgtaatctgtccaacatgtccaaatgcccacgggttctgaattagtggagtctgaattaacggaattttaggcagtctctcatggagaactacgagcatttgaaaacgacccactccaacagtttcaagaacactctacaaaaattacctcttccctcccctttcctatttcttcttgttgtgtttcagttctggcattcaaagtagacagaggaagacagacccaaacgtatattcttaggacatctgaatatttattgagaagccacagttttccacacttccataactgtaggctttatataaggcaaaagcaagatggatccactactttacatggaaagaaatagctctgcagcaaaccccagggttgtgcagttacagatcaaaatgcaatgtacatgacagatataaaaaacagtgtggaacaaaataatttaaattatggttacaatctactgaaggaaatatccacatcttattataaacacatttttagtctagggttgtaatttaaatattcattttttttacatacacagttgagacgtaaaagcaaaataacatttaagaggagaaaactttgacagaagacagtagttttgaactgcgcgcttgatgttaagtcatgataggatcgcccccttgccgtggcaattaagagaatcaatccattggtatgtagccatccttttttttttggctaattatatgagtaaatgaaaggatgggttaacaacgacacaaggggttcattttttggttttaggggaacagaaagcatcaaaagttaattgttggagacttgccttttgtttttcaaaaaataaaaataaaaacacaaagcagatctatgtgttttaattaatttatttacgtactcatttaattaactggcatccacatacgtgaaacagagtgaatgtacttgatgtacttgccctcacatccatttaccaccaatgcatacatagtacatgaatgaagcatcattgatctttgctgataacagggacacgcctagtggttagactatgtattctccatgaacagtatttaaagaatggtgctccatattgcttgtaaacatatagacatggacatcaggaaatcagtggatatgaaggtcatttgctaatcttggtaccacatagctaaaatggcagttgtattgataaacatctcatgggcatggtagttgacagaaaattcctaatgggtttaactaacagactaaggacatgcactgattacaggactctgtcccagcagactctaggaccaaatggtctaatcgtcttcttcgtcttcctcatcgctgtccttcatgctgatgccctgcagtcccccaccttcactcactgatgctgtggcttcctccacagtgagacggttccggatcgtttcataggtcttgctgtttaaggtggagtccaggaccccttgcaatcggaaatctctgtaggttttctaaggaaggaaaagatacagtgataagagagatctcatctccatgatggggagggagaaggtaaaagcaggtgtgggtgggagagcactgaccttcagctaaatatcacactttatgcattgtcaaataaaaagccactgtgcttagatttcacttgtattgaaaactgagatcctttgaatgacagaaaatgagaaatagtgacaggataaactatattagatgagacaaagcaaagaacataagcttgtgtttattcagttccataaagggaaatgttccataattgttttggttcctttttgtggactggttctttctcttaggttagtgtaatgtaatatgatagacacaggaaggggctataatatataaataatggattgagtgattatggtattttgtgatttctgttgcagtcttgttttagtatttttgagtcttgtaactgcataagctgtactgatatccctctgtctcattcataagacagacatatgtatgttggtatatgaaacctattacaggcagtggcaattatgagaaagatggagcgctaatgcctcatcaatatgttgcagacatgtgactcatttcttctctccttgggaaagaactgtatctattctgttcacaactttatggtctcagggaagaaatttggctctttttcaagaacaatggcttggtattactgcaccacaagttctttctttgttccttcaggcagtttctctcagatttccttaggtatctcaaggactgtttttctagaaatccttcagtgttaattgaatatgaccagaagcatctggctgttgtctactttgtaattttttttttgtttttttaaaaggtctctaactacaactctcctcatcacactgcatatcatttcagctactgattctgctgtttgtttctcctattgatataggaaacttgctaaaggggcaagacaaggaatgctaacatacgtcaacaccactcccatcattctttctttttttttttctttttttttttttttcaagatggcatcttgctctgtcacccaggctggagtgcagcagatcgatctcggctcactgcaacctccaccccctgggttcaaacgattctcctgcctcagcctcctgagtagctgggattataggtgcccgccaccatgcccaactaatttttgtatttttagtagagacagggtttcaccatgttggccaggatggtcttgatctcctgaccttgtgatccacccgccttggcctcccaaagtgctgagattacgggcgtgagccatcgtgcccggcccattatttctatttttaatagtccatctaatgcggtcatgatagcaacaatcacaatgtcaacccctcttgaaggtcacatgttgtaatgactacagagttaatgagtgaacccagttcagcttactgaagtccaataacaaaaaagtaatctggtttgacattaaattataaggttatcctcaatcatgcatcaacctgcaagtcttgctgagaggaggaagctagacagctacctgaactgtgttttcactttgatggggacgggtaagagactgaataaatgttaggcatggtgtgggccagatatctacacaattaacttaaatttttgtacttttcaatcatttgttctgttgccacttagaataacataattgttgccagaatatgatgggggaaaataaaggtaaaaagcatttgagcattctcccttttattcaaattccatagcaacgtgtataccaactagactctcaatgcctaagtgcagagaccacatctagtcatttctgaatcctccatctggtaatatacaagtagaggcccacctaatatttatccaatgttgaatgaataaataaatgcttgctgaataataaatgaatgggtgaataaatgaagtggctgttgatgcaagaaagaaagccaattatccttggaaatttgccctggaggaggaggcctctgggtgatgttcttggtttaaagtttgtgaattctgcttcatagctctgagttgtggcattagttaagctgaacccactttttgctaaagtgaaggggttcctttggcagtgacttttctatatcccttctctgtggctcataccacatttttttttttttgttttggcaaaaggctaagattaaacctcccctctgacttatatttttccttcataaaatattgttaatttccaacaccaatctggaaatagaaataatgggaagataatttttaagtatgacaattatatcttcttttcatgtctacccaataagggtcaaacagacaatttccccaaagtgcatttatgcacagaaaatggaattcaagtggtcaggcgaccacttgacgattgagctggtcctaaggaactgaagtaaaaaaatgtgaaaatgaggctgggtccatagtctaagtgtatacattcgttttttaagagctgtaatacactgctgtctataacctttcccgggtggatgctttgtgagatcaaatgcagataataataattctccttaattacacacaacggaacagcagttggttgtaagtcagcactggggtaaagtgaaatggtgctgatccaaaagagactaagaaacggggtgggggcggggggggggggtgcccaggagtgggtgttgcagggacttttggcaaactgttaagaaatagacattcagctacatttattgttaaaatattttaaaggactttgtgctttgaatgagatttttgcatacaaatgttttaaaaccctctatggtgaagcatcaaatagaaactgaaatgatcaaaaatgtatttacccccttctgtgatcttattatttcatgtaaaccactgagatttcacgctgaaataattatcattagtccaaggtgcacacacaagaacaagggaaaaagctactttcagggtatgttatctcacctttgtgatcctttacatttgattgtatacacgcattgtaagacgaactacttcaattaactatgagaacaatattgatttgcattctgataatgatcacaggacatatttagaaatagctgggggtaaatatttctattaaattaatagcggcaacattttatttaattaaactataaatgaaattggtaatggatgtgattaacataatgacaccaaaagccagtttttgaaagtctaatgcaaaggacacgatggcctctgccgtatttttgtatggcaaaaccaagtatttttcctctctggaaaaagatatcaaattcatttgtattaaatttccctttgctgtctgagtaacacatttatcatgcatcacaaaacaattgcataggtttttcttgtatgagatactattttatatgtaaactaatattctttgtgttaagcaagctttgcagcttgccagtgaaatatatttcagtaagctatttgcaaagaagaataataatcttttcttttacctttaccatcctaattagtgttttcaactgataaatatgaagctgtaagtccatccggtccgtcaaccaggtgcagatcacgttcatggagctgttgtaccattgctgaaaaaagagacaaaagttctccagccaacacatcatggagcatttatagggcagagagagagcaggcaatgtttgagtaccccactctgttccaggaggaaacaaaatggttaaagagaatttgagagcatagagtttaatgaacgttagttagtttatacaaaattgcaaggtactgggtactggaccaatccaagacagacaatctaagacagttaggacttcgaatctaattgaactcttccacgacagacatttcctatgtttcaattcatacagaccatcttttgctcttctgattctcttttttattggttaattttacaccatttatattcaatacattaattatttcctaatgtcactgtctttggtgccagagagatgagggcttctccactggattaattgatgttccttgccacttaccgtttgaaaattccacaccctgtctgctaagtacaatactggaaattgggctgagagccttaggaatttaggggcaagtttatcttcatttacctgattgaggagtgctgataaagacaatgaatgaaaatttctctttaagggccaaactgtactctgggcagcttatgtgcccttatattggctgtgcaatctgttttaatcttaacaccaaaaaattatggaagatgagagaaaaaaaaaccatctacaaatgagctcatttcaagctgttgaaatcatacttccccttaagggggttaaattttgcttcttgtctgtgaaaaatgcttgaagctgtgtcactttagactgccacccctgtggtgcaggaagtctctggtgcagtataattttgcagtactgctcatatattcataaatctcactcggagacatatgaacagtgttatgaagtgtcagtataaaaaaaaatctaatcttttaaacttcaccaggtttcattacgctctgccgcttataccaaacaatttacaaataaaatgaaaaggtgtggatggacctatatatttatttataggggatctatatgaactgtgcacagaaaagatgcaaaaaagaaagaaatggttagagaattgagatgatgcatactctcacgctaaccaatacacacgcacatgcacgcgcgcgcacacacacatcgcacaccagtggggattcgaaaagcataaataaaaacatgtttctgatggtaactccaccctttctcacctaaagatcatccaaaatcagtttatgcctaacactcacagtttttccgaagccttgtttctgacttaatttcttttaaaaaaattaatttaggtttttacttgcaaggtagaactgccaagtttcaccttgcaagaaacgacacagtctcagccatggcgtacagaagccctctttgcaatctttcatttctaggctccttcctcatcagagccaattgtggctctccttggagcccagccgcaacagagaccacactaccccaatcgaggcagcactgcagcctcacagccagcttctgctcttttaaagatcatggaggcgaaactgtcagttttaggaaccttctgtccctccccagggagcaggaggggtaggaagtagattttttttttttttttttttttttggagatttgcagttcactccatggaggcagggtgtttgctggggtcaagctgcttcaggcatggacaggttttcccctctaggggtgagaacattttactgaaaattttttttgttaatggttgttggggggtgtttttggcacctcctgccttgggattctggagcttttgctgtcactgcatctgggcttgttaagaaggggcccagggacagggtgatcactgggtcactggtattctggcagccctaccttactcctggcaactggagggctctcttgtgctaaccccaggcctcaaattccacatttactggttgtagctgacatgtaatctggggggggggggggctcaacagatctattttgagaactatgatgaacctccccttacccccagcctcctgggattggaagatgaccttcgagcaatcctggcaaactcctggccaaacctacaattccagggcctcatgaggggtacatctcagggacacaaaagaggagtgtggcactctggcttctaggcagaggtggcattttgctttggctgtgacaacaggcaaaccggcgctggcttatatcactgccagcaagccttgtgcaacatgcctttttctctttgctgagagacgtgccacctttcaggaaaaaaaaaaaaaaaataaaataacgcaaccccctgccgcccctccattttatgtaagcagttcccactcttgtaaatggcttctagtagtaaaaaataaaaataaaaataaaaaggtaggagactatcaacaatcttgctcggctgccgaaaggatagggaggtagaaattgcatacagcaatgaatcagtgcatcacacgcagcctcccaccccaggagaacaagaaagccctggaacatccatgctttccttcctggatctcacatctagcaaaagaagtgtaaaaaatgtatgatgccccattggctacacatttaaagaggcaaaagggagtaagtcactcctttccaaaccttatgctcaggagatgaaattggaggcacttttggatgcagcacagtgctaacttggttttccagaaaggcgcttcaaggcatttggatgtcggaaaaaacaggaggcaatgccttctagaactttaaaatgttagaggtacaggggatcttccacgttatctgttgtagaggaggaaacaaaggcccagagaggtgaagtgacttgccaatgtcacacagtgagtgcctccggaagcagcagctctccaagatagccacagcattgaaagagcggactgtcttccgttcctcctccctaagggatggagcagtgtgtttgccggtcatgacagccgatcttgcacatctcttcccgaatccgcgttcagggatatcacattgatagctagaaataggccttcgtgggggattttttcatcatgggaattggcaaatgccacaaaccagggctttctccctcccagaaagccagtcattaaacatttatcagcacaatccttggtgtctgggttgttctgctcttcctcacggggctcacagtgcttattaatcgggtttgctttatttgagatggatgggaatgcagcagatttgttatgatcttcaaaggaggaaattaataaaatattttaagtgctccctattttgtttagtccttggttcagatatgccttttccagagctaccctaacacctgggcactaacttttcggtaaaatatactctaagtctgtagaaataagaattgtgggctgacgacatgtactaagtatttaagtataatttctactcctttactgcctccctttaattcaaatatattaatttgaaacttgctaaataaagctactttaatcctaaaacacagcactaaagaaataaagcccccaacagcctgggcacctttaaaatatgccctctggggaaaattctgtgaaggttttgaacttgtcacccaaaaggatgcccatcatagacaacagggcccttggaaaggtgggaacttcttcagcagctgaactggatctgaaggctctatttaaaagaagctggaaggcttatctaaaaatttgccacttaattcttctttctacagtgtagtggttaagagcacaggctctaacatccacctgggtttgtgatcttgggcaagttacttatgttctcagagactcggtttcctgatgaaaatggggactaactagccttttataggctttttctgatgggtaaatgaaatcatgctcataaagcactcacaacagcatttggcacatgataaggcctcaataaatgttagctaccaccacctccaccactgcaatcaacatcatcatcatcatcatcatcatcatcatctttcttctcttttttctctccctctctcaacctaaaagattcccaaaaacaagggagaaagtggaacacgttaccagggaaagtcatgtggtggtgaagaaaattattcccattggaatatttctggaattgtatgcatgccttataggacacacaagtagccccttaaccatgcaattgtgttgtaaagttttttctggtagatcatcacccaaactttgggttcataaagcacattttaaactatattgacctagatttacgtcttgaattaaaaagattcagacacagaatgagtgatttctcaaaccctgtggggtgagttacagcttcaccttacactggctacttattagctgggtaacctcaaggaaattacttaattctctgatcctcagtctccttttggggttaataccagtactctcttcatgggattactgtgagcattaaaagaaatcatgtatgtggagggcctagcagagtgagtgtcacatagtaaggactcaataaaatttacccactgttgttattcctctcagaaacatcatggatatactttctttttgtttgtttttctttttttgagacagagtcttgctctgtgttcaggctggagtgcagtggcatgatcttggctcactgcaacctctgtctcccaggttcaagtgattctcctgcctcagcctcctgagtagctgggactacaggtacaagccaccatgtccggctaattttttgtacttttactagagatggggttttgccatgttggccaggctggtcttgaacccctgacctcaggtgatctgcccatcttggcttcccaaagtgctgggattacaggtgtgagccactgcccctggcccatggacatactttcaatatgtgacagaaagacatttttttgatcctccctttctagtaagaagcttagatcattaatatgcagatacacttgggtcacccattctgccctgcaaacatactgacttcatgtagagaaatccttaaacataaaatatttattctctaacattcgggttcaccaaggccaggattagggtgagggagtagggcagggttgtacaagtgcaggatcagatcttgtctttaatgaaaattttgatatttcagtcatcatggattttttgcactaattttgattttataaaaatgttgtattaaaatgttatttatcttggttactatattttttggttctcccttaaattttgtgatagaaaagttgctcacttacctcttcctagccctgctcttgggttcactgttcccctggaaactttaccccctggaagggattaggcttgagacagaagatgggtaattaacaccttactggacattataggattcacagaaaatgggctttcatttaactctggatactatctaatcagctatatagagtgttgctacaatgattgctactgcggttatgtcttctgtcatgatagccactctcatttacatgagtcttaattcctgacccccaacatcttgatgttaatttgatatcctacaaagacattactgttaatggtacatttgttttcagaacaagccatatatcacagatgagtggcagtggaaacaaggagtagtggctgagaggagatagaaccactgactgtattttcatactcaattgtcacaagagtaatttatccctttaacttacacaaacccctgtcagaccagacaactccgtaggactttagagtctactgttttcagcaaagtactattttgtacaggattcctaatatacacccatatgcactcacgtgcatgtacaattcataagaatagttgcctactcattgaacatggagcccttataatgttcaggcactacacgaaatatactacaagcattatatagtttaatcattgacttgaactcaagatgttgatactattaacagtcttgctttgtagatgagagaaaagggcatagataggttacataagcagcctatggtcacacaactagtaagtggtgggacaagtttcaagttggttatttaccactaaatctgtataaaagttgtttgcattcaacttggtactttatagaagtaatggattggttacacagaaacagctctagtcctaggtgtccctaaagcaaattcattcagctttgaagttctcaaagaagtgtgtgggtaggacaacgctgttgaaactgtttctcttagagcctgagcttggcttggtgtcggaaagattctacattttatgaagatagaaagttgctaagcagagtgtggggactcgggggcatccccatggaaaaccactcaacagccttaagaactgatggatgagagacaatcattgctgactcttaagggaaatgataagaaaaaggtgaatgagtccgaaggctaccatttcttgactagcattgacataatttttcttgtcccctatcatcctacctcctcttctattttaggttggtaactcatcaattgctagtggaagaaactagaaaagtttccttcatcacaatgattgaatattcctaacagagttttagagatacaaaagctataacgttgatcaaaatttctgaaaaattacatatcataggctttacaatttttagtgaataaggagagcaaaatggtagagccttttcatgtcaggggaaaaaactgtctcatgtgaaattaaagatgtcatcaggaagcactagaagagaagaattttaggcaaagtcacaaatccagtgaaaatagtctaatccaaactcggttcttcctgtgttgcttttttcttcacaggaaaattttattgaagtataacacacatactgtagtaaatcacttttagcaacacacacacatacatatatacacacacacatactcccaacaagatatgttaccccatgcctgtaagtgagggaaatatttcacccaatatcataaaaatgagctctttaaaaaaataatggcctaagaacaaataaccataccatgcagaaacacacaccttcacacaccttctttgattgaaaacttgtgactcagtccaatatatctccatcctgagtgatagttgaaatccactaggaactgagttctattgttagttcttttctaaacatgtattcctttgaaactggcatgttcaagccatctatattaggaaagcaaagcattaaatgcctgggcagttcatgtctaaattctaaacagtgctgtggctgaatctttatcatcatccatagtttcacttcacagatgaggaaactgagactcagaagtaaagtggtctagcagctagcaagagatggaacatcgacttaaaattctgagaggcagtgcaacctgtggctaagaaaatgcacgtgactcagaccacttgtgtttggatcctgacaaattcctaacaccgctgtgcctcagttttttcatctggtaagtggagataataataaaacctacttaggattaaatgagttatttaggtgctgagtgcttataacagtgccaggcacatcctaagtactgggtattattatctgagccatgttgtcctaacctgcttcccaaataagaaatcacaactccttgagtgtgaactactcagggttgtacaaaactttctgagcagcaggccaagcacagtggctcacagtgcctgtaatcccagcactttgggaggctaaagtgggaggatcacctgaagccaggagtttgagaccagcctgagcaacacagtgagacaccgtctctacaaaaaatttaaaaattagccaagtatggtggtgtgtgcctgtagtcctagctactcaggaggctgaggtgggagggttgcttgagcccaggggtttggggttccagtgctatgattgtgccactgtactccagcctggggaacagagcaaacccctgtctctgaaaaaacaaacaaacaaacaaacaaaccccacctttttgagcagcttctgtttttctaaaaatgcctgagcaagcaggcaatttggtaactgtttggtaaccaatcggtgtttttgaactgaatgctggaggatttttatattttctctggaaagttccctttctctaacccaacacagccacacctcagagaaactggcacagcatcttgcctagaggggctaatgaaataacattttgtttgttggcaaggagtcaaagaggaagataatactttgaccacgcccatgtgactaagttcttcattttgtttttggtgacaaaagtgaactattatttaagggaaaaaacccctacaacctatttcaattgctatattgaaatactgtaatgaaatattttatgtttgaagctttcaatgcgtatttcttccttacaatttgggtaatttaagaacatgggaaaagcatcattcagggtttctttacacttccaccaaagtccctgtagcttcattagcctaagccaaaattccacagccccctgggtctctcaggtctaacgattaccggggatctggttgtatttggtgttctaatcaaagattcacagagggtctgacaaagaaaccctggcacgttcaagccgtctatgccaagtgggcaaagcactaaaggacggcacgcagttcatagcaagtttccagatttgtcaaagcttcccaagggctgaacaaatactttctaaaagggcatatcctccaaatgcgttcaagaaccagtatgccgttgaaagatacaatcttctgccttacttgagtgttgctataattcaggattcacccttcaaaacaactgctcttagaaatgggtatttcccagtcacagcttcaggacgcgcagctaacagcacaaagctataatcagacaccaaagctataatcagacaccgaagctctaaacagacaccaaaatcagagggtacagataatcagaatgaccttctcagctgccctaagtgtcatttttagttgagggtaggattttttttttttttttttaacgtccgtaattctttggatacctgaaaacccatgccactgaagtctttacaaagctatcagtgctgtggcttttcaggatggccgggtcctaaagtttggacggcagctccctgaggactcactgacggaggagtctgagacaacgtgctacaaccagtttcagagactatggctttctataacctgctgctgagagaattcagctcctcttttgcctttagccttttctcattaggaagagataatgcaaaagacataataatttaaaagatatatttaaattattactgcttaaaatatttgctgcttctgtgggaaggtataagggatttaacatttgggagcattatttcaactcccttaggaaggtcccaaatatcttgattttttattaagataagcagttatctattaatgaccaaattccaactctgtaaaatgtgtaataagtaattctttagcatcaaaatttctaacgaatgattaaagggatgaatccacaagtagactcccgacttaatgcatttcagccttctaacccaagtcagtcctgttgcatgggggaaatttcaaggggaggcaagagtccagaaggatcctttctaaaagcaaatcaagcaggggagtttaatccaaagcttagcttatatgaactatctaggggtctctctctggaagacacatctagtggggaatttttagctagccaaagccagaatacaagtaagtatgttgcttctgaatcaatctgattgtctaaaacccaacaagtcacaaaatccccctttatcctacccaatcccacttttcaatatggcgggtggtcatcagtgaggaggtgtgatggtctcagaaaggctatctttcctaataatcataagatattgctggaaatggtgtaccatcttcaaaggagaaaactaagccaaagttcaactcattgataccaacttaaagacacgaaggcacaagatgggaaagcagaggcactgatgtgaattttcagttaggaatactacctccaacccaaaagcaaataccacttttccggtttccacaacctgagtaagtaccattatacttactcaaaagtggaacttttgagtatagatgcaaaaacattgaaagtaggatctagaagagatacgcccacattgatgttcatagcagctttattcacaatagctggaaggtagaagcaacccaagtgtccatcagaggatgagtgggtaaacaaaatggggtatatacatacaatggaatattattcagccttaaaaaggaaggaaatcctgtcacatgctacaatatagataacccttgaagatattatgctaaatgaaataagtcagtcacgaaaagataaaaactgtatgattccacttatatgaggtatctagaacagtcagaaagtagaacagtgttaccaggggctaaggggaggggtaaatgggagttgtttaatgggtgagagtttcagttttgcaagatgaaacgacgtctacagatcggttgcataacactgtgaatctatataatactattgaactgtacacttagagatggttaagacagtacattttttgttatgtgattttatgacaattaaaagaaagatgggaaataaaaatcacttcccatacttaaaacgaaactttgcctaagaaagaacagatatgtagcaatgtacatattctaatctggcacacccaaacatactttaaaaaaaaaaaaaaaaatctttgtaagatgagtgtagtcatttcatttaatcccaggactgaggcaatttctcaagctctcaaggctccacagaattttgagattatgaagaacaaagaacaaatctggtagcatttgctcagtcatttatttggtttatttaaaacatgccacggggccaacatttctaaatctgtgaaatagaattaaatgaagcccagagatgagaactgagaatcctcatagaggactggatccaaacaacaagaaaaggatgcatttttttacaccgtgaaccacatcacctcatatgttttcacagagactcccctgtcccttatccaccagcccccgctccaatttttcaagccagatctgctcaagcaatactcagccctgagaccccagttgcccaaaagggcaacagctctccatccagaatcactcccaccacaacagacttattaaggtttggaatgtgtgttcaggaagcccttattttaggaaacaattaagtagaattaggctaataatgcaaggcaggcaaagcttttgccctttgctgaaaaataactcctacgtggaacagttatactaataaaaatcatgtatttcttaaatgcctcaaaatgatctttgcaccaagctcagcaattaacactgccccactgaggagcatttattctccaggcttgggaggattaatctccctgttcgcccaaccaatgtcttctgttggtgaaaatacagtgtgaggctttggggtctgggaatagaaatttctgcaagtgggaattttgcaggaggcttaattcccttctcatctcagagggtggcaaggtgggaaggaagggctgggagccccccactaggcccaaatagaggccacatcaaaactcttctcgggcctacctgttcttgacctccagggaggacgggaaggcctttcttcaagtggcctgggccttgtctactgggggattgttcccaacccccccaaacccactctcccctcaaagtagccattcatgggccttcctctgggccagaagcaatagatatcccagctccaagtctgggcaggaagtgaccgctgggcaaaagcgggacacagaccctcccgtctgatgctttgtctccttgacaacaccccagctggtggcccgaggcacaggcttaatttcttttctttctctgcccaccctccccgccccatacttctttccctctttctctacacgcacacgtacgacatccaacataaagttgccgaaatagcaatcttgtctctgaatatataaattgcaaaaattgatatgaataaatctgcaagtagcacactgattgtggcacattttatcaaaaaacggcgctcggttgctcggtggctggggagggggttggtgtcattacacatacagaaaaacatctgcaaactcccagtttctttacttagaactgaatggaggcatgacctcctgttccttgccatgaaccctgagttcacactcatattttacatgttacaggaagccacagctcgccccaggggtgctgcaaacagacacgcagaagccagatgtagcccccacccccccaactccttaatgcacctgaagaagccggcaactcgacattcaaaagctgacatgctcgtagcttaaggtcacttcagattttgtaaagaggaggacaaaaccaggaatgcttctagggctgggctgtcagcggggaggcagagggattacaagaaacctgtgactctgcctctttctgcctttgctggtagtttttttgtgtgtgaacaagtgccatacaacagattgagcctcgtataaaggcctgagactgtgcaagggttccccgctgggcctcagctgtgcttgcaattagcaataggcacggagtgattattgttggggtagcggatggcaatgcgaagtgacaagttttatgggggaagttgggagtggggatgctctgcaagtttctctttctttcttttttctttccttttttcttgttctgcaaaatacccttccttgggaggctgcaacctcctgtttcagtgaaagctatttttctttttccctcgtcattcaaaagagtcttaacaaaattgtttgaaagaatatttttctcagtgcttcagaatgcgggttttctaggtcagagcttccttgctgccctatttaatgtcagaaatacccatttgcctcaaattagcagagagcttggagttgagggcaggagattaagcacacaaaattactcagcaggtgacggtggggtggatttgggggttgagaagtctttaaaactgactacaagacattatatacttctgacaaaagaacatagtaatcctacctgcttgctttaaccactgttgtttgcctattattatgtgctttaatgctcatgagagcaaaactattgctgatactactcaattaccatagtaactcacaccagtgacctcttatcacagggctcccagcccagctaaaccaatccagacagtttgtgtctttttatttatttaaacggtgacatatacttggactggaaagctccaaatagagtcgactcctctctttgtctagaataagaacttgttttgaaattttgagtaagggccttttcaccttttgaatctgaggtggttctgaagtttatggatttgaggctgtgaaacgccttcaaaaacatgaagacaccgaacaatgcccaataaaaagaaaagaacatgtgtacatcagagaccagcagcctcccagctgcaggaaaagttatgtttcccactcaggtctccagctatggtctctcaaagattggtaggaggaaaactggaggttcttcctgggggaccattgctattttatcatttcagtgggctaaacacagacaggacaaaatgactactcagagggatttaactctaagttttaaaaaggaattaaaggtgacattaatatactttttttttttttctgagacagggtcttactctgtcatcacccaggctgctgttacccaggctggagtggagtggcgcgatcacggctcactgcagcctcaacctccctgggctcaggtgatcctcccacctcagcctcccaagtagctgggactacaggcgtgcaccaccgtgcccagctaagcatacatttttctagcttcgcatttttcactggcctgtgaatgtatatgtgaatacatgtgtgcatactctatgctgtactctgtctgaacactattggtgattctgatttgttgtgccacattagcatattaaacgctctgagaagttctgtagtagagaagtccgtttaactttgtgtttttccaaatgtacttaacacaataactatttttcttttactcttttttttttttttttttttttttttttgagactgtcttgctctgacgcccagggtggagtgcagtggtgcaatctcggctcactgcagcctctgcctcccaggttcaagcgattctcaggcttcagcctcctgagttgctgggattacaggtgtgtgccaccccacctggctaatttttgtatttttagtagagatggggttttgctatgttggccaggctggtcttgaactcctggtctcaagtgatccacctgcctcggcctcccaaagtgttgggattaaaggcgtgagccactgcacctggccagaacagaagaactattcttcatgagccacccattaaattctctcaggatgtttatgtctcattgaatctgatttggaaaaaagttctatagtgacattaataatattgcaatgactcacagctgtaatcccagcactttgggaggctgaggcaggaggatcactataggtcaggagttccaaggctgaggtgagctatgattgcaccactgcactccagcctgggtgacgaagtgaaactgtctctaaaacaaacaaacaaacaaaaaaaaacctagcaataataataataaaagtaggcagagaacaatgacatgtgcctatagtctcagctacttgggagtttgaggcgggaggatcactagaacccaggaatttaaggccagcctgggcaacaagtgagatcctagtatcttaaaaaaagaaaagaaaagaaaagaaaatatttagtgagcacttattatatatcgggcactattctaagcagtgtatatgacttaaactcatttacttctcctaacaaccttaagaagtaatgacttgttaaatcctattttacatttctatagtatataatatttatatgaatttgttctctatgaaaaaggaagaaaaggaaatgtaatttcatatgtaataaattggcttttaatttttattgtatttttcctgtttctgagccttcagagattgggaagcccatgggttacatgttttctttttcttttcttttttctctcttttttttttttttttttttgagacagggtcttactttgtcacccaggctggagtgcagtggcaatctcagcttaaagcagcctcaacctcccaggcttaagtgatcctcctgcctcagcaccccaagtagttgggactacaggtatgcaacaccatgccctatttttttttttttttttttttttggtatttttttgtagagatgggatttcgccatattgcccagtctggtctcaaacttctgagctcaagtgatccaccagcctcagcctcccaaagtgctggcattataggtgtgagccaccaagcccggctgataaataatgttttctataactacatgaatgccctattaatatcaacttaaatgaagagcaaggcaaaaaccttcaaaaccctcccacctttgaactcaaggtgcccaaatatcaaaatataccttcccccctctatctcttttgattagcctccaaggccctcctgccttgaaagaaagaatctaacttagatgtcaaaattagatctgtgcttgcctgtgcacaacagaacttctgaaactgcggaatgtctaagaaattaaataaaaatgtaaccaatggtcaaaccctgaatgaaaaatggaacatgggccagacaccagctgctctaatacccctggctcaacagcaggacatatcacagcaaaatcaggaaaactcgattttgtgacacttacatagaaaatttttgtagcaaacatcagaagctgacaccttactttctgcaagcaaaccgggaaactgtgatatgtaagagaaaaggaatggctctcttatgtacctgaatttctcagttccgaccatttctttcttcaagatacataaataatgagcccaatgtgattaagccccaatcagcttctaaccaggccttgtctgccacctgtgtctcccagggcaggtgtgcagtttgggcattaacaaactgaccactgttaacaatacctttttcctagggcctatttttctctggatatgttgggggatttattcataggcctccctgtgcactgagaaaatggacccccatgcctttagcctccatcctctcaaaggaacttactgttttgagaaaatgtatagttacaatctgaatttgcactttcaagtcgtctcaatcttttaaagcttgattatgtcaaaaagaaaattccagttttggtggcacatcctaccacccattatccttgtgagcagtgcgaataatttatctgaaaactattctctgatatgcatacaagaacttaagatgtaggagaaggattcagcgtatgaactgaattcagattgttcacgaacagcatctgcccactcccctgatcgcttcttaggtatgggaactgcatttagagtgaactgcattaattcgcaagcagattgacgtaagcaactgaataagaaatttgcataccatatagaaatgattatagaaatcatactctaaaataaggatagtaactcatgtacagaacggaaagataaagtggagtgccaactctgccgtcttaaaacagggttggctaatcatattagggctaatttcataatttgcacacattaaactttctagagtcatgaatcattagagttttgtgagccaaagttgaagttcttacttaggaaaattcaaattgactttagggagttgctttcccgggctgaggtggttttcatcattactctcaacatacaaaagcatggtctatgtatgtacataatttccaggctattacatggaaaaaaattcaggtgaataggtaaatggaatgctttacattaaaccacacagctggtttccaagcagatagtgaaaggacacaaatataccatctaaaaggtactgtctggaatcctagaatttgaagacaataagacccaacaactctaactgggttaagaacactttccaaagtcctctagacagttttgaaactagatctatttcaattcaatgaacatgagctctttggggaatgatttctcataagggaagaacatgatctttttaggagctggatatggcattgagtggtttccaaaaagcagtcaacatacaaggactgggtgcagggacaatattcagatggtggtccaggagctgggaggggtgttgggtttcagaagagaaggcagagtggcatgaaggctggaggagggaagatggcagcagattggggagagcatggcaggcagcacaggtggatggagagggcatcttgatctcctaggagggaatatttgggtgtccatagcaactgcccaattaagggagtctagaaaacaggttctgatgcctggggcccaggaatgaggaaaataaagacaaagtgctgctttttaaaagttaacatgtgttttcaccatgtacagctgggttctgcctccaatggcgccctttcctcttgctttatttttactctcaggaaaccgtattctcctctttctacttctcactgcatatgactctattttttttctctttatgggagggagaacgaacacacacacacacacacacacacacacacacacacacacaggcacacacacacacacttgccagatcacttacccaaaccttaccctggggagccagccatctcatttctgtaaaaggcacaaacctcagaccattgtccttatacaagatacacattcaacatgctgggtgccctcgacagctacagatggtttgggatccaccagccaggaggtaagaagtctgcgtcaggtcccccattgaagtgttcagatgggtctagggcctgagcacagagagttaaatcataaattagccatgagttaatacgtgaggcccggatcactctgccttgccgtcaatgcttctcgtccacaaggctccctcccccttcctccccacaccccccacccttttgaggtgacagaataagaaattaaacacttgtgggttcattcgaaagagtgaatgaaattgaataagctctcagtacttgaggcgcacagcgagcgcctgaatggggcaaacctcctaagttgaatggagtgtcttttgggaccaatttgtctcttttcactctttattcttccctttttgctgacagatgtacaaaggcggaactgcgccgtgcagcttatccgcatgcacccacagcagctgtcacttttgtcgagcaagttaatcaagcaaatgccaccatatcccactttctataaggaacaacatgttatagacagtagtcttgctagaaagagactttattttaactttgattggcttcgttcccccacccctcctgacgcttcccccttttccccccaaaggagggggaaggggggactttgcccaagccaaggatttggctatgacaatgtcagatttcataataatattgtgtgtgaggctggagacgcatttggagttctttcctagggatggagggatgccccgggtctgggtttttttggagtgtgctattgtttgtgctggactgttaggctgcatgtctcaagttataaaaagaaaagccgagggcagaaaatagtattacgccacgaatgtcttggattaattttattcttttttcctttgtaaagcaggttgtgttatttacatatttcttttgataagcctccttgcctggctaagcttacaaagactgtgctaaatacataatagcatttctttgtgcatcttgtcgttagcgagttctttaagttgaatgcccaaatttatttctaatgtgcaccaacaaatgcaagcaggcctccatttctctaattctgtgtaagccaagtggggagcctttacaagaattccctcacgtccacatccacttacccttctgcctcagttaccactatttgatggtgttcagaaaccacaggcaagagtgagcttcattaaacggtacgcagtgctgacctcagccactgcccctgagcccccaacctgaatgccaaaaccagacatattttgaataaacaaactctttagaaacaatgcatataggccactttccaatggccaagggatttgccactttcaagagttggctaacagctgacgatctatcgggaaagctctttaaagtttcaagagaaaaaacaactccctttttttcttttctcctttcttccttcctttctctttcttttctttctttcctcttttcttttccttccttactttttttctctttcatcaccttgtcacattgtttagtgtaagctttggttagaaataaatcaagaaaggactttggtgatacctgatctcaaattttcacattgctgacatcttaggcattattggataatgaccacgtaatgatttagttgcaactccatttgtattatgcacagattgtataaccatgttattctataactgtcgattactcacctcccctttccataaagtattgctaatctgtgaaacctcatagtgccattgaaaacttagctatgtaggtaggttaaaagagtcaacagtacctcattggaaaatcttgagcattgttatttaataataccactgtgtcaagctttgcttaaggaacttaagctgctaccctaaaccatttattaactgtctgggatgtaatgctattgtgttaccaacattttaccccccaaataaaccacaaaactttattcttatgggataaaagatcttagaacacagagggagagatagactgaaagctgagacctaccccttagttaggcctaggtagaagtggattttgaagcatatatggtatgcaagattccctactgcgctgtagtctctttcagctgaggatggggtatcaccctgaagtgggttacagaagtgctttctgggatcattttaggaccagggtctgctggtattcatagagcttgagtccagtgacaatgtccccacattcacgaaaagacctgccctaatggggttgaattttcattaaggggtctctctgattagctatgcaacacccatcattgttagtggacaagctgtgactaataagccacgttctagctagagggtcatagaatcacaatttctgtcttatatcctgcggtgatccatgagggaaatagtgattacagtaagaaccccagtggatgaatttgggacacatagcactcagtatagtgggggcttttaggggtaggaagcacatatttgaatagtgtaaagtttttgcctaagatattatagttacatggctattcttgtggtcagaaagaaagaggttggatctaggactattttccaggcttctgaatttgccgaagtcagtttgccactcagtaaaccaatttcttcatctataaaaacctacctcacaaggagatcatgaaaattacatgcattattacacttaagtgcctagaacagtacctggtacatagtgcccagtgaatattggctctcattggcctcaatacctgtaacatggagatcacgaaggttcctatatcctagggctgctaagaggatttaaaagaaataacacatttaacaagatggtgctgctatctctaatgtacagtcaggaaaatatacatttagaaaactctaaataaatgttataattgttattattaaacagccatttattagaaacttcaattaattggaatctttcctcgtgttttcctcttaggagaatgctgcctttttttctctccctaaaagccctctttgggatttgtatcaaaagagcagctttcagaatgtgctttgggctgacaaacactgtagccccatcttctagaggcacagagtatggcagaaagagcactgtatccagagttggggaacttactcgcagtgcaattctggataattcactttttttttttgagacggagtctcactctgtcacccaggttggagtgcagtggcacgatctcagctcactgcaacctccgcctcctgggttcaagtgattctcctgcctcagcctcccgagtaggtggggctacaggtgtgtgccatcactcccagctaactttttgtatttttagtagagatggggttttaccgtgttagccaggatggtctcgatctcctgacctcgtgatttgcctgcctcggcctcccaaagtgctggtactacaggcatgagccaccgcgcctggcctgataattcactcttttaacatctttgagactggatagtgacacctggggttaagtagtgtgaagcaagagttctaaagtgtcttgacccagagcattagacttggcttcagatgctcaataaggtggaaaacagaactaaaacatttacaaaattgtttcaaaagttgtcgaaacagaaaaggttttccaatgaatcttcaaattcaccaaaaaatcaaatgggccaaagcgattcattacccattacatgaaccagaatactatattttcaaggcttacaaaaaatcaactgacaattgcaaaaatccacagtgagattctttaaggacttaattcatgtttttgagttagaattggaaaccgaaaatatacctgacaaactacacaagatactatcagggctaggaagtcatcaatacctatttaacaaatggttattgaaggcttacatatgccggacactagtggtgaattaggtagacaataacagtgctctcagaggtggggatgaaaataccatagtttcagaagaaagggccctgaggatctgggcaagttcattttggacctcaggtttcctgtcttaaaatgaaaataatactatctcttcccatctctccacagtgttgctacagaataaataaagttatgaagtcttgtaagatacaaagtaggaagggtattaacagaaataaacatgtatttcagtatcttttatccttagagtcagggttcagccacctcagcactattgacatttttgcagataattatttgttatgggggggctgtcttgttcatggtagtatgttcaccgcctatccattagatgccagtagcaccctcccgccaccaatcaaaaatgtctccagacatttccaaatgtgctgtaggggacaaaatcacccacaatggagaaccactgctctaaattagtggttcttgaccagattaaactctcggaacttattttaaaaacagatgtctaatccctaccttagatctactgaatcagaatatttaatgtacaactggaatgagtacatttttaaaataaaaaagtacatatgtagttctgatgcatacccctggttaagaagcaaacattaaaagacaaaattacacgcatataaaaagaatttagccctcaagtttctcgagcagcgaatgcctacaaagcaggtacctacatgcctagattggagtcatcataactgggttgaagccatcctttgtttaaaagtgaatagtgtaatttctgaaagaatatttccaaggagaagctctgttaaggctaatgaagatacagtgttggtaagtcagggacactcccaaaggaagcaataatgtttccttgcttagtgcctaagcatagactcctgcctctttcgcctccccaaatcctggacatctgtagattaagcccagtcctgcctcctggggcaccttctttgaggcttccatctcactgggatattactttagtctaagaaagatttcctttagcgatactgtggcacaactgagctctctgctacttgctatcatgttttctgatcatttcatcactggtaaagatccctgttggtgtggaatgtatcgctacttttctctccgctgcaaagcctaccttagtattaggaaagggtgtggggtgtgtgttgttttttatttatttatttttttagatagagtctagctttgtcgccaggctggagtacagtggcacgatctcggcttactgcaacctccacctcccaggttcaagcaattctcctgcttcagcctctggagtagctgggattacaggcatgcgctgccatgctcagctaatttttgtatttttagtagagatgaggtttcaccatgttggccaggatggtctcaatctcctgatctcgtgatccacccgccttggcctcccaaagtgctgggattacaggcgtgagccaccgcgcccggccgtgtgttggttttttacaccactaccactactgatgacgacaacaataagaagagatattcatggagtcatttctatgtgccatgcactgtggtttgtgctttagaggcatcgcctcatttagtcctcctaattcaaaaagctacctactgtttttatccactttttttacagaaaagaaaattgagtcttggagagggtaaagtagcttacccgatgtcacacagctagtaagtggcagacccaggaattaaacttagaaatgtctgactgcaaagcctatgctcctaacatctgctcgatataaagaaacaagtcccttgaaaagttgacagggcggtcaggcatggtggctcactcctgtaatcccagcactttgggaggccgaggggggcagatcatgaggtcaggagatcgagaccatactggctaacacgatgaaaccctgtctctactaaaaatacaaaaaaaaaaaaaattagctgggcatggtggcaggcgcctatagtcccagctactagggaggctgaggcaggagaatggcgtgaacacaggaggcagagcttgtggtgagcagagattgcgccactacactccagcctgggtgacagagcgagactccgtatcaaaaaaaaaaaaaaaagaaaagttgacagggcacctttcagtagaaggaggctgtagtgactcattgaactgacaagatctgagtttttgttgaagcattaatgctccatgggaactatagatgggtgagtgttaagttcaagttggcaaaattaggtgttaataattgctttttattttttagctcctaaaaacatgtttttggatgaagcttgtcaaaaggatttctgagacgagttcccgagatatctaccaggtagaatatcctttagagacagtcactggagtcccacagatcatgctcatgatttaaactcaaataatccattcactaaagacaaatgatttgtgtcagtggaagtatcatctagagcatggtttttcaatctctctacactattgctattttgagctggatcatcctttactgtaggggctgtcctgtgcactacaggaggttcagcactggcctctgcttgctagatgccagtaacatgcccccaacccccgagttgtagcaaccaggaatgtctccagacatggttaaaagtcctctgtgggacaaaaatcaccccccggtagaagcactaactcagagttccccaaactaatgaagcacctaataactgagtcttttctctttaacaggatgatttcctagggcaaagaatgaattttctgaacaaaagggagtgatatttctcttccttaaaagatgattttaaagaaatttcactagaaagcaactcatgcatttaactttgcttactttacatattatttgttcttttctaaaaaaaaaatctttttttctacacaaataatgagaggggctttataccttggttggcatacagatctgttaattaataatactcccatcctgggcaagacctggagctttgttggtataactggctttagtccagggatggtcagaatggaaaattctgccaaaggcagtcaaggcagcccaatatggcaagtgacactatcattgtaagccttttgatacaggaatattcacactggaggcaaatcactagactctattaactggatttttagtcaactcagcaggagtttaacagaagaacaggaggctgttaactgttctcttctgaactgggaatttggaatgaatgaagtatttaagttgagccttcttttcaggtttttggacacacaaaaataacttgcagccacctggtggaagcaagactttttttttttttttttttttttttttttttttaaattgaggtccgggtggaactataaaaaggaaaggaaagagaagtaatcaagggaggccaaagtgggaagctgtattgctgatctaacgtgctgttccagttccttcttttggctctaagtgggactactctggatacagtcaggggagaagagggtcctggatgtctaacaagcttttcccatcattgcatggagtcctccaaacataatctccttcagagactggcaaaggctcccaagctaactcccagatggacacatggacttcttgagtaatcattttaacaattcctaagctcgactttgttgttgctacatcatactcatcgcgtttttgtgtgatgatggcagtggcagggggctgtattacatccagagaggaagggctacctgtatacttttagtggtaacctcttttctagttcgtgcagatcagtggttctcaaatggggatgattttgccccccaggggaaatttggccatatctggagacattttcttcattttgagaaggacagtggctgctactggtgtctagagtagaaaccagggatgctgctcaacatcctttaatacacagactagcactctacaacaaagaattatctgactcaaaatgtcagtggtgccaaagacgagaaactttgctttagaagtatttttgaaactgaggattgtaaacttatttgtgtgtagtagaatcattttacctgttaccactgaaatttttgaaattcagtggtaatatcaggaactatcagactgcatcacataaatattgttttataaacttttgtttcgtgtgtgtgtacacgcacactgggttgcaatgtaaaatttctttctcattgtgagttggggcaaataagtttgaagtaattgatcttgcccactatgtgccaaacttttatgtgcacttgaatcaaagagactcttgttaaaatgcagattctgattcatttggtctggggttagggctgagactatatatctcttacaaacttccagatgatgctgatgctgagggcctgtggatcacattttgaataaaaagaacctatgcaagatttaaattcactcattaaaataattagagcagtaactatgtatctaggtattgatcgtgaaatcttttgatagcctatctggagcccagcagggagagaaatagttacttgtttaataaatgagaagtatttgaggatttaacacagctcgtctcctgcaatgcaatgtgataatatttcttccacaaaatgtgctttggctactctgtgtgtttgtgtgtgtgtgtgtgtgtgcacacgcgtacttgtacatgtgtactgtgtttgagtctgtcacttactgcttccatgccgttaagtctgccataagaaaaaaaaaaacccctgttctaagacacagaagtattgtgtgggtcatgttaacaagaatactgtgaccttaacgtaacagagcaatcagcttggcttcttagaatgattaatggaacattctcctctggaaaggaaaacaaattaactgtcttcaccaaatgtcttctggaacacagaaagctgttctgataaagacacttagcaaaactcttcattgcctacaagctccagagaaaattcaagactggctttatgtaaggtttgcctgaaggtaagagagttctatttctatgaatggctttggaaggaaatagctagattagaaaactacttgaagatatgttacagaaatgtaaatctgtgagaataccaacaaaaaacccctcagtttcttttggatagtaataacccatttaacatgattaatccaaatctgttaatgccccttatctttttttgtatgcaggattgctgaaagttcaaaatacccaggcatggagtgaagcattcccaagtccatgtggaatggaaatgtgtttctatacctaagactccaaaagcaaagtaattaattgttatcacttacttgtaattgtgaagcccatgggggaagaggggattgacatttgaatactattcactgcaatagggcatcagaaaagcaccaaaacactcggttcatctcctctcatcctaatagaagaggaattatcaaaactgttaaaagcagatttggatggtgggagttagagaaagcatgaagacactgggaattcgagtggccctggagggcataagtcatgaaaacgaacttggattgttttttaattttagcttggaagtatcctgaggttcacttccaagaatccaaacagagcttagattgggactgaatacatggttttcctctgccaaggaaacttaactccctaataaggtatatatcttacatacatacatacacatacacacacaccctattttaaaatatatatatcatatatatatagatacccgttacgtaacaatatttagtaggtaatgttaccaatcaaggtgagtgatgggtttctcatttccctccaacttgtctccagtttctgtattctttttgggaaatgacactctacagctgtaatgcatggcctagggtatgacttaattgccagagtttactttggggctcgaaaatagatgaaagaatcaactgtctcttcttcctgtaactgcctttcccagttcatttggattagctttctggtttcaatacacataatctcacagattctaagggatgtcctagtagcctggctgacatgctctttagcttcataattgaggatagagatgaggtcacagttcaattaaaatttgatctaaagagtatggaaaagctcagcttcagactgatttggagggcttaatttcagattgataacctcggggaaaatcccggtagaattaacaaaggacccttcccaatagtatgggtatgtgtgtgtcaaagtcaccagtctaagacttcaaagcagttacagtgacacaagaaatgctggactgtgaccctctgatttacccacccagctcagatagctgtgccttattccagtagttaaaatctctgtatgtcttcacatggccaccttgtactctggcctctgtgagttttttacagtttagccccccctcaatcttttttttttaaactagcttcagaagttttccttacatacagagaacagcttaaataaaaaaccccggttgaattctgctaagttactaattatgtttaaaagaactacttggttgaattcagcttgattttttttttttttctcagcaaatcagttctatgtttagatagtaataaactcctccagtctgcagaacaattggcacggcagtccctataacaagtcaagatcatgaaaaaagggccagtgctggttcaaaataaatttaaggggcatcacaaccttgccctgcatcaaatcctggtttgcacaaaccagctgtaaagaatattttggggacaagtgggtaattttgaatacagtgtatgagaggaaaatttactggcatgggaaatagtgaccattaactttaaaaagcaatttttttgcttactcattttagaaaaagagtacattatatatatatataattatatagaaaaagattaaaaaaaacaccactgataatgatatgtgggtgctgggaacacaacattttaatcttcttattttttggttagccatattttctaaatgtctacaatatacatatactgcatcttaatagtaaagggtattaattactccctccctctctctgcccccaccccccaaaaccctgaagttccgaaggttaattctgatttatttggcaatgcagtgtagttttgttgagggggtagagctaggctatttcaaaatcacttgaaggaacaagtagttctatgagatgataaggatgatgatgataagagactcattgaatttttaactacgtctgtctacattcattatatcatttagtcctcacgaaaactgtaagaagccagtttctttacagatggggaaattgaggcttagggaagtgaaataattgaccccaggttagaaagctcaaaagtggcagaaccaagtttcctccttctgtctgtcttacttcaaagccccactcctgaccatcactattttgcctgtttcaggaagatgttttaccaaaagtaaaaaaggtaccaggctgctctacatcaagcaattctaagcaagcttggggttaatgtcttaaagtgatggggagactcatagcaccttaacatgaatatgaaactttgcttaacaaggaaaaaaagaaggctgggaaaagcatttccattttgatgatgatgatgatagtgatgatgatgatggtggtggctaacacttaccaatgcttcctcagagctcgatgctgcagattcatatggcatttcaccctcataataactccacgattatcatccctgttatatagatgaatcagctgaggctcttagagattaaatgccttgttcaaggtcacccagctagtaaggatcaggtctgaaggttccagaggcagggcccatgatcactgcacagtaagtcccattcagggcactcacgtctgcttattgcttagagaggagataactcactgtctcagtgtctagaatgccatatgccttgaatttctttaatcagccccttagaagtgcaacttattgtgttagtgaatcctatgcacctctccccacttcatatttttggaagtggtttcccttacctggacagctggtgatataccttacagatatagcgtcatgtcctccttgtagcctattatttggtactttcatcctccagcaggatgattcctactttgattgatatatgctcacatgtatggtgctttagtaatttaataaggttgttaaaataagggtatctgtggtttcatatataaatatagcaaatatattttaacaggcaaaggtttcatgtttcaaattacccttttcaagggaactagtcacactcaattattgttctgccacacaaactggacaaatacacgatttgaaaatggaacagcaaattaaaatccgtgcgaggcaaagaatactgagtagcagccccttccgaagctgaccacactgcttgattaagttcttacgaggtggtttggtaagaggccctttcctgatctgataactgccacggagaagccaaatgcagagtcaatctgcaaatacttaatcctccagaaggcagattaagtgtataattgacctatataatccatgtatcatctccagtcaaatgttccctgggcctggttcccaatgacacggggcctgaagaaagccagtgcggatgcggcattactaccaatgtggattccatccaagttcgagatggctttttaatcactcatctccgagcctgtgaggtttaagcagatgaattcaccctaagcacatctcttttaatcccgattttcttctcagtctgtgtcttcaagaagtacaaggaagaaagaaaattaatttttgtttagaccttgaaatcttaggtgcgtctcttgatgatctgatctctaatttcaaaaagcatgtttttattttggggaagatgttgaattaatcactagagaaggagggaaaagccatctgcatgatttatggatactccaactttaaatcactgtcttcaagttatttcttgagcttgtgctttcctctgtagctgctgctttaggaatatggagattatttcatatccatgttttatattttctttgaatgtcagcaataattttcaagaaggctaagcttccacttgagtctcacagcagtctgatcttcttttaaaaattcagcatctttaatctacttgaattcattgtttttgtgtatattggaatattctcttactttaaatctcagtttgttttgtttcaaaatgttataaactgttattctgcagcaactgaaaacaatatacaattacacttcattttttatgaaaaaatataaaaacgcagataaaaaatgtccagctgcacatctgaaatattatgggaaacagtttgccgattcttttctgatcagcactttgtcttggattggttagtttttttcttaggtgcgttatcaaaaaagtcattagtattttatagaaagactaggtaaatcaattatattaataaacaaaggaatcttaatggcaaaagcaacccagttaggcaacattatgtccaaatgtatttctccaataaacctagagaatgcttggttaaaacaaaaaaaatcggtgaggatgaatttggaaagcctgttcttaagttacgtaataaaatagataaaaatgcagaacatcaaatatagagtcccaaatgctatgccgataatctcccacaagcacccacttccagccaaaagtacaatgacgtggcagagagaaaactagctcagagagcactgggtaggggcctagttaaagcagaaaatgcaccgttaaatgaccagctattaatccaaatattctcaaatacaaacacacactaaaaccatccagccttttctacaagggcacactcagaagggcaaaaacaggaacaataccaaacagcaacaacttaaaggacttatcaggtaaataaaactgagacttgaaacacagttaaaaacacaacaggaactcttagaacatgcctctgaatgacagatgccagcaggaactaaaaaccagagaatgacacaacagtcagaatcaacaacccccaaacagcaaacaatctcggagatatatatttttttcttcattcaaaatgttaatttgctattattcatttttgccatttatcaaaatgcaacgatttggaagaaaaatctcacagagcaacaagtctttctcaataggtttctgccaattgtttagaaacttgccccaggacccctatcattaaggaatgggatttaaagaataagttcatttgcagcaagaaatttagagtggcagctttcacagacccttctgccttgatattcctattcccttgtttagcttggtggacacaagagatttgcagagcatgtacacaaagaaataaacaccatgcttgaggaaacagaagccgaaaataatcaaacatgttggtaatctgatgttttgctgctagattatagaaaaacagtaagtactgaattaaattactaaggctgcatggtaatgaagcttttcgagaagctctgggtttttaaaatgacaaatgttttaaatccatgacagattcaataactttttttgcactacatcagttaggttgcctagcaccaatattctgtaaagtaggagatcaggttatttagaaagtaagaaagtaaatggcaaagaaacttgttatctctaaataagctcctgaaaaatttttttttttccacggggccgggagtgatgtgcagtgagtgattgtaatagttaagcctttaccatcagatatactcaggagggtataactaagactccgttgggaaaaccaaattgggacaacatcagactaaattgtgggggtttccacaatgttactgatgctattttatgctggtcagtggaattcaacaagggactggagttacttgtgaatttttgaatgtccctaactataacttgctttcggaaaaaaatattctcagtaatatttctttttactattaatttactattaattaattaattaattaattaaaggctggagggcttgaattttgcctgtggtcttcaacagtcaggcaagtccagttttaccacctgtactagccaaggctgcacttttcctttttaaatgaagatttggttgcactttcctttaagaagagccacaaaagagataatgtgccttgctgcgttcagcaaggctaccttgcttgtacttctaatttcaaaaaaagagaggcaagggtggattatttgtcaattaagtaacaagctaaactgcagattaaacatcaaattcagtactagatttaagttttagagaacacaaggttattggttattcacacacactcacacaataacacacacacacgtacacacgggccacataaaactgagaatcggaagatactgatcaaaggaaaaagaaaggcaacctaggcattgaaaaggacaacccacaggcttcttgaatatttgtggtttggaatttaattcaatggagatgggcagagtgtccacactcctaactgcagacccgagggtcctgcctgtctctgttttcaatgcctattggatggtgattgtgccccggacattctaggctcagtactttcatataaggcatgcatgcagagaagggggaggacccgctggtgagctttatgcatgtatgaggcattctcagtggatgtgggtcatgctagaagatgtacacaggaagattatttgattctaattcatgccacttgatataatgtgataaaacatttgacatgagagataagttccatttttatctgagagaggatgggtgggaattaaaaagtaagaagggttttgtcgaggaaaggtgatgcaggggaaagaggggtatcaagcacagaaaggggacgattggaaaagaaaagaaaaaaaaagaaaggagcctttctacacacgaggaaagcaaatgagctggaagtcaaagcatataaaagtcagaagccgcagaatcagaaagcggtgccaacaatgagctcacttagctgtggaacaaaaacacacacacatacacacacacacaaactcaatgtaaattgctgaacacaatcacagaaaaaaaaaaatagaaacatggattccatagtagaccaaaacattaatgttcgcattggcactaaaaatatggaaacctggacaggaggagctcacgtttcacaagacagaagtaggctgcacactcagagccacagggagacaagaacatcagcttccatgcactctggccgggtctacactggcaaattcggtggaaacccgagatgaaatatctggctaaattaggtagcctcatctgctttggcctaaaagagataggcaatttgagactgaagcaggttcctttttttttttttttttttctttttgcctcagtggcttgctttgctgtgcagatgcagtctcagtggaaataagattgctcaaaaatgattaacccttggtaatctgcattttctgaagtttgatctgggtccgcagcccaatgtactcattctttgtacacctgtttctcataaattatcagctggctgggtgggcagggggcgccatggtttaaagctgcaactgactgagcaactctaatgtaagtgtttgccaaaacccagggtaaggatttccagtcttccaggaatgaaattatctttgaagtgataacgatgcgacatttactgcacatctgcacaccacagctggtgtcagggaggcgccacccccaggagagggagttggtctcagcctccctgatgagaatatctccctaaagtgaggccagattgcaaggaggaaaaccatgaccaagaaaggtctttgccagttagagagagctgccttgcaagcttcgtgcaggaatgagcctgcttgccgagaggctgtgtgccgtcctacgtatcacacagattgggactgagacactgccacaccagagtgggttcagaacagacacaagacagataagagcctaaggcagagggagaggaaaagatttagtctgaatcagaaccaatccattttctcaaaatgtgacttatcctcctgtctcttattttgtcacattttggagggtctcctccttggttttcaaggaggagaaggcatttacttacatcaaataacctttctatgtacatctcctcattgaccttatcacgcaggacatcctgagaatggcggacgaaagtcacgtaggcgtcggccacgtccatcccgggtttctgtaaagaaacaggaaaacatgaaaacgaattttcagacagccactcttccttgtttaccattcacttgtaccctctacttgccctcacacaccctgagatgcttctgctggatcagctttgtaggcatgggattgctgtccacagcctgggctggtaggaattgatattagaactgcttcctctttccagaaatcaagcctggctaagaagggcattgagattgtaggattttataaatagtttttctatgataaattttttcctggcaaatttatctaatggataaatctttactgcataacccatagatgttctctgactttgccttggattgaaacctgcattaaagaatatccaaacatactgttttccactgtccttaatatattatcagacgggtgatggaacttcccattcctttttcctcttttaaaatattgagaaagtactaagtaaaaaaaattgtgtttcaatctatacctcttcctacccaagtctcattgtgtgtgtgtgtgtgtgtgtgtgtgtgtgtgtgtgtgtgtgtatagcttaacctgagtggatatagtatttgctaattaattagttcactcagaggagacactaaaccatttgtctttgcttccagtgcagccttaaagtccaaggattaaaaagaagaagaagaagagaagaaacaaaaggcaggggaaggaggagaggatttgatttttaaataaatcagattttctggaaaggtaagctggtggttcatcctgcagttaggaaatgacttattgtagggaagtaaaaaaaaaaagaaactcagaaagcactctgcttgagatgtcacaatcaaagttatctccaaagaaacctattaaaacactgtaatataggtcattaggagagtggccacaaacccctcaaatttccacagtagatatatatgtctgctaataactaaaaagattagttttcattactgtgatttaccttagatcacaaagtatcatttctctactagacgtgactgtcaggcactgtaaattgaagttagttaacacttctgtgtaatttccagggtgaaaatgaggaaggtttagaaacagtaggactgtatttttttttcctgatacaaagcaaacaattatcatgcaaagggccaatgcttggcccctgggatgctagtaacatttcttaacacctgctgaaacaatgacaaggtattaatttgaaaaacaatgaggacaacccaaagccacagtagtcaagtgttacactttcaaacaattttcagcgaatggattgagcaggttccatgatggtcctataattgttgcagttttatgatacaaaacaatagaggttctccaatgagatgtaagtgatagctatcagttctaagcaggcacctctctccttctctccgtttggcaactgtgcatcaaagggcattctcagtagggatggggatctctacctgggggacttgagaaacttattattgtttctatttctcccctggtgatgcttgtggcaatatggccttttcctgggcgcatgcaaccatcttagagctaaggtacaaagtcaagtgcggcagatctatcagtaacccaaaatgttagaagaaacagtaatctacaatgatgcgtatttgcaccactccttctcttttcacgaagtttcactgtcttcaaaggggcacttcattcaagttttaaaaactctggtattttaaaaaatcagtgtggttcatcttacccatgtagttaagaaactccatgatttgctcccttttgactcttctttttccaatagcacttaccaatagctgatgttgtattatacactatttgttttctctcttatcccactagaacataagctccatgaacccaggaactttgtttggcctgttttctattgcatccccagcatacaaaatggtacctagcatatagtaggggcccagtaaatatttgctgaatggacaaattcaagaatgaatgagcaaatcctttctccatctcctcctttttcaagctcttcagtcacactgcatggatttttactggatctcccacaaattggaatttgtgaatatcacttaaacttttctgtaaaagaagagttaaaaaaaaacttctctgggccttagttatgctatctataaaatgggattactaacagctcccctacttacctccacggactgttatggtcatcagctagaataatgtatgtaaaaatgttttgaaagccatatattgtaatacaaacatgaattactatgattcccccccccccccataatattataccattccacagccttacctacctttagaatctactctagaaccaagaagaaaagggggcctcagaggagccaacgtcaaaataaaaatgataaagcctcagcacaaaacatgtgtagttttctcataatggagtcctcaagctcccactcccaaccaattccaacaagtttggtttccatcccttgatggagcagaaatagggaagagggggattgtttgaaaaaactgtgcagataagagagagctatcatttttccttatgcctgacggtgagggaggaggctgcccaactgcaacaccagacatgcagactcaccaaccgctggggtttgggactatcgagggcaggggcaagcctcccctatatcttgggaggccctggaggggagtgggtcactatgcagccactggggaaagacatggtcacaatggtgatcctgagtcattgagaaaagattatagtcagtaccctgtttaaaaaggcaagaaggttgtgtaatgcatttcaagtagatttccaatcaaaacaattaaaagaaaaactgttcacaaacaagctaacccttagttatagctggaaaatatacttgaccagacagctgatactattaaattatgcttttatatcattgtgctacccgcacacactgggacaaacttttagatgttttttaatatctcataatgacattgtgtattttaaatgtggcttggacagactgattgaatatgacacagattttagaaaacacttaaacaaatatctgtatagttaactgcatccatgtgtggaagacataatttgtgaataagctaccctgtggctcagaaaaagaagaacattttaatctgaacttgcccctaccggaatacttctgagcttgagaaaaatgagctcaaacttccagcatcctaagtcagccctacttatgaatgcaaatctcctacatataccaatgggtcaaaaactacatctaaaacaaagacatatgctttggggatcatgtaatgttttaggtgactggtactagaacttccctccagtagtgtggatagttaagagacaaatctcaaaggtgactaactgctagtgcccacatggaactaaaccattaaatgttctaacaaaaacctcacagggaaacacaggtgatctcagaggcttcagagatagaaatgagttgagaaatgattttatctgatggttcttaagcctggctgcaaatctgaaggacctggggagctttaaaaatactgatgtctgggccctgaaccccaaagatgctgtttcaattttgtctggcaagtgacctgggcattaatgcttgcaaaagctccctagtttccaatatgtagccaaggtcaagaatcactgatttagtccattggtttcccaacttgtactacttatcagaattatgtgaagaacttaatggaaagcaatatccaggctccaccccagaatgactgaatcagaatctctggaggtgagggcctgggactctgtattaacaaaacaaaaacaattatgtgcccattaaaaaataataataaaagctgaatatattaattaataaaaaacaaaaacaaaccagaaattttttttttttttgccaagtattgctgctgtacattctagtttggggactgctgacttaataggtaatagttagtggtatgctggtaaactgactctttttttttttttgagatggagtttcgctcttgttgcccaggctggagtacaatggcacaatctcggctcactgcaatctctgcctcccaggttcaagtgattctcctgcctcagcctctctggaggaggtagctgggattacaggtgcacgccaccacacccggctaatattttgtatttttagtagaggcggagtttcactatgttggccaggctggtcttgaactcctgaactcaggtgatccacccaccttggcctcccaaagtgctggtattataggcgtgagctgcttcgcccggcataaactgactcttcaaaaccaacaacaaaacaaaacaaaacaccctgatttgtagtgtttaccaatttgcatggtgtaaatactcccatcaaggctaattttgagctaccaatgtgctctcattgaaggcggagttggagagagatgcacataattgaccttgggaaccagtgctagctactctaccacacccctggaagtgcaggctttatggtccaactgacagcacctgatagtcacactctgcttattcaccaggtgaccttgggcatgctaattaacctctttgtgcctcagtttcctcagctataaaacagaatgataatattaacccctcctaggattgatttcagaagcaaatgattactattatctaccatatataaacaatgtacatatagaatatacgtgtattatgtactattgttttctataaaattgttatttatttactaaaaggtttactataatattattagctattaaagcgtatgttaatcaacttaacatttagctttgtcctaagtcattaatagctggtaaaaaaatactttttctaatatgcactaaaataattaccactatccaaatcaaggtgtttgtttatgcactaactggaattatcttgcagtatggcagaatttgtaagggcattggcttaaatctcagctcttctactaacccgatgtgggatcctgagcaaattaacttctctgtgccttagtttcctcatatttaaagtgaggttattgtgaagataaaatgtaaactgttctagtgagtactttataacgcttggttgtagtagcagtaatagtagttattatattttgtataatcagtggtaaatgtaccacattttggaacatgctgcatcaacttcttctgccctccagagtgtgaaaactctactaattcaatttgtttcctcatagcctaatgacatatggtttggctgtgtccccacccaaatctcatcttgaattatagctcccacaatccccaagtatcatgggagggacccagtaggaggtaattgaatcatgggggtggttacctccaggctgttcttgtgatactgagtgagttctcaggagatgtcatggttttacgggggcttttttcctttcactcattcttcttacctctgctgtcttgtgaagaaggacgtgtttgcttccccttccgccatgattgtaagtttcctgaggcctccccaggcatgccgaactgtgagtgaattaaacctctttcctttataaattatccagtctctggtatgtcttcatagtagcatgaaaatggactaatgcacctaacgagtcttctaatttagcataattaatccataaacacttaatgagtacagatcagggcaccctgcattttgatatagagtccacttactgccctcccatctttataataaatctgaacctagcttgcaggaattattagatcgaatcatatgaaatggctgatatttgacttctttgacctcaccaatatgccaatttcatgtggttcaatctaacataacctgatgttagtaccaatggctggatcaagtttctctaggtgtttgggccttgtctacaggccacctgttcaaacctggctgagataccccctctgctctggatcctacagagaatagaccacagctaccaaatctttgggtcgaaagccgagaatttcaatttctatcactgttgaagaccagtggagcccaacgctgatgtctgcaaattcatcccccatccatctatatgcaatagagtgtggacatcacactaccaccaccacgtgtgtccttctcctggactgaaattcctaataagtgccaggtatggtgctggatgttctatgtatgttgtgtcatttaatttgcacagcaaacccatgacttaggtattatcgtcatctccattttaaagatggagaaacagggccagaaaatttgagtagttagctccccacgaagggaaagtttatactttggaggcttgagaaagtaaattacttaagttctctccctgctgcagttatgtgagctttttctattctccattataagaactgtctacctgaaggaatctgaggtttgtggataggaagtatcatataaattcaaagcataattattgattgtacattctttcattaaacaaacacaatatatgctaatgctaaattcactccaattttctattttgtcttcctttgagaaataagccagtaaaccattacacacttagcttcctggggaaatgaatttaaatgttaatacaaatccttttagaaaaaaacaaattttaacaaataagtatttgaacaaggggggtacttaaccacgttcagaatgagaaatgcttagtacaagacccttggtggctgttgagataagctctctaaatttaatattttataatagactcacacctcttttgttagaaatggagaaacaaaatcattttctttttcactttactggaatatattaaaatctctccaattttattttgctaataggcagggcaaagtctgtccataaatgtatcctgatttatcacaggtaatcccacactttagcattcatgtgttgtacttaacctcaatttaaatgtaaattttgggaaacttcgagtgctttatctgtgaactttgagagctctcttcattaatgaggcctgcactaaattataagcagttttatgaggtttccttaaaacaattgcagaattgaccccaaaatgaacaaatttagaatttatttgttttttttattaggttggtgcaaagaaattatgttttccacatttttaattgcaaaaccacaattaagtttttcatcaacctaacaaaaaatactatcacccttgtgcaagtttctagcttcatggctttcctctgaaggtgtgcacacaggagggttggtgaacatgatgaaaacagaatgaaacaacagagaaaccaatgaaaatgaaagtgaaagtgaagtgggtttaccctcaaacaggacctttcttcctgatgaaagaaaccataccgtcttcttatctgaaaaaaaaattctactacaaaatattcttggcttctttctgatgatccaagtcagcaacacacagtttagctagcagcaattaatatgagtagcactatcaaaattctcatgaaaacaaaaagtaaaaatgaaaaaaaaaaaaaacaaaaaaaccccatgagaaacaattttcaaatactcacaggtacatccacatatttggaagctgccttcacctaaagaggaaagaagaggatggaagtgaggctggtgtttatgtttaattgttcactgctcaatgctgtatccccatcagaatcaaaacaacatgctggcacatggagctgaccaggaaaaacagaaaggtactagaaaataaaatctgtttgctattttttcaagccatagccactgctttgcagaaagagagaatgcacacgcaaatttactgattcagattctgttgctggagcgggagctttacattttcctccctccctctgaaaaaaagtaaagtgactagctaaacccacatggattagtccggggcttaccagtctagagaagcaactaagattgctgttacttctggtaccttgggtctttgtgtaatttggctgcaggttgtcctaactaaataactaaaaacctcagttctcagctttcattaactcaggtttttaagaggaagatggacatcctcaacccagagggagatggtgtctgcgggtagggggatgagaacctttcaaaactgcccaaaggctgccgttatgtctcctgcttttacgtgctaaaaattccagatgggaagtgcaggaagtggttataaaatttttagttttgtggggagggagtatggtagcgtgctagagtgttatgtttgagagcatgaagtttggagtcagatctcagttcgaatcccaactctaccacttacaagctgtgtgaccttgggcaagttgcttcatctctctgagcctctgttacctcatctgcaaaatggagttattattagtaatagtgcttatttccgcaggttgataagggtgaattcacacttagccccaggatgtaaatacagaacaaatggcagctaagacgatgaattcataagcaaatgtgggtgagttctgagtactgtgaaaagtcaatgaacagctgggtttgagaaataaagcctatgggagtatgtttaatattctgtgtgtttcattttgactcaggtcacacatgtttctctaggcacaattaagactaaggagctacatttggggtcagagagggtttcctgtttttactgggaactacaaagactgcaatgcacaaaaagcagttaggatgtcttttcacatctcagccaggcttcctcctgcaatttggctgagatcaatattaggaatcaagcttcacccaaatgtctcccagaaaagtacccaggggagtgatttcctctgttgctcttttctcaatgctagtttccaaaatgtcagctctcaagagaaaacagccaatgaaccaatagggtggggtggaaagagcccagaatatagagtcaaaagttctttcagtgccagaactcgttgaccctggggaaatcatgccaagttccttagccttggtttccagatttctagaccaaggtgacaatactgtgtactttgcagggctgaaagcttggtgaaatgagaaaacgcatgagaaagtgctttgtaaactttaaagcaaggaacacacatcaattaggtaattatcgagagggcaatgcattctatcttcttgaatcattgccagcccccaagacgattcctggagtctcctgttacagattctcttagaaccttacacttgttcttgcagcattgattgcaattcagccgaaatttttttttgtgcaatgtctacctcccatataatgtcatgagagcaaaggctatcttggtcttgctcatggctgtctcctcattgattcacctggtaccagcttagaaaggaaactcagggaaaatttatagagggaagcaatgagagaaagctaatgaccagttctggcctcaggatgattgagaagtaagcagaggcaagattgcatcaaggagccacgtcactgatcagtctgaaaaccaacatagttgtatagaaaggtgactgcctgcagaggctggtgggtaaaggagaatactcttagtccttaaagggatttgaggcaggctctccagattttgcacaattatcatttctactaaaagattctaaaccccaaatctttcctcgccattgctatgctagaacttagttcaggaaagaaggtggcttgcctttttttttcatgtctcccccatgtatactattatctaacatttctgtgatatttttcatttgcaaaacacttccacaaacagtttcttctttaagccaccctgcaaaaagggggtgattcaatcagatccgtttacaatcgagaacgtaaaacccatagaatttaaggaatttatttgctcatgatcacagacaggaggcagagaagccaagactcctatgcggtcatctgagcccaactttctcccttggaactcttgatctcctcaatattggtagaaaagtatgaggaattcaagcatcggtggtcagagcaggtgctagcagaacaattcttctcagctagaaattgcctcctgtactctgtgatgttgatgcttagcagttggtaggggttttgttacagctgaaatgagcaacctttaaacacaccatttaccatttactactaacatgcagttacaatccggagaatgacaccaaattctattcctttacaggcagtttgggaagatgaggcaagtttctgtcacaaatgaaaatcatccactctccctcatgcaccagccctcggtttgttaggattgttcttttatttaataaatgatgacttgcacttagtcttattgatcctcctcccatcccataataacaggaaaaaataacccagggtaaattgtggtctattattatttagagacatgtgtgtatcatttttggttcgggatattgaacttttttgggggggggtggtatggagtctcactgtgtcacccaggctggagtgcagtggcgcgatctcggcccactgcaacctctgcctcccgagttgaagcaattctactgcctcagcctcctgagtagctgggattacaggcacccaccaccacacccagctaatttttgtatttttagtagagatggggtttcaccatgttgaccaggctggtctcaaacttgtgacctcaggtgatctgcctgcctcggcctcccaaactgctgggattacaggcgtgagccaccatgcccggccgctggatattgaactttaagaaggacattgatgatgaggaaaagggggattctggcagtatattctataaggaaagtgaaagaaaaggcatcttgcctagaaaaagatgggctaattgcaaagaaaaccataatattcatgtagttaattaaggagcttcagtgcaggtttgaatttgttcacaatggttccagagtatagaatcagaatgaatgtgtaaaattacagggccctagaaaaaggtctaaacagctatcacactccagccaggaactggccatttctggtgatagagacctccacctcactggagaagctcaaacagaggctaggtagaaggctctggacgtgtttttcttttcttttcttttctttggatttgtttctttacctacatgagagtttatctctagggctgcttttcattctctgattcaagtccccttagaggtaggaagttgtcaccagttacattctttacagtagataaatgtagcagagcggagaaattgacagaaccaggatgagaatcttttcctgtacaatgtcagcagtgctccctttttaaggatcaccttttcttaagttatccatatccatatccataggaatatgtctttttgccagctatactctaggtagaagggaatgatcagatcctcccaacccactagagttttggaattattgccagaaaatccaagcatgcaccaggcactgtatctagatcaaataaccaacagcccttaccatctacacaaggctattttacattataataagatattgttttgatgaacaaaacgcaaatttctttaaaagcactatataatatagtagctttttgtctttgtgtatttttttccatcaatggttgttaaaagagtgtgtgtgtgtgtgtgtgtgtgtaattttcttttcttttttaactttaaatctagagaagtggcttacagaatgggttcaggattagctaggttaaaactctggctttgccattttttagcttggtgactagccattacttaacttctctgagcttcctttgtaaatgggacagtaataacgctactcaaagggttcaactaaatgtagctgtgcttatcatcattactggtaatattggcttaccggtgtagacaaagcacatgctcctcagcctggtggtgatagtcagtttcactccccacctctggcccacgggcaatttcttgctataaaaaagattctggaatctccccaggttaccaacaggtatctgagctgattctcagtctggcatactttctgccaattctgtgacaccctatgcactgagaactcaccctctaaatgttgaggctgacagcaaagacctgttctctttgctaagtatgactgagtgtgggcataagtgagagggcagttccccaggccagtgccctgggttataatcaacaacacaatctattactctccaggaccaagccatagccatgtaccctagggcacaggagacaaaggggagggggtagggcttgccccagatacctggtctggcatccctcctgagcaggttctcaactgccctcaaagggaggcaagaactgtgacttcagcagaacttcatctcctgggactccctgctttctgaccatcccctctggtaggacaacccatatcttttctctagcagcattcatgaaccctcttgtccccgactctccagatagagccagttctggaaaaagcttagaaaaagagacacaaatccagagaggctgacggaggctaaggataaaattgggaagagccgctgtcagtgagcaattgttcatgttttcctgtgcctgaaacaaagaacatttactatgtacaggtaccacattaggagctgtaggatgaacgtgcttgctccatgatttctgcctcaacaaccttttgagggggatcctattaatattcccattttacagttgaagaaaccaaggctaaaagagataagcaacttggcttgaaggcacatgactaataagttacagctttggacctcccattccctaagctgcctatcatcctattatttagtttctttttttaaaaaaactatgaaaccacttttattaattagctatatttaagtcttaattttttcttgtaaccttaaatggcttctcaaaaaaaaaatgtatgagggacttgaatacatttgagtcagtgcagaaggtccaaaatagtttctctggcttgaatgtcccagctaattacctcgaccctccacctcacttagccagtgtagacaggcttaatggtttctctattgagctcttccattatttttcaggtgcccaaggtaatcttttcattgagcactcaccattctggggttttcacaatgctgatgactaagggattttcttctgcctggccctaaaaaggggacctgagttaatcattgtgcagctttgatagggagcgcggcaggggcttaaaccacttcttttgcttcattaggggaaaaagcaacccaggtgcagaccacgaggacctcagggtttgatactattaaatcaatgcacagacaaaaaaaaaaagtggattaggccctttttgcaaacagaagtctggtgggtaagactcaaagatggaagaagaaagaagtctgaacagataccaccgcattagtgactgcccgagcgccccatgatctctcacaaaaaaaaaggaaaaaaacaatcaaggaaatgatttattctctccatgagctgactccacccccgcctgtttgacttcacaagagctctgagttaattttttttgtcctttgcctagatactgcagaccacaccaccacgtcaaagggctagcaaaatttacttcaatgtttggcctttgaaatttctgctgcaaggttaatgatgctgttttgctcccttttccacttccctaacccaagcaatttagaaatgtagatttttttgtgtgtcaaggcaattcagtatgtaaaaatgttactcagtgccatgcctaaaatcatttcgtctcctgttggtttgatttttcatctctcaccagcctcatatctagaatgtaggtgctctctttccttagtgtctacactacctggtatatagtagtggctcaataaaaatatattgaatgaatgaactttagagaatggcactctttactcagtacccagggcagaggttagaggtttctagcactttcttacagtaggtgtttgagctgtagcactcttataggacaactaagaaagtaccactaggcatgatcagttcaaaaggcatagtccctgggcatagtaagaactatgtgccagaaatcattgtcatttctgctggaaagtcaggttgttttagtgaattgcacttgtatattaaggttggtctgaccctacacatgtggctctttaaatttaaataaattaaaagaaaatacaagtaacattcaactttttagttgcactagtcgcagttgagagtacttgagagctacataaggctagtgactattttggacagctcagatacagaatactgccatcactttagacagttctattggacagtgctggtctagacgcaagggacattcataaatataggttattgcatttttaagtgatatgaattaagaatttctatgttagaaaatgaaattaattggaggaggaagcaggagaagaaaaaagatatgggtgtcatagtctcattttgtgggtgaaacaggaaataaaggtggatgggtacagcttaaagttataatggtaccaagacaggaagaacaatactgtaataactgtaacagaaggagagtggaggagaagtggatgatgtaaagtgagctgaagctctatctattacagtagggagtcaaataatcactaagattgaccaatcaagaaatgacaacaaaggctgggtgcagtggttcatgcttataaacctagcactcagggaggctgaggcaggaggattgcttgaaaccaggagttcaagaccagcctgggcaaaatagggagacctcagtttctacaaaaacaaacaaacaaacaaacaaacaaaaaattagccaggtgtggttgtgtgcacctatattcccagctactcaggaggctgaggcaggaggatcacttgaacccaggagttcgaagctgcggtgagctgtgatcatgccactgcactccagcctgggagacagagtgagaccctatctctaaataataagaataataaacaatataataatagtacttagcactccaggggttaaaaaattgttaaaaagtttcattttgaaggaagggattgagagcagaaaggactaggacagagagctgtgtttttttaaaaaaaattatgaatgtttctgtactgtttcattttttttagccatgtgccgatatgactttcattaaaaattattgaaaaaaggaacaaaagtgatagaattttcaattttcaattctagtggagaaagggattttgcaggaagaatatatctttctcagggtgaccttctcaaggtgtttggttgatgaagtcatggtttagaggtatgtcctctataaaggcaaaaccaaaacctaacagaaccaacactcaatacataatctggatgctctaagtgcatcttgggaagatgaataaattttaagtgccaactgagggactgactgcttgggtgagacagaatgtgtgagtgggcggatgtactgggactgcgtgtgcgggtgagcagttgagcaaacctcagtggcttctgcctggggccaagtgacaattacggtgaaagccccttccaatactttctgaggactggagaaaaacacaacccttaaagtatatctggaatcatagacagcatgatggattcccagggctctgtcaccagagggcctgaaatgtcttctttgcttaccgaacgtcagtactgtgctgggccagttgggaggcactatttccatgtgagcactgggtcaaatgctacatggatgcatatacatcatgaggccattgtccgttgcttccttttataagagggccagagtttgtaaatgccatttttacagaggtgggaactgtgacaccaaaaatttctcataagtagctcaccagatgtccattgcttgaaaaatgatcactggctttcaaaatttgattcccatttgaaagaaaagagttaaagtttgagatgtttaaaaaataaggtttctctaagttgcctataaatggaaccatttcagataatggaaaagagaatactgaccaagtcttgactcttactcctactttctcaattagtgtctatgtgaccttgggaaaagcaatgaactactcagatttctcatgaacaatacagaaatatttaataactgatagtcatatataaaatcaggatgcatttaccaatgattgaacacctaatttacagtatcttattcacgtcttctaaggacttgtcttcttcctttatgaatgaggaaactgggctcagagaggttaagttgctgtcctcagggcacacagtcaagaagtagcagagctaggatttgaaccctaatgggtgggcctgacttcaaaggattctgtactgtatcaggttgtccctacactgccttttcacaagacaatttaacaaagtttgaagggaaaagtcctaccatgactgtggaagtattttgaacaacaaaatgtattataatattaactgaccgcaaataagacctcatatataaaactgtaaccatcaaggataatattctgaaatgacctctgtgaaccactgcagagcttcacagagggccatgggaaagtgggagagagccgaggttttcctgcaaagcatccttaggcaagaacatgaaaactgagttgcagggctactggttgattgtacggcttctgtgcatgttcataaatattgattgtgattaaactattatcatagtaatgagggtagtaatgcctcctacagcccatcccaccatactcctcaaagtccctaccttttattaaacaaagggctgctggcactgctggggagttgggcaagaggcaaggaaatgatctctattaagcaaacgcattctattccatgctctgattaggagccgcagcctcattaacgatgagaattgttctcatctcctgttgttcagggtactgtgctccgagactagatccaggaagtgtatgttctcatctccccccaccccccaccccctggggcttctgaacagatgcctgattgaagtagacctgtttttccttccagttttccttttcctcatttctgtcccaatccctcattcccagagaggatttttccaaggctcaagggctccctcagacccagcctcttaacactgctgatacttaacaatggttgcatgcttactctttgcctagcacaaggttaagcaatttataaggaattcaccctcacaatggtgggcgtgaaattctcattgcttacagatgaggaaactgaggctcagagaggttaatcgacttttgaaaagatccacaactagtgacattatggagctggtatttgaagcatggtttccttggactccagggtttgccctcctaatggccacattgtatgcttttccattttgttgatttttgtgacatgatcttattttaagagaaacttggaagtgcaaattggaaagttttaattttgtaaaatctccaagcagacatgtaagcttatttttgcggattttaagtgggggcccctgcccccttctggcatttttgtgttttgtttgccttttgaacatctctcaacactaagaagggtgacagaatgcaagcttgaagaggacaagggccatgtcttacttgtgtccctggcttccacatggctttggtgctgagcaagtgagggctatattgttgttactgaatagtaatgcttctgcacgaaggggtcacttgtgacctctggtgtccttgacttttcctgcaggctgctttagcctgaatttgaaggtataatttatgtcactgctgccagtgacaacttatctatcatagcctgggtttgtaacacagtggtttggtttctctctctctctcttttttgttttcattttctcaggtaaagagtgaagaaaacaagcaatcccagggaggatttttgcaaggctcaagggatgagttaagaggtctgagttctattaaactagctgtgcaagtcattttccttctctggtttcagtttccgcaactgcaaaatggagtggctagaaagtatcagtacttcccagacttccagcatcaatacaccttcctgattttggctgcaacccatgaaccatctgtattatagttacttattattcctccttaaactagctcactttaaaaatacttaattataaagggaaacatgtttctactataaatgaaaaagcaatatcactctcaataagaaaaaagccagggtgaaaataaatacaatataactaaaataatggtagtaaattctgggtagacatggttgcctgctaagggtcctgagcctgaagcctccccgtcctctgttacaaatgaaaatttgagatttttagaaaagtgtgaaagacaaacaagcaccaaatggaaactttcttcttgacataaggataaagatgaaaagagaattagaaaaataataaccctctcacaatgtgattggtcttgtttaatgatgagtttttggagcatctaacaccagtagcatctgaggtcccatgtggtacatatcctgcacttgggatatactcagtggtatgctggtttctgaaaagctcacactctctctcttccctttctctttatctatcactgtctaaaaaaaaaaaaaaaacccaatataataatatactgaaatataagtaagatagtgtttgccaatttcagtaaaatgctcctgctgtggtcagttttaggctaccaatgtgacatccctaacttcgaacataggaagagaaatggagatcggctctcaccagcaggtaggagccaagcagactctagcatatcagtggaaacattgaaccagaaagtctagaaagttccttcgattgaatgcactctagacactaacttccagacagtagagtaagattttttttttaaacctatctctaccactcttagttcagcaatttacatacagcagtggctgattgagtagctgatgctaacatttgtgctcagtgatagaactacactaataattacaataataacaatgtctaacaagtgtcaaatacttactccaatccaccattttctcatttaattctacccacaccacataatgtaggtcttattgttcccattttacagattaggcaactaaggtcagagattaatcaatctgtctaagattatactttaggaagtggcagaactggaaaaataagaaaccccagtgcacactgaaataaacctgattcaaaccaaaatatgcttggagaatgagatattcaattctagttaagcaaacattttgattaataaagaggtgttttagagactatgtaaaaacgaaaaattcttttggcattaaaataaaacacaaaatgctaaaatacactaaacataatggaatatgactttgatgaatcaaatttttgcatgaaagaatatgctaaaatataagtcacaagagttttgattgaccttgtcatgggtaatagtttggattgcttacaggagaaatgattggtatgctaagactgaactggtgagaaaatggaaccaacccaaatgtccatcaatgatagagtggataaagaaaatgtggcacatatacactatagaatactacacagccataaaaaaggatgagttcatgtcctttgcagggacatggatgaagctggaatccataattctcagcaaactaacacaagaacagaaaaccaaacaccgcgttttctcataagtgggagttgaacaatgagaacacatggacacagggagggaaacatcacacactggggcctgttgaagggtgggggactaggggagggatagcattagaagaaatacctaatgtagatgacgggttgatgggtgcagcaaaccaccatggcacatgtatacctatgtaacaaacccgcacattctgcacatgtatcccagaacttgaagtataatttaaaaaaaaatttttaaaaaagcaccagggtcatgtaaactttcttacagttttgaataatttgacagtaaggctaagaatggctatttatggagcacctactaactatataccaggtgttatgaaagggctactgtttatctcttattagcccagtggctctctgaggcagctatcagcattcccactgtatagatgaagaaaccaaggctcagaaacggtcaatagcctgcctacgtttctgttagtctgggcttcacagtcacacctttatcttaatcactctctaactttctggcgataaacttcccactgcatgtgatttggaggtcaggatagaatctataattaatttcatgacaactatttcctgtttgaagccatgtacctattcattaggtatttcttttttctttttcttttttgagacggagtctggctctatcacccaggctggagtgaagtggcacgatttcagctcactacaacctccgcctcccgagttcaagcaattctcctggctcagcctctcaagcagttgggattacaggcacctgccaccatgcctggctaatttttgtatttttagtagagatggagtttcaccatgttggccaggctggtctcaaattcctgacctcaggtgatccactcatctctgcctcccaaagtgctgggaaatacccatattctttaggtatttcttttgtagctagcatttctgtgacctggtcacttagaccacacagtctggagaaaatactgtgtgtgtcttatgtttgctttgaatgatattcagctgttcactacacaatattaagtgaaatagttaactttggatacttatcttttctcttctgtaaagcttctgaagggttgcttcagacagcaagtgtgttaattgttaactccattttcatggcatcaactggaaataaggatgtcctagtaggcaataaaatgatctgtcacagaccccaaaggggatgtcaaattctgaaacactagggagtggctgatgaaagaaactgatagaagatatagcagatcagtgtttaagacttctctaactttttaaagcgcggtgttttttggttggcccatatgaacaaaatacattagaaaaaataaatggtggcttccattggaaggtggccctcagctccagcatcagaagaccacaaacccagctggcttataacagggagctggtctctctgtgacctcgcttaacttctccagctgaattgattttgctaaattccctgctgaaaacgctggaagtctgtaccataggcaagctccttcatgatcaggctcctgcactgattgctctttaactccatgcctgtcatttttctccttctggcctggcctttcacaaggaacgtctagttcctaaaatttactagatcttccctttcacctccaggtctttctatcttggaatactctttgttctctcctttgccaagcaaaactctacttattttttaggtctcagcccaaatgtcatttccttcaatggtctcccagatgaggttgggtccctttggtccatagttacactgcactggctactctctctttctgagtaatcaccatgcttgtaaactacccgttgagaatatgtatctccctcatgcaaatgtccaataaacagcattgtccatcttatccattgctaacccccccagtgtctagcacatagtaggcactccataaacaggtatagaatgaaggactaatgtaaaatgaatgattatctggacagcacaaaggaagtggagaattttgaatgtctattacttcagtactacggtaaaatagctggctggtgagtaaaatctttataaattatttttgctggtaatatatgaaaaatagatgactctttcccttagaagtagtatcagctagtggatagtttctggaaaagtcactaattgacttcacctacagatttctgtgtatatatggggaataacatttttgtaataataaaggagcaatttagggtagagtcttaataactatgcgactttgacaaatcactcaccatcacttatctataaaatggggatgctaattaaatcagttgcatagactgattgtgaggatcaaatgagaaaatgcatgcatacacttagcacagtgtccggcacatagtatgtgttcaataaacgccagctactactaccacagttggtgcttctgtccaaggcagacacctccactctgaaatatagaagccaattgacttaaaaattacatgtatttggcagtgaataatctggtgatgttaccctctggagggtgaaccaaaacctctgtctgcatcactcatcatcaacccacactgtaaaaagccgtctctcctaccctggacattccctgaagccaaagcataagtgaaatgccatcagagaaaatactaacaaactctgaggaatattcaccccactctagaattcagactgcctcttaacaaaaatgttctgtgaacagaagtgaatgtcattgattcagtttgggctttagacccaggtggcattctcgttctaaggcatggcatcaagagctctgcacaaaagcagtcaatgctactgatttacacaaacgtctcgcaaattctagtggggagaaacatatctgttttgtttcatttccaggtggcaagacaatcaaaatgctggcaaaaggaaaacagggtgaatgagagtaacttaagacaaagaagactggacatacggtaggtttcaggcccttgacagccctaagataggctttattcttcctgttgtgagtggcttccatgttgtgttgtgaccacctcaaatggatttatttgatcggaggaggatgtctgaattctaggggacttgagaagacttgatataaagttcagacagaacttgataaggttctgtctgctttgagatggggcctgggctactcctacatctttattcctctgcaggggccccagggtttagtgaaggaagaattcacgtgagctggggggagcttaacctttccaagccttagtttcaacatctgcagaagagtgttgttggaatgggattgttctgaggattcagcaggaaaaatacatttaaagcacatagctttgtgccaggcacttagcaagtgtttaaggaataggagctgtagctcttatagttattttagacttctgaattcatctaatataaccatcatcatattacactgaaggagattaaaagccaagatgtggtaccttgttccaggtcacacagctccttggtaaggggcagagctgggttaccatcccagtctccctaccctgtgctgtcttttttactgtactccatggactctcaggactcctagctcagctgagctctccggtatatcatagttctcgggctttccacctttgccctctccagtcaagtctccacccccaacattcacttaatccctaaaccgtgtttatgtggcctccaaaatatccacagaagtgcctcctgctttcctgcctcctggctaatgcagctgctattttgtccagaagattctcccctcttctgtatccatcgctgactccttcaagcttgagagcttaagtcgctcatgtcctctgcagagagaccttgcctgagcatcctgactaaagtaatatcacctccccgctttctcttgctctccagtttatgtcctgtggaaatgcttctcccaccggataattttctttcatttttaattgcctgtctcctttactaaatgtaagctcccaaaagggccgagaacacacctttctagctcgttgctgtgtccctagcacctagcacagaacatgacacataggtgctcagtaaatagaagttgagtaaatgaatgaatgaattccagaaccagcatatttgttaacacttgcagaggacagaggaaagcattgtcactttctgtgggaggaacctgggtacctgcttgccctcttcttggcctcctaaaagaacagcgagtggctacccacaagacagggacccttccaaacaggcatcccacgcaaaagcacatcttgtagtcaagggaaatgggcagatagttgctaattgcgtcttccaactgggctgatctttcaaaagttcgaaaggcgcctgcctccataaatcccaggctgctactgctgctgaagctggtgagggaggagaggagggtgcgcttgggcgcctctcgggctggcacgaagaagccacatctcatcctccctcctccctccagctcctctccaagagaggaagcaatgcagatggagacgagaaataaatattcctgcctgctccgtgccactgcagacgttttccaaaatgtctggcttggaccatgaaacaagcccacccaggaaaggaggcgctcagcgggagaaagagggggaaagggtggcatatttgtcgatactcgtcagctttctggggggcagagcacatggctcatccttggcagctctgctgaggtggggacgtggtaagtgcacagtaatacttaaggaattgaatcagaaatgggagtggagttaagaaactcatgccagagcgtcggcactatctctatgcctctgcacagggtcctaggacgcacagctggttctttcacaggtttcaagctctttgcacaatacctgctgcctctgctcatcctttttacttccactccactcctggggaattaacacaattgggccgaaggaagccatcaaaggccatttggaatttgggcaggaactcagaatccatgtgtggagatattcctgccacctctaaacacagttcactttctctaatactggaatactggcaggagatgagaacacgggctgcaaatgataagtgggtgcttttggcctggggtggccaagtgtgtgggagaagtgtcactaaggagggaagttacgggcccagcaacaggcaccgaagtgttctgcattacactgcctttgctaggcatgctgtgaggctgcaaaatgtctctgaaaagggagatgagaggatgggaatttcagtttgaacacttctgcataggatgctctgggtgtcctgtttctaatcttcctgtgagactctctggtgccctgttcttgatatcgctgcccctggaccaccttcccatagtcctcttggtaggccagtaattagggtggggcccttggtggattgaattctgctcagtaaagagtagaggagctttcctgagtttcacaggttcaagtccaatgcaacaaaaacagttgctcaaagtgaagacacaaagaaagcaatgtcttctacgggtgtcagggaaacattttccagaaatgttgcactgaattctgtttcttttcaccatttccaggacttcactgaggaatgaaacattgtctaatatttcccactcatgtgccctgaatccttctttatgaatcttccccactcatttgcccatctgccttccagtgccaggcaattgccagctgaatcccactctctccaggaagccattcagtggtgggggaaagctggcaggacacactggttcctgtccccactctgcccattgctgtgtgacctcagacaaatcactcccctctctgggccttcattgctttgtcaaaggagtgggttggataggtttcctttcagctgtgacacattataggaatgttccataagtgaaattggatggaattcctactgtcattatccccttcccacctcacctttgccaataagctccagggataggggccatcgcacctctgggattgaattcaatcctcgtacctgggaaggtcagaactgcatatcagaagaaactgttttaaatgttctgtttatatttcccttagttcccaggaagattaatgtatgggttggggaaagatcaaagtagggcatatttggaaagaagttgtgtgcatgtatgtctgcattttacaataatcatattagttactttttaaaaataatagttgccatttattgaactctattatgagctaggcctatgctaagctcttttgcctacgttattatcttcatgatagctcattagggaacatattatctgccctgcactcccttacaaatgagaaaactgaggttctgaggggatgggacatttgcttaagatcagacagctgttaacattggcaatgggatttgagcctggatctgttggattccaaggacaataatgtgccatccactaccctgtgctgggccttgtcttggcattcagtcactatctgggagattcttcatacagtgaggctgttttaaagacccacaggcagtgggtcctaaattgattccctttcctatggtgttgtcagaggaaaacagctagtctcagagccagcaggaacctgctgtcagaaatggcagggaagcatgcagctgtggtgtctgcctagcatcaggaagagtgggagaactgggcccccgaagcagtccatttatagcaaccatcttcattgatcatttatccatagaaaataaggctggtttctgcccagacttagctacctcatttctatggccttgcctaattctggcacagaatcagggcctcttggaatttgcaaataattagatcatatgtcccagaagttgtaaacttaaatggctcctaagcccaggtaggtatgtgaatgagtgaaacagccaggagggggttacagcaaactgcaaacacatgtccagtctaagacccccaagacacagctccagcagagttgctgtgcacctagaatgctatgcaggcacccccagaaatacagaattttctgtgaattctcctgatttttaaatgtaggcaattcagttaagaagaacatacttgacacagtgaggaccatataaaacatatttccaggactgagtgcaggtcttcatttaaaactctaaaattaatttttcttatttacagatgaggaaatggtggcccacattaagtcatttgccagagctagctaaggtgggcttaggtaggcaaatctctggatgcatacaaatagcaatgtgtgtgtgtgttcataaaaaatacacacatattgtacctttacaaatgaaatagaaatgatgttggattacctgctgttattaaatgtttggcttttcacatagtgttaatattatacaatagttgactataattaacacacacacccatcccaaaacaaaatgacacaacataactcctctcccaagccgaaaccaaaaattaaaacaaaagccaggaaataaagaagctctttacttacggtaaatgacagaaaagaagaaaacaaagtcccttcgtcatatctggataattttgccagcactccttccaagatagtaacgaactagaaaaacagcaaaaaagaaaaaaatgttatttcaaactataattgttcaccataaagcacatcatttccccaccacataaaggctgggatcgagccctccgttcatttctgcagtctattatttgattcccgccttcggagaaaggaatagactgcctttacatagaaatatttgacttatccggctttctcttcattattatgtgattgcaaatatagagtgttacagaagtgcaaagtgacaaaatattattgagttgcatatagcatgcgataatattaaatgcactttttaaaatccaaaactgcgcaaagcagtttctacgttacatattagcactacatttaatccaatctatttttatttgtattttatcagtaatttgggggaaacagaagtttagcactggcaaatataaatgtcttcccattcagcattacttagttaaaattctataattcatgagggtgactgaaatagctttatctgacttttatgttttattatgactctcactgcatgtgaaactagaggaaaaggggttttcatgatggcagaattccttattaccgtttaactttctgtatttaaaaatctaactttgtcagagctgaaaaacaaaacaaacatttctcatataacctagcgcaacgtttggggacaaattcttattaagttaacatatgccacttcatcaatttatcttcacacggctcgagatcatcggaaaatcatttagagctgaggctgggtgatgtacaatcttgtttcctgagagacacaagtatccagctcaactttttaatgtgttacattttaatggaaatggagacataacaaagcagtgttcacaatgaaacatttcacctgaagctggaggttacctttgcaaccaagagtgttatcatttctttaacagtttcttcaattagttcgtctatttttgaatggtattgatgctaagaacacagaaagacaaatattagcatgtttgggaggtgatggcactgcatccgtcagtaatttttagacaacttaatttataaataaagcctggcctgcggaccccgtttatttccttagtcccagaaatatttataagatcctgactccagttctttgatagagagagatctgaagctcttaaaaatattaccaagttcattgttccttactcaaggctttcgatgcttctaatgtgtgtagacacttaaacacttttacaaatagcacacatgaatgacttaatgacccagcagtgtgttgatttggatcttacaaagcaggatactgtaataatttaacacaggagattaaaaattatctttggaaaactgctgggggttgtggcttaggtagtagattccctttccaaagggaatttgatgaagacactgtgactaattttgcaaaaactgttctgaaaccctcaggttctttgggttaatacctcagaactcctcattttgtctccaagtcttgactcagtataaaggcaaagtgtctctttctgaactcttgtggcaagccactcatttcctccatacatggataaacagacccagtatgagagcctacactgagaccactgctaagtttttaaatttctctaactgtgcctgtcaattacatttaaatagtaatgtgaagacaaacccccacacaaataaaaatctgctgtaaatgccagggaaaaaggaaaagtgattttaacacaaaatattatatgccagctccttgacatttattagatcattttagtatccatttgaattatcccatatttccctaacaaaaaataacaatgcaagacattgttatttgaaaaggaaaatgcacttacccacattttagcaaactttcagaaggatgattaattaggaacagaaaaaaaaaggaacagtgcaaatacaaattaggacaaaaggacacatgagaaaataaaaattaaataaaatattcaaaagtctatgtaaacatatggaaataagccatagtaatgtggtttaatattctgataactggcaatcagaattattgagagtgaggaaagggatgtgaattaggtaaatccatttagaatcataggcgaggtttgtttgtaattggaagacctggataaagtcccagtgcaaagttgggaagtcatgttacctatgaaaatttaactcagtttccttatctgtaaaaaacaaacaaaagagataataatactatcatcctggaccaatgagaagggagaaaccagtatgaaactctgattttggaacgggaacaaagccaaccctgtataaagatttttagcgggtctatgctagtattattattttaaaaaccagtgcccgagtcctttcctgtagtcatgccttcagactcataagtctctgtttgggagatcaagtgagagtctagatgtgaaaatattttgtcaactgtcatcgtgactcaaatattgttagttgttcaagttcatcaagtattagataagggtagagagagacagtcttatcacttagtcatctcctccagtttcattttaattgattagaggaaaaataatacagctaatggcttgtatgttgtagtcccgttgaatcagaacccatgttggctatactgctagattcaaaaaggaatttactcctaagtggcataaacctgaagctaaatgcaaaaaatttatctgcagaattctttgctagaaacacaaagaaagatgtcagagcaaaagaattcaggaaaattgacagggctccaaattcatttttaggtcttgagataagatccagaatcacatgcttacttttcctcctcatatgactgcctcactcgtctaggttttctttgcattgctataaatgattcacatttattaattatgggagtaaactaaatcagaaaagctagctgtgtgcaaaataatatgaaatataccaagcaaagaagaacatcattgagaaacaaaacactctcttgaaaaactgggctgaagtggcaaatagagactagagtaattgttctccacacaccaacaaagatttagggtcttactctgaggagttaatgatgtcattctttctcccaagagaaacaagctttctcttcaggagctagaaacttcaaaccctttcataaggagacatggttgagacatcgtggcttatggaaatatgatgatttatgggaacctcttcccatttcaatttttccatgccaaacttcgccttaatttttctccaggcagtcccactatctctccctttcactccatacaaatatgatcatctccattcctcttctgttataatgaacgttgctttttttctgcttataaaacaaagtattttgatatgattattctgtctctcccatccaggggaaactttatcatgtcaatctctgttggtctatttcctcatttttgcagtggggctagaattataacttgtgaatatagacatcatattcacttaaccaaataatgaaacaatgcatggaaacgtggtttagaaactgagaggtgctatgtggcagtattactactactactatgattaatagattaacatagtggttgcatgtgtatatacatttctctaaactcacctaaaatctctatattttgttgtatgtaaattatgcctcaatttaaatataagcttctttgtggaagatagcagagcagggtaataattactctgtttatcatgtagcaaagaggtaaatatcaaagcagcccctattcctattcaagtaattacagaatacgtgaatcccttttgctagttttccctgatatatgagacttattggattaacttgctttctggagtaatagtgagtactctgctttcactccttgatctttcttgggagatatattgttctgtgcagatgtgaagctccatgaaggggtatatatatatcagtggggcaacttttaattaacaaacattcctactagacaattttgttataaaatgccttgcagtctgatcgactatccagatacggtacaaagagggagctttaccattttcccattttccagtcctctctgctggccttttttttttgagatggagtcttgctctgtcgccaggctggagtgcagcagcactcggctcactgcaacgtccacctgccgggttcaagtgattctcctgcctcagcctcccgagtagctaggactacaggtgtgcgccaccacgcccagctcatttttttgtatttttagtagaaacagggtttcaccacgttggccaaggtggtcccgatctcttgacctcgtgatccgcccaccttggcctcccaaagtgctgggattacaggtgtgagccaccacgtccggcctctactggccttcttggattaacttgccctatactccaaaattatatcctgagggaactactaatattcaatggcctggaaagtttggtcagttcacttttgcttctgatgggctgaggtgcaaattcacaattactgtgtgaaaatcattccacttgacttcctgtgctacacgttttgccttgtcatagaacagattgtgtgtatgttgtctttctgttaagaccatctgaccttggaaatgagatgaaaacacactagaccaagtgagaaactatttaatacgcaatttcccttctattggtacttcacaaattttaatgaaaaaaataaatacttaagatggaaaactatgcttaacaaatgtttcagcagctgcctttacatgtgatattacccaatgatgaaatccaggatgcgatcttaaaaatggagatttcatcacctggccagtatctaatctaaagcaggttgagggagttgggacccaggtggaggctggtattagtagctaggtctataatatgggcttcatatcccatactcagaaatacaaactacataaaaacattggactttcatctattcttatcccagttccaggatgtttccagatattcttgttaaatctcattttagcaactcagctttactttggagatgaatattcccattctacaaagtgagaaaaatcaaggaggaaacatttccatatgactttccattgaagttctgattaaggttacagccactgtgctagaccacttagaagaagtacatatttacagacaattaagtcaagctagctttattctcacctgttctcagccacttggcattcaaagaagcctcatttcccacagctggtcatttaagtgtctcagattcaattatactaaggaaaaatgtcacgaaagatctctctaagatggcttgggaaaaaaaccaacagtcttacaataagaatcatagactaggatgcattattggatgggcccttaataaagatattcagtctagatgtgtgtgtgtgtgtgcgcgctattttgggagaaacaagaaatgtttacaagcctcggttatttgttttcattaaaaaaattatgttgagtcacatggggagagtatgggtagtcttttctactttatcaaatagaacaatgtctagaaagaaatagacactgctgtttcatgtcaaaaatgttactgcaagtccaagacaactttctgattttatatccagaattaggggactttatttaatacccaattttaacaaaccacatacttcccaaaggttgtgtgttgcatgctatgttcttcattcagcaaatgatgacacatcgtttggcagctaaggtatggagtccatacgatgtcatgattaaaccaaaaggcaacttattcttctataaaaccagactcccaggtcaagctaaggtcattctaccttggcccagaagcaattagtggtaaagagaaaagaagggtccgccattgtgataaaagtcaacttggtctttctcatcctctgtctccaactggggtctatggtttggtcaagaaggtccccaggtcgtctgaaattgtagagtaataatatatgaaagtatttttttcccctgagaaatggctccatacctttttttatattctcagtgaagtttgtgacagcaactcccacgctcccactactctccctaaacccccagctcaaaagcaaaacagcccagatcaaagtgacttggcttgtttggaagaattgtttaaccatctgaccaggtatgtgggagcttttgaaacatggccgtcattgaatcaagctggggagggactgcaaaagctgctgaggagaaggcaagaccagtcctgttgtatcaacccttctgcaccctggcctagcaccatccttagaaaactcagttaaaatgtacatctcaagaagatttaaggggaaataggtcaactgcactgcatttaatttaaaagaaacctgttatgttttaaaggatcccatcgagaagatgaaaaagaaaacccacagaatgggagaaaatagttgcaaatcgtatatatgataatggtcaagtatccagaacatataaagaactcttacaactcaataataaaaagacaaataacccaattttttaaatgggcaaaagattttgaataggcatttctttaaagaaaatatacaatggtcaataaatacataaaaaggagcgaacaatacatgctacagcatggataaatcttgaaaacactgtgctgagtgaaagaagccagacacaaacggccacatattgtatgattttgtttatatgaaatgttcagaatagttaaatccttagagatagaaagtattttggtgattacctagggctgtgaagaagggaggggtgtgagaattaatgggtactcagtttttcaggtgataaaaatgtcctaaaattgaccgtggtgatgactgcataactttgtgaatacactaaaactacaaaattgtacatgttaaactggtgaattttatgggtatgtgaattatatctcaattttaaaaacagtagctccaaggggagaaaaattaaggaggaacaggattctggaaaatatgaactcaaagggatctcaatgaacttttgagatcaccaaaaacagggcctttaaagtgggcttgatgaagcctaagagattgtttaaatattccagagcagcttaggtgggtggtgggcagtgaagaggtgcagagcagagggccacctggcagcttggactctaggccccctcctcccctctccatccagagcagctgtacttttatttgtgtcacatgctggccttcttgatttgctttgaaaaacagattgtgccactaaaaacaccctgaataaaactagaatagtgctaccattttacagatgaggaaactgaggcccaaagaagctgagtgatttgtcaaactccagctttcagctcagccaggggaagaatctaggtttctgaacaccgaacccaggtcttccccaaggggggctatccttcctacctgagtccttcccctgaagtcaggtttacatactgagtatccagatcagtggttctcatagtgtggtctctggaacagccagcagcattagcatcgccacggaacttgtcagaaatgccaattcttagaccacaccgcagacctatctgaaattcttgggtgagactcaatgatctgggtgttcagatgctctctgggtgagtttaacgtacactgaaacatgagaaccactgccccagatcattcatatgagcacacgatgctgggacagagaaccaagggcaccctgaatttgactccagtgcttagaacttaatccccaggaaaaggtcctcgacaagaaaattagtcaggaacagagttaaccagggtgggggtgggggctgaggaagctgacttgtaggggaaacaaggttgaagatgatcttgccaggaagagaataccaccaacccacatttaaaaatggaaggtgctgaaagagaaaataaataacgaataaggagcaaatataatttagtaaaaattctgaacatgtaaggctggtatcgaaagatctgatttaggagcaatttatgccaattggcaacaacatagagttgccagaaatgcttctgaattaattctaaattggtatatgaatatctagctggcttaaggccatcagagaaaaatgatcatgatagtctttaatcaagcccaagttgctgtttccttctcctttacattttaaatactgctttggaattgcaaacttagcaaaggactaaacttttggtcaggaaagattcatgatcaattcagtctaaggaaaattgaaagtctgcaattttttttttcttttttttttttggaaattcagaacctgctggctggggattgggtagcagggtgatctaacattatacatcctggaagttgtttgatgcaagaaaggcctctcttgctgtccagatgttcaaagtgataaaatgcacttcaaatgtgaaaatgactttcattctggcaaacacagatctgttcgagacaccagcctaataaataaggtcgtcaaacttcatttagcttagagaactatatggccaccccaactccagccaagaatcacttccaagtgactgacattctcatcagcacatgccttagaaatctacttgacaaacagatactgaacactcatccatggcttaatccacaaatgttagagtgtatttctgaaactagcagactagggtagatggaaggaatttgtgaagttttcttctacatgatcaatgaagagggaaaaaaaaatctgtatttttttttttttttttacctcttggcccatttccatgctgcaaagttttgttgattgagctttggcatcaaccataacattaaacatggtgcatattgactgtgggactcgaaaatctgttgatcgactggttttttgcagcttaacttcaaatgcaatcctggttctattaaaacaaagtaggaaaagaccaattcagcgttcagatggcagcaggtggaggagatattttctgagaggtcagtgaaaaagaaaattgaaggctgtaatcagtttcagtcaacaatgacttcacatgtgttcccttttaaatgactttcccaactaaggaaggcctattcacggagacagacatgcacacccttcctttccggcagtacccggaacacttgtagcttggcgtatttctctctatagtttacatgctatggagaaccttaattgcaggagaatgaatgaattcacaaaaactcgattatagcagtatagcatatgtaagttctctcacattggcaactgcctaccttgaattacttcattaataaaacaaaacaaacaaaaaccaaagcagtttttaatcttcaaaacctcgtggtggggaaaaaaatcttaaatgatgtttattgctgtgggtttttattttcccctttctggttttgaaagagacaaaaatttaaaatccagcaagtgtattacattgctttaaagactacaaaatttattttgcttgttaaaggacataaaaaggtaatacatcaagctgttaaagatggctacctttgaggaggggagggaaattaggaggtgtggtattgggggacttccactatgttttgttttcaatgtcaatgtattattttgcaataaaatacattattttatgatttaaaatgtcataatatacaactattttatatgtacgcttaatatacatatacaaattcaagaattgtgtgatggtggaatctgaaagtaacataattctgacattggtcaaattaggatctcagcaatgtgctaacaactcatagaaaaagcctagcctgacatggccagctggtaatacaggtgggagatcttatccttgacatcagcattgtaaaaggggcctagttatattttaaaaggtttcagggaagtgggtgatatcatcaaatgtctttaaagaaaagcacctggttagtaagtggctttattaaggccccatttgcctgatgcatctttttggcattgttcactgtcaagttctggagatcatacagccaccaggaaagcattactttaagaggaatttgtagcagttttctaacagtgcataggaggaccacacagctagttagctcaggaaaggatgccagcttgctaacacaccctgagtgcatgcagagaagccaagtataatttctaaggttgggagcccagttcttaagaaaaaaaaaaaaaaaaaaaaaaaaaaaacacctaaaaatcccaaacccttaaaacacccctatatattatatgatcatgttaaagataaatgtatcttggcttctgaagattcagtgcactcaagtagctttctaatcatgatgatcattttaagctacgctgaaaatacatcatttgccggttttgtgaaaaggaggcctgatgaggactgagttggacaggtccctgtgctgatcttctgaggcttgtgtgccagttccggcccaatttgagaaatggaaatgctaaattgctcccttccaatgaagtaatcgtcttcagttttcacaggagaactgttcatagcccttggagtgcagggctgtgaaaagaggaagctgaatgcaaaattaatatgactgagagggctctgtaggaccaaaacgccagaaaaggagaggtcatttaactcaactgactccttgagggcaaaagacagcatgccttgttttgtgttcagcacaagtaacctgatatagactagactagaggctctgtaaatgtctgtcaaattgatgaattaaatttctggagcactgaaacatgaggagtgccttattgactttttgtcatggcatatttatacctatgaaacaatgtccttgctatgttggcttagaacaagggacacagaatctgttctaccaaggagaacaacggttctaggctcttctaatgtagattctatgtattaaaacattcaaaaactcgtccatgctctgtcctctgaatctgtaggtccgggggtatttccacccatttttgctcttgtctgcttttgggctgatttaaaagggacatcaggaaatttaagtgtccaggccagccatacatgtgcagtggagcaacttctgtcagtaaaaggttgcttaacagctactgtgtgccaagcatggtgctgagacctggggagggtaaggaacgccaaatgaaaaagatccactccctggctctgtgcagctcaccctctttaggtgtctgaaccgtgaagacatgattacagcatggtaagggataagagtccctatccacctgtgacatcctcatatctgtccattttctctgagcatcttcccatttcttgctccctacccagactggcctctccatgaaggacatgcatgtctttctgtacaattatgtgcacagtttaggaactggtaagcctttactgtaatgcatttcacccctaggacagatcacgcaaaaagtttttttatggaatggtttggccattggaaaagcattgcttttcctaaaattgatatagactatctaggagatcgtggaattcaagaccctaaggaaatattttgatcttgagtttgagaagtaggcctgccttcagttctaagagagagaataaaagagcaatactaaaaaatctggatcactacaactttaagcttctggaagtggcctcaaacacctgcccagattctccatagtgcatagttcctttctcaattcctgctgagatgctgttcacctacctgagattgcattgttcttttgcttctttgctttccagttctgatgatattacttcacctttcctcttccaagatatgaaataataaattcaaagaacttccagacaaacccggcccccatcacccacaattgatccatcaaccaagctacacaacatctggagatttggagtagcctgtgctgcttgcaatctgggtttttttttttttttgaatgaggaaaaataatgcaacagttatgaactagaaaaggaacttggatgtgtatctgggggtagacagagtgatgatgatgatgtcccctcagtggaattttatttctatatttgatatggagacactccatgaggaaagggattctactactctcattcttcattgtatgccaagaacttagccctgtgcctggcatatgggaggagctcaaatgatgtttgctgaatggatgaatgttgtcctcatttttttccctcaccttctcagaacagtctgcctgggaacttcaagtacagcattcctaacctagtcctaaaagccacagtgacaaaacagggaatctatgtgcaggcaaaatgtaatgttccatgtctcatgccccgctgttgaaatccagctagattttcaacaagacaactacaagttggcccacatatatgctcatcttttatatacggagtgaatgatgatgctaaggccctatccacattgttagaaaaccattagatttctgctagccatactggatacgccagctccagaattgcatattcttctttttttcccttctaattgtccactcaggcacacattcatacatttaacaaatacttactagttaagtattttgtgccagacactgctagatatcagggatacaaaaaagaatggacagggatcttttcctcttaaagccaacaaccatgaaaaaattggcagccagattattttgggtttgggacagatggagggcaggtgaatggaagttagacgttgacagccactactccagctgactttgacaagcaatccccttctccaattagtttcaaactacagccaattgaaagagcagccatctacccttccctgagtctgtgtatggtggggagggtgtgcagaacctgtccagccacctatacttaccttttgacacaagattcgatcatgtcacttgccatcaacttcagccgttgttccaggtgctttccaaactcttcttcaggccagtgcaggtcccgaatgaaggtctgaagggcgtcaagtttccaaaacagatcttctgaggtgcctgacccattactggcaggacaaaaattagaaaatgagagtcacccactggcctcaggctctacaaaaactaacacagagacaactgggggctagaaggcaaacagcagcttcaacatacaaaacaacgtgtgttggcggtggaggcgggggcgagtctccaccggcagattttgagttttaccatacatgacttagtgtgctttgctcagccaattaccccagaccagtgagaagtctggggaaggtgttgccccataacaaccaggagaatggtgtatggtaaaaatcagccttcttttaataaccacattaacacatgtgatgattcagatgaaggccacgaaccagggggagaaatagtctcaacagataataactacatggcaacatgcagttattaaacttcagggtttcatgcatttccccagctcccctccagagtggagacctcttggagattgcacaagacttttcgttttcaaaggacagtgctaacaaagtggtgagcgaggacctgctttctctcttgaagagctggaaagaaattagggtgactcagatcaagaggggtacacctggataccttgattccaaaattctagttcagtttggttactgttccaattttcatagaccagcccattgcataggcagggtcctcaccaggatgaggtgagtcgagacagtggaagttagtggacaagggatattgtcaatgctttagggctcaaaacctgagctcttttaccattgcaccatcttacccagtcctgtgtgcagttggggaaattggttttgatgcctttctatacgatgacgtctaagaaacttttacctggggcatctacaaaaagcctgtgtatgaaaaatgctccatctctcatcctcctgcccttttctggctggctgtcttttttgtaacaatcccatttggagctctgaggggtgtcctcccccccacccacttcctcgcataccactaatgctaacacagtaatttataaaatgtccaacacaccatgcattaccacttgttctgacatcgtctatagaaacagatgagagtgggtgtttctattgtgacagatgccagctgcattgaattaatgcttcagagagaaatatagctagtgcataaatgcatacacagctactgcagggcggggagggggcacacgcccaagcatgctgagagggagcctacggcctggaccaacagggtaatgttttcaaggacagaccagtctgaggtcagtacgtagacgtatctgacacgatggagcaggtaacatataaacacgcccttaaaatgaaaggtggcaaaggaagaaactggaattatgaaaagatatagaatcaggcatttcctggtgggtgattgagaatccacgccttcttttcagatactgccgtgagcattgttcaaaagtgggggaatgcgttgtttctccgtgaaagttcagccttccccctgccccaacctatgcttgggaaaaagaaaccccaactttgtctagtctaagccccgttttggaactgcatggttgtatgttttaaatcattaagtacatatgaatgcaataattggtatttattacaacaacattttgacacccatctggtttcagagtttcaaaaaattcttgtagggttttttttttctttgaagagcttattattaagttttgacatgaggaaaagaatattttctttttatttttaagataaactgttaatgttaaggcaatagcaccaagattattttgattgctgagcagttaccaaaatgtgttcccactcatgccttaattaattgaacggagaccattatctgctttattacaatgtcttgattcatatcttttcaaaaacagtgtcacagagcatgcacagaggaagataagagaagctttctgatatttttaaatttttcacagatactacctaatctaattttttcatatagtcatcttagcatgaatatgatttgtgttcttttttagaagctttttttcagatataaatttttggaggttgtaatttgcctttaaaagagaatcagacacattgaccatatgattttagtgtgaacttgtgagcaattgtaggttgtagaaatatcaggcagctttggaggagccagctagagcagtcattttaatggtctgtcctccacctggattactgcaagaataaaaatgctgagggccgtcttgatgaatgtgattctaagatttcaaaacatcactgccagtttcagaccattttttattcctttgataataacacttccctttgaaaacgtgccaatttattctttcaagaaaaagcttatctggtccgtaattagctgtggtctaagaaaaggatcaaagaagggtacagaatcgctaaaccttatttcacttattaaatcatgcacgtggttctaatttccctgaggtagaatttaggggtgctcgatcttcttgctaactaaaaaaggagagaagattcatttttgaagctagaagaaatggcttctcaaccctcactcccccaaactgctggctttcaagaagtggcccatgcaactctgacattcatgtggatgagtataaagcatagccctatattcagatgatatggctaccacaaatttaattatttattgtttgaatcttgtgtttcgagaattattgaacttctcattacctagctctcaaagcaccatattgtactgtgaccttggaaagtacataatatatttttttacataacatttatgtgactaaggcttgatccattcagaaattttcatttagccctgaacatactgttactatatcctgccatttgctgacaccagaaatatgctttatggtttaaacattctctaggaattttttatttttatttaaagaaaacaccccagattctaggtaggtgtgcttccttcttagatttggatcaggccagagatgactggccagcccaccaaagaggtttcctccactatttttggatgtctagctcctaaagtcatgtcacctgccaaaaagggtagaatccttttgcaaaagaattcaggaagtgaaacatagtcctccagcattcagtgggcgtaagacaaattgttagtgctgtatatatagcaaacatcttacaaacatgatgcatgccagaaataaacaatattgtctctgtatgatcagcaaaatatgtctaattatccatctccatctctgttatataggatgtatagaaataaacaatacatatccatgccaagatcacttaaatttaaatgagatctaatgtgaactgaatacacactccgcatcatatatagcagccatccatgacggtgccgaaaaagtaggcatttgtgggatgcctagagggatgttaactggtagatttggtactttgggaaggttcacattgggtaggttcacattgggtaggttactggttaaactcctgtggaagaaacagacagaaagaaaaaataccatcacagtgacaatgcagatgtggcagaagcacacgacaattgtaaataaattgaccaagtccacagcaagacaacagcaaaaactcaagcgacacacttcagaaagcagcttacagatgggaagctgtggtgtggctctgtatccagagaaatgacaaaagttaatggaaaaattaaccacacagtgacttaaaagtgcacccatacacaatgatcacatgcctttgggaggggcctttggtttccatatccattgccataagagtctagaacttttctcatgctaagaacttgaagttcctggaattcttggtgtggctggggctggggttgctgtgaagtcactgggattgatagaaatggtggagcacttcaattttcttatttttaaaacaaattactgttgatggaggcatatttctcaatcagacgttagacaccaaatagagtaggaagttcacccacttggaggcacacctaatggtgatgtacagaaaccaagctctttctaactgctgcttctaaagacaggtgtatgggcaatggcatgtcagttgatggtgaaattatgaaattgtatcaagaagaaagatcagatttgaataattttatagaacatttaaagaaaatagaaactttctctctcaaactaagttcaacaaaaatgcagaaatgtttacacacagaaacagacaccaaggaaatgaaaacaatccccaattcagctcttgtattagactctttgaccaaaagtggatttaaaatgtggcttcatatcataatagttacccttggaagtgggacagacactgggagaaagcatgaaagggacttctggggagattctactttttgatctgtgtgatggcttacatgggtgtgtgttcaatttgtgaaaattaatcaagctctgtatttttctgtaaaaagttaaaataagtgactaaaaagttaaaaatgttacctcataccagccttttgtttttggacaaagatggatcaactgacgtgatggaagagagatggatggttttataagtagagggagaaaataaaacaaaacaaaacccccaacttgaatcaactgtatttctttggaaggacggtgtcatacacggctcctcaagctggcaccgtgtgtctcagtagtggcattttaagggtgttccatccagccaaagtcactggcacggtagagcccagcctaactctgcatctgagaggagccttcctgtttaagtgaagttgacagcactttggcaaaggacttgaggttctctttttggatcttgcaggagaagagcaagttttgccaaagcagctctgccctgggcaagctgtgtttgactaacaggactcctgcaagagctggagctgcctctgggcttgcttgggtggggaagtgggggagtaggggagtaggggagtgggggagtgggggagttagggaagggggaagttagggggtgggggggtggaggtgggtacatgccttctgctaagtcagaaattctggaccttgaagatcacctggatacctgtctccctctagaaacagattattctttcacaatggcaatatagccccagctcatagactgaaaaacctagaatgcaaaattgtctacctggcattctcttctgtaagggaaacaggtgtctcataaatttgtcctttacacctcacattttgggaaagccaattatacatctctacttggaactaaagggtgctcttgtgggaatggtcaagaaaagattaactatatgactattaaacagaagggaaaatggaacttttccttttatgtgtctctgtttaaatggggaatttgcctttgaattcagtccctggtggctcttagtcttaaacactgccatgtaacaaaaccgttggcgatttccactgagacatgtgtaagcctatataagcaaatgtgatcattaaatgatacacacactgaataatgatcaaggaattagaagatcttagagatggcagcccggaaagttaaaatgtcaattctgagcaaattaaaagtagctaggagtgcataacatacaaatgtatgcaaaagcaatttaatttaaacatattagcgggtggcgggtacacaaattagaagcaagcttcattttgcacacaaaaataaaaaaaatacttctattaatcaaaacatattgtatttgtaaaatatgacatttcagctagactactgcactggactcatagaaacatttccttctctttttttaatgctctgctttcaaattttataatgctctacttttaaaaggatgaaacatgcttgatatttctgcttttagaaaaataatgtagtgtattactagtgttactaatatttcatttggatattaataacataaagaatcaaggaggtaattctaagcataatattttactaatatacatgtgaaaagggggaatttttaagtagcacttagttccaatcaggctcctggaactgctgatgactataatgaattattactttgaagagggcctttttagcagctaccttaaaacaagttagttatgcatctctgagagaatcataattggatatctctggatagtacaagaagtatgaattgcaatcctaacaacttatatgcattaaaatttacactctttcattcattttggggactcttgaaaaagaatagcttccatttaggccaaagtgcccatccgtggatggtttagaaacattctcatctactcactcttacatggatgaatgtcacagatgtgtgcacgtctcatcatttctatggatagaaatgagtggaggtgaagtcattcctgcttctagaattgactctaatcaagacactgactccatgcagaagggatagagttgtacctttctcaaagattttggctttagatttatggatggggttgtatttaagatacaaaatgccttctacttttatgaatcagttgttgcatgcatatatgtagcacatcttgtcttttcttagtgctttgagcactgaagcctctgtcagtgtttgttcttaggtctaatccctactttggggcaggggcattctctaatatcttcctagaatctagagcagtattttacaatcttttactcattatcaccctgccccacaacttccttctccatgaaaatttaatacaacagatatatagaatatctgtttatgtattatatgtagatctgtgctatatatataaaaagagtaagacgtttttaagcgccaccctcccacctgagtcaattttctcaacttatgagctgtaaagcccccattgagaatgtatcatctacagaaaaaaaaaaaattccaaactttgtgggactttagaacctcccaaacatctctccaactttatggcttgcctttgttataatccatgctggcgaaaactcagcgtttgcatgctctccctcccttgtatttctacctttgtacatcatctttcccagcatccctaccccttttgaaatcctgctctcaagctacgtttttcatgaccccttagtggaaattgatttccctctattcttatgtcctcataacttttccttatgttatttgtaaattacagattttacattggcaaatagagtcgtttttcctttttcatgataattttgacatttcataaagtcatttttcttgtgtgtatgttgctcagacccaactagattgaaaccctcatctggggaaacatccccatagttttcccattacatccttatcattttcagcctgtgtgggttctttaacaaatatggcaattaatcaacaaacatttattgagcacctgttatgttccaggccctgttataggtgttagggaggcagcgatgatcaaatgtgtatatgtgtctgaatatggacagtgatatcttcaagaatgttagcattggaaaagctttggttattcaaagtccttgtttgacaaggtaggatactgagcctcagggaggtgaactgagggaggatctcaactcaggacacttggtggcccaaggtcacccagcaaattattggcagaatcatgagatctgacaccaagtacattacttgtctatttgacaccaggccacctgcatattgctaaggtgtctttggtctgatggttgatatgctaatatgttccaccatagtaacaattttacttcacatgtatcttatggcattatgttttatatcttaaatatatacaataaaacctattttcaaaaaagatattgatggccaggtgcagtggctcacgcctgtgatcccagcactttgggaggccaaggctggtggatcacgaggtcaggagatcgagaccatcctggctaacacggtgaaaccctgccccactaaaaacacaaaaaattagctgggcgtggtggcaggcacctgtagtcccagctacttgggaggctgaggcaggagaatcgcttgaacccaggaggcggagcttgcagtgagccaagacagcaccactgcactccagcctgggcgacagagcaagactccgtctcaaaaaaaaaaaaaaaaaaaaaagatattgatatctatgactatttggaaagtgacattaaaaaatactttttatatgcatatctgaggcagagtgagaaagtgcattttgagaaatgagaatcccagattttacagtgtgcatatattaagaagcagtgtttagttctaccattcagagctgatgcagggcaagagagccccaaagtagggcttagcccatgagggttcttggcttcacccaggaaagaattcaagggtgagccgatggtaaagtggaagaaaaatgctttattgaagtggtagtgtaaaatctctggtggtgttacagtgctgtgactgctcctgcagagcagggctttcccacaggcagtgtgcttggagtagcaagcagctcagggcagttttgcagtcatatttatacatgcttttaattacatgtagattaaggagaggtttatgcaagatatttctaggcaaagggtagtaacatctgggtcatcaggtcattgacatggaaatgagtggtaactccatggcaatggtaaactgacagggcacactggtgggaatgtcttatggaaagccacttttgccccatccttgttttagctagttcccaatttggtctggtttctgaaccccacctccagagttaagttctggctcttgcctcagaacagtcctaacttgaagtgggcaaccatgcagccaaggattccccatgcctggaggtgtttaagtaaagattgagtgaccatctgtcagggaaaaggtagtaggcaagggtggtggagctactagacttggtaagactttgaatgagttgttttctaggttttctttcatattgaaggccaccatggcttattaccaatgagctaacactgaagagctgatggaaatgttgtccatttcttgttaggaccaaaacctcatattcacagctgccagaaggattgtgggcaacctgcccaactgtgagtggtgaccctactacatgtcctgatggaaacccatgagagggccatgggctccagattttattgacaacttgggactgtctttgagaagctgactatctttagctatggttagaagcaaagagatgacattgtccaccaattcatagagattctaaccatgactgtgtctggcttaacggaaacagagatgtagcttcccttttctcttttcgaagagatggaagactgtctttctagggaaaggctgccataggactcagccattttaccctttccgtcaaataacttcaattatttttgttgttgttgtttttgttgttcatcttaaataaccttaattgtatcaagcctaaatgatgatatctattttcttttacagggccatattttgaaataagaaaatctgaagaataaaggatatttttcattctctttttagcaaactcaatacattggtagcattttcttgtcagattgctatttttcttcagcattttgcatgctaattattttgaacattacattgcatttcattacaatgcatttctcattttacttataacgaggtgcttataaattttgaaaagaagaagaacagaactacttgaggataacaattgtttgaaagaaaggctgtgtgtgtgtatgtatgtattggaagattctgtggcaaaaatggaaaagactgagcaaactaaatctatttacctaagttagtttcttgttttggggtgagcttgatgagaagtatgccaaaaagatcattcttcacttggaaaaaaaatctaagaagagaaatgaatctgcttcttcatcaacccaccaataagtagtcagatggaagttcacactttatttctattcacgttgtaggaaacatggagagagtcactcctcttagcacataacatgtctccaagctcttttttacactccattttattccattctgcaaagctgccccgtggcatccacactctgtttaaaaatcggctgatacagtgtgtgtggtagcttgtattttagttagcactgtttttattatttatttatttatttatttatttattattattattttttaatagggactcactctgtcaccccaggctggagtacagtggcaggatcatggctcactgtaaccttgaactcctgggctcaagcaatcctcccacctcagcctcctgagtagtttggactacatgctgtgccaccatgcctggctactttttttattttgtagagatggagtctggttatgttgcccagactggtcttgaactcctggcctcaggtgatcctctcgccttggccccccaaagtgttgggattacaagtgtgaacaaccacacccagcccttagttggcacttttaaagatctccacagactctgaaaggcatatactatttagtatgaattgaacaaaccacaatcatattcactaacagcataattttagatagcaaaaagctactaaaaaacacacacgtatctgcataattctcaggttattattcgcaactattattcctttattcacaatttgcagacctttaaattgcccatgcaagagttcaaatttttttttaattggtaaaaatattcccaagaaaacatccctagactaagatttccaggtatgaagatgatttttgagtctatctttatttctgatggtattaagaatatttaatgcccccaaagaagtagcagtcatgtgttaaacttttattatttttttttttgagacggcatctcggtctgtcacccaggctggagtgcagtggagcgatctcggctcactgcaagctccacctcctgggttcacaccattctcctgcctcagcctcccgagtagctgggactacaggtgcccaccaccacgcccagctaattttttgtatttttagtagagacggggtttcaccgtgttagccaggatgttctcgatcccctgaccttgtgatccacccgcctcggcctcccaaagtgctgggattactggcgtgagccgccgcacccggccgtgtttgacttttaagaaatttaacagattataaaatgacttagtgacattatcacgaagttccatgacaattctcagacactggacaggcacatttttaaaacttcagttttgcaggggagcaaacaagttcatagaggtttgaacccttgacttctggctagtaaatgggcactaaatctagggctcttcaaggaatagtgaaggataccaattattctcttccatgtgtgttggtagtagtagtctccgtatttaagtgcaagtaagtaaatgttatttcaagaccattgttattttaaaacgtaaatattactcattttaaccttttcctcttaatagctattctccagcacaactgtcttcattgtattgaacattgaaaaaaaatagaggctctcaataatttaccatcaagggatccagttctaccctcatgagtgaaaagtcagtagggccatattaagagactgttataaactggagaataacaaactaaaatttaaatttcttggtatttgcaaaggaggagctactggttattaacctccctgcaatagggaaactcctcttgtggctcagatgtggaaggggggcagaaaagcctattttgcattaatttatcagtgagagccttatacagtataacattagaggagggtctcagttcagaaaactgcttaaaaataggctgcaagtcaaggcttccaaactgaggaaaggcctcatgaatatttgttctggagttcctaaaatgtgcttgtaacatccctctactttgctccatactgtttgctgcatcccaaagatgtaaaatactagcatgaacgaaatgatttccttaaaaaaagaaagaaagaaagaaagaaagaaactaacaaggcaaatccagcagtaggctttactggagcttttcaaaccatcaaaccataaccatcaaactctccatataggagtctctattttttcagaaaggggagtctgagactgaccctctggagcctcaagtcaagccctcttcccatttggggaatggagatggcaccaagcctgccaaacattttcaaataagacctaaaatttgccaaacatttgtggaaattgacaaacttgcaacccacaagatttcccataatttatcctgcagggtatatgtcccattttaaaaaaagcacacggttgtcaaatacatttaggaaaatccgggttaaacagagttacacaaaattctaggtcagtggggtaggtattgtttcctaaacatacttggccataaaggttttttttaaaaaggtgcatctaaaaggcctagaccaggcaatggcaaactatggacctgttttgttaacaaagtttcattggaacacagctacactcgttcatttacatactgtctatgactgctttcatgctacaatgacagagttgagttgtgacagagattatgtggctccaaaagcctaagtatatagtatatggccttttatagaaaaagtttgctgacctccctgcctagaaccccaccgaacacactttgggaaacactgaatcctagagataacaccattggagtaagacataccacacaaatatcacagccgagtttatattccttcttccttatttatcttgtgcaataagagatttcatttcatgaaacgttttttcagcctcttcccctaccctacccacctcctccatccccgaccctcctgccatttgggcaaagaagctatgagcatcatagtagaagaaatgtatggtgtttctctctgtccacaataacagtgaaacccatatgacatcattaatccatttctgtattactctccagccatttgtacccaaactccgatggtatcaaaaaaggtttccttacttgactggttcccatgactcccgctcaaagcccctgtgaatggattgtgcaattgaggactccatcagatccacatatctaacaacaagtggggcaaacaggtcttgcaggtgtttgtgaaattttccattgcacaaattatctagaacagataagcaaaagcttgttaagaacccacagctactttatcaacgtacaacacacacacacacacacacaaacacacacacacacacacacacacacagatgattgattgtcttctacattaaatatactgcttctaaggaagccaaaaagagaagagaaggaaaaaagtacataaaaagcattgaaatggaattcaaaaacactttaccccttggtattgatcttctaaaaggaaaaacgatcatgctactttaagaaacaacagaaacaacaatccacactatttttttttctgtttttcttgcacccacttcccttcttcccattaagttcctaggaagaaagaacattcttcatactctgccctccttcatcaccctccctggggaggaaggtctattttatggctgttgtcactataacatactctgaaatgcttgacatgttagtcagctggaaatttttttttcatctagaaagcatcttttgataaaaattgcaaaatatgaagaggttaattaatttgagagacaatcaaacacacaaaaaatggatacctcttctcacattactctcaggttattctgtctagttaagagagagcgtccctagaacaggatactttttggaagaaagggaatacccttcagctgtatgtttctttttggggggtggggttaatcataataaaaccatgaagagctatgtcaagcctgtagtctgcttgggataaagacatcttagtgatctgtttatctgcacactacttaggaaagtcaaacagtcaaaggtaatacatacagtcagtacggagaaaatcattcagcagctgaaatagtggaaaactgtcccatgtgtctggaggttgcacctctaaggctgcatccatgtctactgcaaagagtgacaggaacgtctccgcatgctccaccattaaatctgaccaccacgcaaaggcctttaaaatttggcagaaaaacaatagacaaagaagtgatgagcttctttctcggacataagacgtgaattccagccctcactgttcaaaattaatggtgcatccagcagggtttggtaattttattgtaaagagaacagaatttttgatacaattggggtgttaagtgtttaaggcagtgctttgcgttattccaggcctgccatagagagcctttattctgacctatgggtcagaggatgctgcagtagaaatgacagacgtggaacttctgttcaatttacaataactcagtacattttgagtcatgctctttgtcattgttgttggctagttcttgctctaaggtattaaaatctgggagtttcttcactgtgtttatgggttttctgctggtctaacttgaaaatttgtaattattgttcacttatatctacatatctggggcttgtctatggtctcatacaaaaactcaagaactcatgtttccctacacattggaaatgttactcctatttcatactaagtcaaagaaaaccattgttgcaattgtcacaaaacttttgagttgtaatctttttaagcaaggaggctttggttttgtatccagtctggaggaaagatcaggcttaggctagaaaacactgagtaagatcaggagttacttttctgggggttggacacatatgtacattgaaaaccaaaaaatatcagtgaagtaactcattttcatgcacatgggcccttggaaatcattgtgcagggtctcagggggtgacattcacatcagactgggccagatgtgaattcaattcaaaggcatgcatgcatgttgactaatcatttctggcagggagcatgcagaatgagtggcagtgtcaacaggccctgttttgccgatttcaaagagagcagaaaaacaaaaacaaattgccagcctcttctggtcccccacatccccattcaatgccgcaaagtatttacattggaaacactttccggagcattcaccaaaaaaagatgggaaggcatttgaaaatatgaaagatgattatggaaaaattccataaatgaaagggtttgttcaatggccaagctcttctgtgatctattagttattagagggatattctaacagccactaggaggcagaataggggtccacctctcttctttcacgagatttcactttacttacttctcctttatcaacatgtggctggtttgcaaattaaatgaaaaaaatcaagtcatggaccattctgcaaggttggcttggctggaaatagacacctgctgtttccattttaatttacagtaaaacctcactgattcagattaatgggagaggggagatgctggcctgtcagcaaaaaaaagcctaacttattggactttctaaaaagaggtatccttttactgtttttgaatgtagcctataattggacactaaagtaaaaagtattcattaagtttacattagttattaatgcaacataagtgtaaacgttttttaagcatgtaataattatagataagatgacttataaattgaagtcaaagaaacagtagatttaatttcatagatcctaggatggaaaaaagggtattggattcctctaacttgtaagaagagtctttagaatttcctgagaaagttgagatcaagttaaatatattacataagagaaagagtcacatctgcaattgaattttcacagattccaatatttgggtctgaaccgatgaggttttattgtagtttcaccacctgcagatgagagccctggggtttagggcttactccactgactacctagctaagtccagtagatagagaaaccctccatgccacccccagaactttcccagacaccagccttttaggcagagaccatctaaaccctggaacttgctggatgaagttccatctccacccctgtgtggaaggctgactctcatcaatcctgattccagacatttgaaaaattcacaaaggtacactaaatgttggctagtacttattctttagttattcaactaactttacatcttcaggatgagtccaagaaaagttattgggaagactgagttgcctccccagatataatttgccctagaatgacaggaaaaaacaaaacaaaacaaaacaaaaaaaccaagctcaaatgtttgcaattaaaagtttattaacccaacctcatacctggctcttaccagcaattttttttttttttttggacggagttttgctcttgttacccaggctggagtgcaatggtgcgatcttggctcactgcagcccctgcctcagcctcctgactagctggaattacaggcgcctgccaccatacctggctaatttttttttgttgtttgtttgtttttgtattttcagtagagacggggttgcatcatgttggccaggctggtctcaaactcctggcctcagctggtccacctgcctcggcctcccaaagtgctgggattacaggcatgagccaccacacctggcctcttaccagctttttagcttaaaagttgcaaaccagaggtcataagaagtgccacttctacgatctatagagaacttcatccctcattgtaatttaatatattattgagcaaatatttaccatccttgcattaataatcatttagatattaatagccctgcaaagaacgatgactactgtggcatgaatcattgctattggagtctggtagaacagtttagggatctagtgaaccaagagaatttaaatttggggactgtagagtaagtgaggaccagagctatttttgtacattcaagggaattcttttcaaaaccttataatcaaacctgactctccaagaagaacaaaatgattctagcaagggcagtaacaaccagaaagcaaaagtgtaattccaattaaatgaacagaatctgtgtgaccgggttgggaaaggccaggctttaaaaatatttattttatgcttgctcatacaggtgaatgctatttttgtacttgagctaactcacaatgttcatgggcatctaaagtcttataaaccttttccaaagacaataaggagaataaggagttatacttcggctactaaatacttacccagagcttttcgttattcaaagacaaagatgtgtgctttaggggtacagtctacatcaaacacactgtatattttgcacacaaactaacatgtatatatgtactcctctatataccacaatacatatatacatatacatacgtatacatagagagagattgggaaggtgtagcaaccatacatgaaggcataattcgtgtgtgtatgtttgtgaatagattagactctggaaacagagtttagctgcaattaagagataactgtgaccactgctaccatataccgcatgtgtgtgcatatgatgtactcttagctggtgagatttcttttcttgggacatttaattactttatcttggaatttaaaatgcctttaaggattattgtttttattttaggtggaggaggcaagcctactagtcactttgatttgagtggtaccaccaaacagcatggccacacagccaagatccaagcttaggatttagtcttttgtttttcttttcttttcttttttttttttttaatatactgagcacccagagaacatggtagtgagtactgatcagtagaacataattgtcttactttttcttttggggaagaaaaaccctatgtttagtgtgccagcagtaaggctacctcttccactgtactccagccagtcttgaccctggttgtacactggaatcacctgggcagcttttaaaaattacccatgctcagcacctccctggaagatttcaataaattgagctgggacaagacctggagatctgaattttcaagagctgtccacgtgattgcaatctgtaagtaaaagttgagaacaggtggtagtgcctttctggcccactgtaccttgaaatgaatctgctctcaacacgttctgtttattctgttcatttggtactttccacacaggttttgtcactttgataatcagatattcttatattttgtttccttagcaatttgttcctcataacaaaagagccaagctttgtggagtgctcactttgtgccaggcataacaccagatgctttaatgaatgtggccttccactctaacaatgaccatctattgttatctccactttacaggatgagagaagttatactggaagagaagaggcaaagctaggattcaaagccaaacttctctggcacagagcctaaactcctggacaccctgcgttctattgcttgaaggacaggctgtcctatgcctagttgtctttcaaaaagcaccaaggtagttgcctcagtgctcagaagatggaagacgctcaataggtagcttttgattgatggagaagattttgtgattgggtaaaatttttaattttggaaagaatcctgtacatttatctaaaagaaaatttggtctcaggcacttcaaagtatgctgaagttttcattactaagttttaaagttggtaatgggaattgagttgatgtctactctatttaatttgaatggcttttgaatatacaagattaaaatattttgtgatgatggttattagggcagtttaggataaggattaacacagcgagaaagggctttttggaaaagtgaaacgtgccttgtttagcatataagccctcctttggtgtttcttttgagcaatttagaaaaatatacatcctttcttagcccgtagcagcctccaaaaataacttgattataaatcaagtatatctgtcatttttcttctcctctgattcacttaaaagcacaattgtgactgagaaaactgtgctctttgtatttatgtcttcaagaatgtgtgggtttggcccagcatcatgggaagagcctcaaccactcagatcagaggagggcaggctggagcccctccatgcctctggagatgactttgtagacacgtgggaagaacacacttaccatcgccggaaccccagatgcctgcaatctgaaaagaacatcctataggatagcgtaggaaaaatattctaacccacttaattgtttacatgtttggaggttatcgatttgcttttccctatcactcatggctgtgcgttgcggatagatgctgcatgaattagttctacctgcctcaaggggtcttacccccattctttaagggttttcagggaaaaaaattcttcagtactctctctatatataaatactgtatatatgattcacatagagacggttgttgaggaagattagtatcactccggtgagctactggttactaagtttgatactcatctgctgtaataaaggtaagtacagacagacataggaaactacaccaggctaaggacagaatcaaggcaggtaggaggcgttgtgttgggatgtaactgcagtcgttgttaagtatatcaattgcttcatgcacgcacaagagaatcacccacattgaccctgccgtggagggtcacccattccacaagcagtccactggaagttgctgttacattccttgggtcagtgttagaaagcaggagcaccaggaaaagtcccattagaagacatggtactggaagggcatgcacaaagtatgacagcaggtggctggttcattcggtttagtcacatacctctttcccctgccatgatcagccaagattgaataaaatagtagaaaaacagggaggaaatttaaatatgcaatcaggcattagtcgggacggctggatttatggcgtattatatattatttaactatactggcaatttccatttagtcatggaatgaccattttaggtacttgagaaattacttttaggaaatgtcatttttcccctttgctgtaaatctgaatgtagagaaagggggagaattatgcaattttcaaaaagattattttaagagagatgattttaaatctcacttttgagatgagcattgatataaccatttaaccatcatgaaattttggaatttttttggaagtgttaggttgtttaagtccttataggtttgggatttagttagccttgaaatcccttggtttataattattatcaaaaggatcattttgacagtggtttcttaaaaaaagtaagctatatttatttagatgtatgttggagaatcgacaagttgaacgacacagaataatttgcttctgtcactgtgtttaacaacccaggcaatctaagatgaaaaaaaaaatgaagactgtagtacaagcagagtaagttaccgagataaattgagaaagaaggtctgtggttctcataccaaataactaataaaaacaacagtggtggcaacaaaaacaaccacaaaaaaccaaaaaatattttgtgttctggacaatggtaaccagatgctgcttgaatgattaactttaaaaagcactcacctcatttgttcatcgctagaaacatctgaaaacttaggccgaaacatacaacatgcaaccactttttggttggttaaaataaccttccaaagacttcttgcaaaacttccactttcattccctttgcaatcccagttaaaagaaaatgggtgttaaggcatcttattcacaatctggctgggaaaatcagctctgcaagctcagctaagggacagtaagatacacttcccaccaagcctgctcacctctgcgtggtgctcctcattttgctgaagaacttcaatgactagttcagcaagacgtattgtatcttcaagctttttggcaggagtgattaaccggcctacattttctgtagtacaagagtttgtgttaaaattcagcgaaagtggcaggctacttttatggccattagaactagtggataagaaattgagaatagttatcagttttttaaaaaaaattcatgcaaatgttaagtgccatgtaattagtagtgagcaaaccataaagccattttattattatcaccattattataatatatattagaaaaaagcagtgctccagcttcaaatttgcatatgaagctatattaagtctatgacagcccatatcaaatttagtgacattttgtacacatgttctttaaagacagcataaatgtactataccactctctagattgtaattatgctacctgaagtgggaagattaacagaagtttaatattgattgctgttacatttgttttttagattagttattaaatgctacagcgtaatttttcattgcaggctcgcgtatgttggaacgctcattttgaaaatgcagattcaaatgtctgcttcaagttgtccagggaggagatagaaaagaaaaattggatatgcctgggccattagtcaggaataataattcttaaaagggtgttaggagtagattattgaatgggttgtgatagtttgtgctactggttgttacaattgaaattttatcagttaaactgaaacaatgtacttaattgttttctttgtttttagtttctcttaaactgaaagtgttgtatttttacccagctcaagaagaatctgaaccctggcttatgttgccttctttttagagctgagttcatgagtttgacaatgtcattatgttccaaaaattacaaacttttttcctttgggaaaacagtaatatttaaaacataaaggaggttttctttctttcttttctttttcttgttttttttggagacggagtctcatttattctgttgcccaggctggagggcagtggtgcgatctcagctcactgcaacctctgcctcctgggttcaagtgatcctcctgcctcagcctcctgagtagctgggattacaggcacccgccaccacgccgggctgatttttgtatttttagtagagacagagtttcaccttgctggccaggatggtctcaaactccttacctcaggagatccgcccgcctcagccttccaaagtgctggcattacaggcgtgaaccactgtgcccggccaaaacataaaggttttcttggccagtgaaactgcttggattcaaccagtctgaattccaggggaacttgtatttcatgtttagcccccttcaaaccttgaagtctcagagtcagagcacatgggatatagtgaaataaacatcatttagtagaattccccaagtaggtacatacatttgcaaaagaactggcaaaatttcttttcatctcttcatctgaaacaggtatattttggcttcaggatgtttcttgctagaaagaattacctattactaaataggaaggtttctggcaggcagcagtgggtgggaggaagtaggcagacttaaaatcataagagattgctaatttacaaaaaaaaaggttcttaatattcttttatgcatttcttacgtaatgaacatatcaggtcattagtaatttaggatttaataatgaaaaataaattcagcgagacactatgcaagaagagtgttctagcaaatgggatgtaaggtgattagtgggacagggtaagactagccaggtgttgaaagtctcagtctaacagggcctgagggctagtgtgaaaatgggcttcctggattcaagtcaatggaaagctccattatctctgccaaacccagatggaaatgtggctggatctggttagagcctgaaggtggggctgtgggaaacataaacatgtggattaggcagagaacaaccaacactcagaataagtagatgtgggagcttaggtgctgagagcccattgcctggtctagagcaacatatatttagagaaagagtgtatgacaagattgacttctgtgcttttggggcatctgacctgttagtaatttgataaatagactatcataatttcattcgtagactttcaggcatttctacaaacatactgtgtatatatttttgggtaatatgtgtagagtgaggtatttgcattttgatagtaaatatgcacaggctactattttttgttcgttgatattcacatttacacatcaatttgcaaattcctcatcctatgcttattacccattcgacacatacacccacatacacacatcacacacttacatacattttctagtaacagacaagcctgcacattaatacaaatcttcaggaaatcccacttggggcacatctttgaaatctcttgctttaaaaatagagagctttgtccttttgggtgaaacactccccaaatctaggggaattctggctgtttatgacataggataaataaataattcataccaatatttttatgcactttttaaaaaaaagtcaataatttttatgtttggaaaaatccaagatgttgaagctaggaccacctgaagatttgttttaataggcagtactcttagattgactacaatagatatcaatagatacacataaattgtgcatgtgcatgcagccattctatgagtgtgtgcacatgtacgcagatatgtgtatgcctgatgtatatatacagacagtatgtttaataaaaccctttgcaattttacttgaacataaaaccattaaagtaagcaggttaaggatcctttaatctagaacacttgatctgccaattaacccatgtagccagtctttcatttactattaattagctgtgattccatcatctgtagatcaagccacattagtgagacactgcactattttcctgtttgtttgcatagctgctgtactactagctaaatggcaaaatggaactaaaagtaaattccctaagatgttgtctttaaagaaaatattgtgcaaaatcctttagcacttcttccctctccccaacagaggtcaaggagaaatttgtgcttagaagtgattttttttttttttggccacttaacgctgtcttcagatgaattacaatattcctatcccccaagcttgcgctagctggagcactgataaaatggaactaaaaatatagtatacttaagaaccatttcatacaatagaattgaagctcataacacagaaaaaattgtcatgcaaaatgttacgcaacaacaatgttattttgtgctgacattgagatttgaaaatgttgcatatgtcagacatagctagacaaaaaatatgtggacatttggaaataaatgctctcttttgagtatctcaaaacctataaaattatacttgagagcccgagtctcagcttagtgttccaaactgaaacaaaatttcaagaagaaaggtgaacagaaaagcaaactaaactagaaagctgccaagtagaggaatgatgaaagtttacggtacttgattttggcctaggcatgcctttgagcctctgatataacatgctggtctgtgtttgggtgggtggaggaggaggcccaggatgtggcaggggagctgcttgggtaggtgaagagagacagtaaaaaagtaaagacaaagtgactttaacaaagggtgacaagtaagatgacaaactctgaaaagaacaaccaaataagcaaaaatgataaaacacaaatggagagctgctgctttcttggcaattcttcaacactacagaggtgtgacattgtttgacaaggactcttaccagtgtcaccagcaacccccacccaccaccaccaccgagacactcagaggctgaatgcaaataccagatgctttatccagatggatacacatgaatgatggcagcagcagcactgaccaaaaaaagatacacttcgtacaatgaagaacacctatacattaatagctgcttcttttttacagatgaccagaaataggacttgatatattaatagttggaagatctggcttgtcatcccccatatgttacttactttctacgtaaccttgcatctgctacttgaacctctctgtgctttagtttcctcatctataaattgagagtatcttttcttgtatatgttacagggctgctgataagagcaaagaaagcaatctatgggactgatctctgtaaagctcaagatgcctacacatgtttattgctacctccacattgtgagaaggctgcaattaattgctttgcaaaagcagatgaagggccgttattagttcaagtgagctaggaaatattcttgctccctttgtggaatttcaacatgtcaaaatctgtcattttgggggaaaatgtgtggtatctgattgtttccagctcatttaattattttcaatttggaattctcgtggcttttatattgtgggttgaatcatatataaaaacttgccagcttatcaaatatgttacttgctattccaaatgttagaatactgtaatcagcacttgacccatctgtcatgtggtttacaatatcagcacagcaaacatcctataacaatagcctctccttcagtacaggcacagagcactatcagcttctgcaattctctctctttaatgagtgtctcattaaccttggacctgctcctttctaatagttctggtttataaagcaatctgtatggtgagagggacatactccattgccaagtttccttcttggtttgcttgaattttcaactgggaaaatgaattttactgcaggcatgtaggaaatggaattctagtgacattaataaaaaagattgaaaaatatggataaaatataatattctggcaaaaatcatctattaaaagcatgagatcctcttcttgctggaccatttcagtgtttagaatacaggacaaaaaaattaacagtttcctcttattgaaattgtttgggaaaaaaatgtgtgtaaatagaatttggaagactcagttttaaatgataaccatttaaaaggaggcaactactaatcctttcatcataaaaaatagtactccatattgtatattttgttaaaatctggttttccactgacagcactgcctaaagttaagagcatttctggtaatccatcctcatggctctttcagtgaatgcatgttacctgcatgtgcagttctcacagaaattcctgactcattctcacccagttaactgaacctgggtagagaaagacttgatctggtggtgaataaaacaataaggcgcctctgggttgatctgtcacccatgaggcagcagatacatatttcagctaaatgggtcttgatgagaaattcataaagggatttcctcctgccaactgtctgtccagaattctgacagtgaggtttgccaccatagaaaaacaagctccctatttttttttcctcaaagagcaaaacaaaaacatcataccttggtttccaacttcatttacccaattaccattgctcatgtttacacaattaaatctgcttggcttccagagagagagttaaatgtgactgcagaaaaacaaaaagagaattccgcagcaggcttatctaagccaaggaagagatgcatccaggagcaagagacactccaattagcccttaaataacctgaccaactctggctctagctagtgaattgccagtccctgaaatatcatatgagagatgaatatgattgatggaaactcacttattaccaagttccagcctattgatgtgttgctgaagatgctagtatttgtattatgcaattacagaaaataactagcctgtagcaatttgctatgatctgggggtgggggtagataaaagctcaagtagcaacagaaagcttagcagatagccacatcatactatcctgaatacccagcttccctaaaatgatggctacataggccaaaaacatgcaaggttgaaatctaatacaatttatttagtgggactgtctgttatgtatacttgatccccttgattctccaatatccactccctttcaaaaggttccagctctaggtcagtctaaagtatgtgttaatacaggctgttggatggatcatggatttttcccatgcttttcattggagccatcgttgtcttttccctgtaaggacttaggtggtatagcttgtccagtctacctccaaaatgtctcttatctcacaccgtactagatcacgtgcttatccacactcttgccgagggggtgggcatatgactcaggtctcatcatttccacctcaactgttgctaaagcctccaaggcagccttcagtcccttttctcttctgcagttcattctctgccatgcagcagtcagagtgatctctgttaagcacacatctgaacttgtcatgctcctgcttaaaaacctttgagagcttcccttcatgacaagggttatgccttcatatgccataacaagagagtgccatcatagcaaagcttcagctcctctgtcgatgcttctacttgagcacttctggccctggataataggaaattatatacatttgtctatctccctgtctgccagggaattctgtatttctagggcttagagcagtgctggggccagggtaggtcatcaaatattggtagaagggaattctcagtggatcctgtccaatgcagtgctttcatgaaaaataaaatgctctgtgttttcagtatacatacaaactacacaggaattcttatctcttatccaaagtctctggttacttaacaaatgtactaggctgaattctgaatagtaaacatcataacttaaacttccaagccagagaataacatcaggtttcttaatgcaattaaatactatttaagacagctgtgcgcggtggctcacacctgtaatcccggcactttgggaggctgaggcaggaggatcacgaggtcaggagttccagaccatcctggccaacatggtgaaacctcgtctctattaaaaatacaaaagttagctgggcatggtggtgtgcacctgtattcccagctactcaggaggctgaggcaggagaatctcttggacccgggaggcggaggttgcagtgagccgagatcaccccactgcactccagcctgggtgacagagcaagactccgtctcaaaaaacaaaaacaaaaactatttaagacaattaaaaataattttatttaacttaatacaaattaatttaaattaaagaaagaaatataacactcttgtaatggtttttcttctctaatttggtattgtatgccaactcaggctttgttcctcgggctgagctgttgcatataagaaaagtgagcttaattctgcatggacattgtgttggaaatctgtccttgtatgtgcaagaaccttgcttaggggagttaccttctctactccatgttattttggtgggacttccaaggaaagtatccttcaggggaagccacatgagctacacctggccaaccatagtacctcataccatcatgggtactatgactggctctggggttagcatgtgacccaagctgggccactgtggcccttctctggaattgtatacagttgcttggagaggaatgctctttttcttctagagtcattagctaggataaaaggctggtgctatttgtggccatattgcttcccaaacttcaaccattagctccagtcacattaaagaagcctgtcagcagctggagatatgaaaacacatgaacatttttcatttctgagaccaactccttcatggatttcctagctacatgaaccaaaaaattctcttttcttgcttaggctatttgagttcttttttttctctgattcagtagtactactaagtacccacttagtccccaaataaacttttatgtacattgccacaagctgtcttgggcgggagcttggagcatctggagggatgatgaatagaggcaaacactgaaacaaggctagggaacaccccagtcagttcttcttaggggtccagtctttgacctacatcatgcccttctctggcactatcccctgctctgcaattcatcaaagaccctggcctgggtaaaattcccttgtgctgcactcctgtgacaccttgcttgttccctttactatcatcatcagattgtgattgcttgtttcatgtctctgttttctttttttttttggtaagctcaacaagggtagggagcatgactgcttttgctcatcacacactcccctggtgtctggcatagctcctggaacctagtggatatttaacaaatatatatggagattgcaatgttgtatttgaaatttataataaaagacaatttgaatacctcttatattcccttggctctcaaagtaccatccctggatcagcagcttcagcatcacctggaagcttgttaagaatgcatattcccaggctccaccccagacctgctgaatcagaacctacatttcaacaagatccccagtgattcagatggacattaaagttgaagaagcactgttttatgattcatttctgaaatcaaatgatatcattatactatacatttcaacttggaagaacatccttttaaatactttcaaacaaataataaattaatatatataatgagcacttactatgtgccaggcatttgtgctaaccgatttatttagaatatgtattttaatctttgcaataattctctgggggaggaaccattattagcaccttttatagaaaataaaagtgaggttacagaggttagaaagcccagtggaggcaagataaggatttgaatttggggtataacaaatcattgagtgctcaggctgggcttgaggtagtgttttcttagagctgcacgtatatgactctaacatgtggatgctagatgtcatcaaatgtcctactggaagctcagaccagttaatggattgtggatagggccgttatatcttggctgaaaggtaaggcagcctggtggggtggtgatggctcttgaatagcacataggacaagagactggagagtcactgactactcattttttttgaacctggcttcttttctccaggccttgatttttctagctgtcaatgaccaagaaacctcttttgtgttatacagtttcattgctaacaaatcacaagcactttatagtgtagaagttgaaaatggggactttggaattaaacagggtcatgttcaaattttgactctacaactaaccagatgtttaaccttgggggagtgacttaacatgtttctacttcaggatttccatgcatgaatgcataagttcttatttcattgaagtaagaggcacatcgtaacatttctgaaatccggatgcatcttatgtttgatagcatgtcacaatacagtatatgaatggcgcagcttataattgatggccctttagattcaatgaaatatggtaataaaacacttatctcacagggtcatggtgagaattaaatgagatatgtataactacttagcacatactaaattctcaataaacaacaatttttatcataatctgcagcatcacatctttttttctgatagaagagagagacactggtttcatatttgtgggttcacagcatattttaacacatccttttttttcccaaaatctttcttggtgacagtgtttaaaacatgtttctctttgtcctccccacttatggtaaagtatagatgaggtgctagtccacagaataatctgggcttggaaaccctgatttatgcaccactgaaacaaaaaggatggaaaggctgggtgtggtggctcatgcctgtaatctcagcactttaggaggccgaggtgggtggatcacttgaggccaggagttcaagaccaacctggccaacatggtaaaaccccatctctactaaaaatacaaaaaattagctgggcatggtggtgtgtgcctgtagtcccagccacttcggatgctgagacaaaagtattgtttgaacccaggaagtagatgttgtggtgagccaggatcctatcactgtactctaaagcaagactctgtctcaaaaaaaaaaaaaaaagaaagaaagaaagaaagaaataaaagagaaccacttagtccctcatgtataagacatgaagcatgagatggtcctcatctcagaatggccatcctgtggggatgagattcactattattggtcccttgtggaagacagtggggtggtggcttggctctatgtgttggtgagttttgccagcttggttctctttctctctttcaacaagccttagatctgtaggaaatttgcctggagacagagaaagatacaaaacctcaacatcacacaatcttcctggaagtcctttggatagatttgacctgatctagaaggtttctgtcaattggagagaagaaaagtcctcagttcttggacaaccttggggaatctcaactgccctcgggaagaatttacaatgtaaagattttgtcaatgatccagttccagaaaggactgctctgttaatttgtagtcttcctatgtaaaaagtggtaggtattatacttgaccttatccactgaatgaatggatattgtctaagtgctcaccacatcaggcaaaaagtctacatggtagaaagagacaaaaatgcatggtatttaaatttagacagacctgagttcaaatcctgcttcagaaagttacttatcctcactgaatcacagctccttcatctgtaaagggtgcaaaaataaagacttctttatgagtctaaggttaagattgaatcagaagcccttagcacagggccaaggcccataggttcataggtggctgctctcttctctctttctctccccacctacccatcattcatccatccacccacccacctatctacctactctcctctcctttcctctcctctctcctctcctttcctcccacctacctatttctgcatctatctatctatctatctatctatctatctatctgcctgcctacctaattatttctgtctatatctatctgctgtctgtctacaaatcatcatctgtctgattttgcaaatccttgccatatttggaggaaaaagttgttttatttcaaattccagtggaatcgttatgatgctcagaaaattatgcaagtatttagccaagaactgaggcaaaacagcaatagtagtgtagactttctcagagcttgctgggttcagaatgtgtgacggtttacatggaaatgtatttaaaataatagaattcatttgcaggagtcacagcttttctttcatagactagcaggcttttgcatctttttttggaggtactgtaattaaattgaacatttaatttctaataatgccaccaaacataaagcataagtccaccaaaatgccatctgcatagccctgtagattcttaaagcatagtctgactaaaggactcagcagctgtccatatttcagtccccagtattctacccacttccctacaatttgcacctgtaactccggtggtgccctaccacctccatacagttggttatgtagacctatccatgaatttgtgctctattctcattaagaaaattgaaaagggagggaaggggtaagaaagaaaaaacatttaaaggccaggaaagaagtaattatgattaagattgcaattgagacctgatatacttagaaaaagcttcactataccaagcttcaaacccatctctgctttaacctcaacttttaagtccagttctaccctattccctctcttcagtcctttctcttaattcctgctagcgtgatttttctgcagtgtaaaccgccaacccatccctttgcataaacagccttcaatgactcttcatcacctttgcagttgagacctgtggaatctttcttctgaaaaaatccatatgcatgccaaggttggcatgattttcaagttaagaaattttgaaccatgagatatagtctgaactcagcattattatggcatagaaagacctttgaagtcctgtccctgcctaccttgccatcatcagcacccatccactactatcatttcactctgttttgcagctacgttgaattaattacagagtagttaaaagtgtggcttctgcctgggctgactccagctataccacttatacttctggatgtgtgtttttttaagttctgtgcctccgtttgctcatctctactatgggaataataatagttccctcttataagggattttgaggagaaataagttaataatatgcttagaatcatacctggaacatgatatgcattaaataagcattcattattttttattagctatctggctttacatatttgcacatattattctcttgatgtaggatgactttccattcccaatcctagctcccctttgcttattctaattcatctctcaagatgcagttcaatccttaccatctcgtgaagacttccatggttttctgacaatgccccatcccttttacacataactctaccaataggccttgcaatatagtgatttacatatatagacccatttgcatgtatactccatgaggctaatagccgtttccctcttgtttacatagtctctggcttttaacactgtacctgctacagggtaggctcccactaaccatttgtctaataaatgaatgaatgagtgaataaatgactgaataaatatcttccctaccagagagaaaggttcatgtgtcttgaacacaggtttatgagtcttcaaatacttattgcagccctatgcttggaatgtgctcaggaatgctttctgaaatgttttgaaatgtgctcaactgttaatttggattaactgatagttatttttgacaaccctttagactacaaaaatgatgatccctattctaatttattaaagttttaagtcagacttctcctcaaaataagatcagaagttttgggaccaaacaagaagaaaatttccgaagccagaactttccaagagctttcctctaatacaacttccagcaacagcccctgttcggtcatcctgtccatgcttcctgctttatcatgcgatacatacaagaacaacatggatacaacttctctctgtcttggctgataaacattcatcaaagaacacaaacttctcaatagggcagaaaacagaaaaaagaaatgaaaaacaaagaggaagattcatttggttaaacaactttttaaaaaatgcacatgaggccaaatcactggaatcctataaccaaggatgaaatgaagctctgcagcaaaccagaattctattcctttaaagcttatgccttttcagaaattctgctctataaaggtcaacatcaaatgggcatgagatgtatttagacagcacaaattaactccttaagtattattgcaactccacatggctctctgggagtacaaaccttaaggagccattgaaaaacaaaaacaaaaactgaatgtaactcaacagtcctgataatttataatgcatatacaattggttcacctgcatccttttgattctctatttgaaagagagagcacaacaaggagagaagagagagaaacaagaacacatatgcagaattaatgagcaagtggaccaaaatgccccccacttatgtgtgatacatgatattggaaagaaaaggttgcccttgggttcccaccgccccaaagtttgggggccagcaaaaaaggctccttcacagaggtggaaaatgctgcacaaatagaaaattagtaaaattaagtttaatgtgaaatcaagctatgaaacatacatgaactctccaagtgacaattaagtcatatgttctaggcaaagtttagaggacaaggacaagtcaaaatctctagagggaacaaggaaaagcttcccagcttgatagagaacagacaggaggcatataagatctaatttttacagagaatggaccacctggtgtggtctcatacccataatagtttggcatcttaaacatggaaaagaaggcatgattttgccccaaatatcctttatctgacacctaacgcattgctccccagcctagctgctaccttttgattgtgtaccagtgacaagcactttacaaattagggttacacacaagcaaagtaaaaatgcattcaggtcacagacagagaataactgaaaaacttacagacaaatctgagtttatcacaaacaaatggcttaattgtctaacctgttttaggctgataaaaagtgactggacttctcacactgggtttcacagacagaaccaacagacaagccaatgctaaaaaacttgaagcaaggagagtgagttggtttggatctggattttcttgaaataatgaaaacagaaagagtgaagacagcatggtgaggaggtggtaggtactcacgaatggttaaatccatcacttgggaggccaagcagaagacaggatgctcatacatttctctctttttccctataaaagaggatttgggcatgcaagaggcttaggtcagaggtaaagaggttaaaggtcataggttagaggaaaacgttacattagctcaaaggaaaatagccacagagtattttgggataaacacaggataaaagaaaaaggagcttcaaaattggagatctactggattaaccattcagcatgccgtgagtcacgagagagattgtgaccatgattttacacgtctctttagagctgtttgcaagaatacaatgaccaaaacatcatgagtaaagggaaacaaaatttcattgatttaaggctccaagatactaaggatttaagactttagtatctaaggctcttgaggtatttcttcataaacatagtctccagcaatattactacaacttctttccagaattctcagataacaaagctgttaattctcacagaggggctcaaatgtaaaaaatgaaagatttcttctctgagggtaggatcagagccttgtaaaagaaagttgtctggtagtaatatctttcaggctgcaatgtctcagcctatggtggactatgttcatgaaagaaaacctgatacatgcagccagaggatgttgggttgtctgaattaacaatcccagcatgctttgaaattggtgtctcagccacttttgcagaggtcacattaaagtggctgagccaatcacggacaaggaaggagagaagcggaagagagcaggtagtgtggaatgaggtacttctctgaaaagagagttgaaaaaaaagaattggtttcttcaaagaatccccagacctaaaagtcacagtgcaaaagataattaacacaaccaagaagaattgaggcacaaaaggaaattacagaccagctgatctactttggaaatgaatgcatttttacttacagatcttaaagtttgtttttggatagatttatctgaaagaagagagcagatcttaccaaaagactagtagtaatagctagaccaagacctatgaggcagcagccatggcaacagaacgtttcttgatcccatcccatctctggacttgcctagaattgttaggtacctggctgactttaccaaatacaaccaatcattacgtcctgggacagtaaatgctggaacaattatttgctaatatagccctttaacgacctcttgttcctctatttttgtcactcattaccaagtcaagagttgataaacatccttttggtgcccaattcttaagtgtttctccctggatgcataacagtgaattcattaccactggtacacaatttgcattgtcagacagacaaaattgagagagggaggacacgtaatgtacagaacactgtgaatttgacataatcttaacctaattctctaaggaaacaaggattttggcagagtaagtgatggggtctgagtgattggttagtttcttttccccccagttgtcttgaggcagacaatgcgcatttgctagttttagtcaggtgtcatgtttcacgtgtgagagaacatcagattccagaatgcggacacatcgagttttgcacacagaacttccacatttatacacttacaccactggtcaagttgggtgtggctttcaaatcaccctatagcagccaacagggtaacaatgaaaagtgattaataccttcgtggatgaataggtcccaaagaaccatatcttctcaagtagagtttactcaaagcacctttggtgattactgggtcatcagtgaccacttccctaaaacttgagagggcagtggtaacaagcatttaaggtctggagtaacaagaatgaatgagatctaaagccaacttggagccatcacagatggctcagcactaacctgccatcgagcttgaagcactaccaaaagacaaggtacttttgggggcaagaaagagcaaaaccttgatcttgctcttttcagttcttgtattgcttccaatgctatcagcagcggacaacagactgctttattttcctctgtttaaagaagggggcaattctacagaactccttcataggaaaacatcagccacagagccgatacttagggccaacacagactctcagaaggaatttagttatctgataacatcctgttttcaatattgttcccttacaaagggaactgtaattacaaagcccctgtaatgtcttttaattcatttacttggccacagccaaggaaacttcgacatttcaggtgcttccaggtttcagcttaatatactcagacggaccactgttttcaggtgcccttgagaaaagagaaagacttccccagggaggcatatcaaaatttaaattcaaaactgggggcagaagggagccttaccttcgattttggcatactctgagagccgagaatagttgactaacgcagcctgttccagacatttacggataactgtttttacctcctcttgtggcactggggtaacaatatctttcatcaaaaccttcaagtaggaaaaagagggattattaagaaggttcaagcaaatgtgtcactcatccatacttcttagaagcgtgaaagtttaaaatcagttctttgtgacttaataagattgagagccatgcttaaagagaaagcaccagaattgcaaagcattggcaaaggccgtccatgagtcagggaagggctaggaacatatcttctgtatatcctatttgggagtttgaagataaaatatcaagagttttggcagtttcctcgcttctattctgatatttgatgaatggtaaacaaatcctataaaaattacaactaggtcattcaaccaaaacatttcattacaattatgcttatgtctttttatatatatgtgatctatcttttactttcattcttaccctttccaagagtgagagagtagctttcaaagcaccttcaggtcgaccaaatggaaagcaatacctaaaaaagacaaaattcttcaggttgcctaaattattacattttagcatgaaatatgctgcaatttgattcctatagcaactctctctgaggaatggaaaatgctttttattttgtcacgttgtgttatgttaatctgaattcacaccatatatgtgtgtatataatgtatatatgtgtatgtgtgaataatgactaaagagggactctgcaaatgtctgcagcagaaaagaatattcagagtggtgacataaggctctgtttagatttctattgtgaaggagaactatttgttagctcaaatgtgaccttatatgttattatcgagactggcgttaaaaaagtattagttggaacaggctgaaattcaaatacacttacttaagtccccaaaagatcaatatatggaatagaaaagtggatttagagcaaattcatgattctgctagctatccttccctgcttgcggtttcctattgttatggaccgtctgctaccggtaatgcattttacatatagtgtgtatgatcaataaagatttatccaggaggattttgatggcacagaaaaaaactatgtcaggtaccactacaagttccagtgactggtttcaggttgtcactggcccgtcagaacactgtgcatgggacagagagactagcatggctgcttaaacctggactatcttatgtaagcatcccacttcttccacttgccagctggattgccttgggcaagttccttaacctctctcagcctcactttgttcctggtttaaatggggattatgataactaccttacaaagttgttatgccacgagttaatacttctccagcctccagttctatatctggtatataggaagtatttaataaataggaacaattacaaatgctattattatttttcagttactatttcaggatctctggtccagaaccaccaggacagcactaaaaacacctaatgtgctccaagggagaagtgggctatgtgatgtaaggctcaagcacagaatctgctggctctcttgagtatgcaggggagattcaatccacccaggctgatgcaaggttcattctttccctgtgttgccagccagtgctgtttctgcggtagtggaaaaagtggagactctcctaggagtatcactgccttccttccttgttcaccatgttctgattcacaagattttttatttattcatttttacttaggaaccttgaagaagcttcaaattcaactttttgtaatagattgttgaccagggtcagctcaaacatggaagaatttgttctttaagtggaaataacatgaacttaagaatgcaaagtttcctggttattgcggaaccatatctgattgatttgcttgttctactcagttatttctaaatatccaatgtatcctctggtagatttacagttttggaaaattaagtcctttagttttcccttcccactctcatctcctaattaaagctctccagccccagatccttacctaaaatgtgtaatctgattttctagcagaactcggagcctctctttgatttcttcaaaacgttccttttcttcaacagtcacagttccaattccatcaggcctgaaagaagacatgtcatgaaatgacgggaacctcatatgctgacaccatcaaatcaaatctctagcaggaggaaactgtccattttagaagaaacaactacagtgatcgatgtgagctcaggagaagcccagctattcagggctagcttccaaaggcgttgggttgtgtttgggttatcattttggaaacatgtgcagagctgtagctcttttcttgtgaaatggtaaaatgtacaaactggtggcttgaaggttaagtccagcccctgaacttgttctgtttggctcacagcgtcttaagaaatttgaaccagttgccaacatttttttaaattagggaagtttgagaatacgattctgatttctgttttcttgaaaatttggaacagttagcattattaattggtggctaacagcttcttccttacctgggacaggcactcacctggtccacattgctaaattgtattacctatctctcttgtaggcacttgggtttggggtccctgaattatgcacaaaaattcctatgaaaatcaggtgacttgtaagtgtttgtctttcccggtgtcagacgtcttaaatggctcaatttcttgcctataactaccgatgttcagatttatttaagtgctcatgtattcgttgaagaacaaaccacatgttttccaattttagcaaactgttactcattgtaataaaaaggaccccagcttaaataaatgatttcagtttgatcatcatattctcatggttctgtgtcatctttaggtgcatacatatatactctatttgttatggaccattcaagttgaaaatataaagggaggatacatatttatagcccaaatttatctgttccaaactaaatgcaggataatctgacccattcaaagccttcagcttcccagatctcatagtgacttgttttgactactggctgagccagtttgcagattggtgtgtcaccataaaacttctattggaacattcttcagtttgcaaatgcaagtcatcttgagaccaaacaaatggtcttatttataggccttctcaaggatccagcataagttgggaaaatcctttatactagaccagtctgactgcacaaaagacttggcaaatgacagcaatgtacctcctgttacgggttaatcagtcagctttccttcttttttgataataaaaatgccctatttgaaatatgcgaaaatttcctcttccccactttataaaaaatacccccaaacagtaaaatcctgttcagtccatttcttcatactcttccaaagaaaggcaaaatgataaacaacaggtaggttgccttcaaattctctggtaaatctcaaatgttaatttacaaagtttattaaaaaattttttaagagacagggtcttgttctgttgtccaggctggggtgcagcagtgtgatcatagctcactgtggccttgaactcctggcctcaagtgattcttctgcctcagcctcttgagtagctgggattatgggtgcaagctaccatgcttaacaaaaacaaattttttttttttacatgaaacgtccgtgaatctacagttagataacaggatgaatttactggcctccacaaaacatgtgatgcttttgtttgtaacttttcgtgtatatgctacaacctacaacttccttaagctgtggtttttaaatttctttaaacaaccttcagcttgttaatgaactgaacacacatttgtttatgtaatcagcatgtgcatgcacacactcaactgggggaaaaatggagcaatttaaagcatttgttttttagtggagaattaacccagagaaaaatgctgttaaatataattttacagttcagaaaaggtttactgatcacagcaaaaagtatggagactatttaacatgaagagccaggatatttgtggtcattattaggagataaatatctctgtgaataaaaccattcattcattaccctacaagccttctaaggcaattaggcaattagaaggcagctttctgctttgtgtctgagatgataaaaactgaacatttagtgtatgcttggccttctcagttaattctcactataaaagatattattacaaacctaacaatggattatgttttttccttttgttctgatgattcccatttgtaattattaaaagtatcagatagcagcttctgcttcgctgataacctctcctcgtactactttctgaacactattaatctcactattccaataaaagtaaacaactgaaaagtagtgttgtctcttaaatttgcttcttgatcacctatgtcagcgcgacaacttttattttaaataaaacaaactaactttactaagtctgtaaggtacaagtacagagttcaccaataaaaacaggtgataaaacaatttgatgtcgaatgattttgacataaaatgtaaatttgtaactgccagaattgctctgaaatggtattggtaacaggagatgctgctttacaaagtgaggaaaagacatgcaggaataacaacttgtcaaagatcataggttgtaaccaggtcagttaaaaagcaaaaggatcccttttttgtttgatttcacttcattgttttcgaaaattctgtcaaacatcaatttcttgttcatcgacccctataatttggcaatgttagctatacaggtttagatagatctctatagaactattaactgaaaaattcaggttacatgctttggagagtactgttttttccacagaagcaacagcatactttttctagagcagtggttctcaaacttgaatgagcctcagcatcacctggtgacaacctggattggttggtcccctaaagttgctgattcagtagagctggggggtaggggttgagaacttgcatttctaacaagtttactggtgctgctagtgctgctggttcgaggaccacactctaagtgccactgttctagagaaaaaaaatattaggtgggtggttcttccagtggcagagagggtatatttgattcagggttcctgatttctcttaggttggagtggatttggaacccaagatattctgcaagagatacatggtattatttaactatgaatcccttccaaaagtggcatttgtattgtttacaaggtgccattccaagtagtgctggttgcaaaataaatagtagagctatattggtatctttcagacgccatgcttttgttttgtctttctgaaaatatttgggggtgattctacaactgtcttaaaactagctctgcatcttgttcctttctcaatgctaaatcactaaaggagacacaaagagtgagagaagaggaggggtgaagctggattttaaactgctagctagaaaattccaggctgagatgtgtctacacagaacacctgcctagaagcctgactctctcacgctctcgtgtcctgactgtgaatattctggtcttcttgctttcaggctttttagcatccattgccaatttctaacccctggatttggaggagtggcctcagccacattctggccactctcgtgtgagggtaaatcgaggtgcctattcccctactattaaagccgaagggcttcctagaggccagcccctccctttcacagccactccatatctaagctggactatgacctcagttcagctaccaggacaccctcctctggaatccttacgttgaataaatgatacaaggctagaataaacagacggaatttgcttgttccagcagctgtgccttgaccagactgtccttacaggtcagtagtttttgatcttgtctgtttcttagaattgtgaaaggtcgcatcctcaaagctctatctatctatctatctatctatctatctatctatctatctatctatctatctaactattgagacagggtctcattcagcctaaggtggagtgcagtggcgcaatctctgttcactgcagcattgacatctcaagctcaagcgatcctcctactgcagcctcctgagaggctgggactgcagaagcatgccaccatatcttttaattttgttttaattttcttcagacacaaggtctcattatgttgcccaggctggtctctaactcctgggctcaagggatcctcccacctcagccttgcaaaatgctggcattacaggcatgagccactggacccagcctgacactggcatttttaaggtttcccgtgttactctaacatacagtaagaaccactgtgtcagtcctgctttctactcttccatagctcacttgattccagcattcctttccccgtctttgaggcccccagcatcatcctaataaactctcctttgcttagattacccagagttagtttttgttacttatattgaactcgatataagttcataaagcacatatctcttccttcacaacgttccaaattttaatagatgatgtctttgaacttagctttagaaacacatacacacatgagcacatacacatgcgaacatagcccctggtctctggttccacctaactgcacactggctaacaactcgcttcttttatatcatgatcctgcaaacttgagacaatatgcaggtcaagcgcagtcatttttggagccgtgctgaagcctggaagctctcccacctgcgggccatcactggagccagaaatgagtctctccagccacagcagactatatcgcatctgacacggcgggcatctccggaatccacctttcaagttttcggcaaaccattttctcactgtccttcacaaagttgacattttcggcagcatgataggaaagatgtcatgtcggctgctcttcaagttcttgtcacagtggttagcaccagttctgtcatcttcactctcctcacagtctcccatcttgagccatgtcacaaataataatacatctagagttgcatttttctttttttttgtcaaattgaaactaccataacccagctgcccaacctttgagtgactagttatgcaaattgttctctttttcccaaatgcttctgacctggagtttattaactaatatctattataggattaatataatgaagtactgagtttttaatgtgaaacattttaatatttgaaattaagtgtgaacagtgtagtcaaagaattcaagattcaatgtgttttgtgaaatgaatttacctctttagtgttgttaaattgtcactacacacccaggtgagcacacagacttttagcagttcattatctttctagaatggttctccatattatgttaaaagctgggccacaaaaaccttcttttgaaaggtaagatgtctcttcaagagggtcagaatgctaaattaattcaaagcttacaatgatctatatgttctgatattgcatctatttggtgattaagggcagaatccaggtgtaaaaagaaatgtatgaattccacagaagaggaaacagtgtctggtccactgctccgcatataaccagctttcaggctccagtcactaccaacaaggggtaaaactccagctgaagagggaatatactttcatctccaaatgcaaatgtccacatatgctggtgcaggcaccgtaaacatgatatattctctctctccaaatggatgcatgcctgcagaccgcatgatggatccatgaaaatgtccttaaacaagcatgataactgaatcctacttgctacgaaattgttccagcccagaaacatgagagcttaaagggccagagagggacagaatatcttagtagatgttctttgcagtgctccctaaataggacatttagaccaaacatcctcttttaaccactgacttaaaaagaaaaagagttctcccagaaactaactctttattacttctagttttagaatgatacctttgaatttaatccttgcatggaaagttttcctttgtctctttcaagtgattaataaccacaaattcaagatagcaccaaagcattatcttctcaaaaggagatatccctgcttgctcatctatatggtttgtacaatcctatgttaattataaattataattagggccctcacatctcatagttactgcttcattatgaaagccagcctcaccccttcctctcctttccttccagcccatgcccttttctaattatgccctgatgccctggggctcagacacgctgctaaaacaaatatatcaaagtgtttgtatcacaaagaataagataggaagcaacaataagcagtttctacaatattacaagtgtgcattgtagcttcctggggctaataattaatctccaaacaaggcttggaaggggcaaaaatacaccagtgaggactgtcttgacttatttacagttctcctaaatatgtggttataacctaacagtatcagaaggtgtcattaactctattaaaggatgaaagtcgtggagaagtctctctctactgaacagtcacaaagaatatggatgctatgggcacaaggacattagtcaaagtggctcaggctcagtccaggtactgaatgaagcaagaacacatcagatgattagagaaattgtataaaatgcaggaaagcatgcattttacccccaagaggaccaattttaaaaattggcactgcatagatttttccctttgaggaataagggatgtgtttctttatttctagacaaatacagacaactaatctttagattcctttctgaagacaccatatacaaaattctgagtggtcagaccagtagtatgtgtggctttttgatatcacatccactctaaaaggagtgtaacatctgaaaatatgtttttgtaccagttaattcaatgactatgggataaagacacattgttggaattttaagaggaaaaacacattatctgatggtttgctatgggccagaaagattgcaccaatggaataggtaatttagcatatttcacaagatttcatgtctcgatgggagaatctgctgttctcatggggaaagtcagaaagagagtcacgtgggttaaaaggaaacaagttccaaagtgaatttctccttggacatctgggatgcctacttatacgtaaaatttgtttgaaaatttttcccactttctcttccaagtacttcctattaagtaaagctggctccttagaatttagagagcatgactcagccatgtgcaaggcctgtacttgctcagaattggaaggccagccagcaacatgctcatgttcacaagtgcaataatctttgtgttcagtgtgtaacatgagaccaagaatgtggaggtgttttttataccgcatcagtgcctgcctgctatataaagtgctacatgcagaggttagtaaaacagagctatccccactacacagtttttgccctttatctttgtgggaaaaagggttgagaagcaccggatgtaatgtcattatgtgtgtgtgtgtgtgtgtgtgtgtatgtgtgtgtgtctgtgtgtctgtgtatgcacgggtatgagaaagagagaggacggagttagagtgaaagaaaaaaatgtgttactcatttactactaggaaggcattcaccaaaaagaaataaaaggaaccattatgtgacatggattgaaacggccacccaacattggaggcaagggcacagtcaatagggcaatcattgtggtccagaggagagaagatagagacctaaactatggtagtggcattgaagagagggagaaatggtggacttgagagatacttaagggcattgtcaggatatagaaattgaattgttgtgacacactggggagaaagagaagtcaaggatggctcttgaggttctatcttgggcaaccgggaggatgaaaccacttacttaggaatcctggcagagtaacaggagaaaagtgagttccatttgattgtttggttactcaaatcttaatctacaagggatcacatggtctctgaacatgggcagcaccttggctccaaatacatcgcccaaaagaaatctttagagcacactgccagagatttttaagattcataccctcttacatctgctttactcattaatctatgcagcttactttggattgcggcggttggcattatagatttgttaattgctgatacaatgtactttctacacaggccatatgtgaagagcagcactggcattcaagaaatgttaaataataatgtaaatgagaaaaatttccaatcccaataataaagggatccaaggaacattgacgcaacttgcaatcatcagagctgtttgattgccttgtcactgtgggatagtgaccaaagtgatgctaatctaaatgtcatctagaaagaatactaaaaatattatggtgagaattaagtactgcaaccttagaagctgatttaaaaattagaagatgtagcaatttacatctgtggattttatgatcgccaaatgcaaccagctgagcatactcacattttcctttttctcctgtctctcttttcagaaaatgggttcagttttaaaaagttagttcaaactaatgttccctcaatcagtgggtcttgaactttgctatatatttaaatcacttgagatttttaactcatgaagtttgggccacattccagattaattagaatctctgcaggtggagcccaggcattagcatttttaccctctccaagtgattctagtgggcagcctagtttgacaaccaaaatcctaaatatgtatgatctaaagaccaaatgctttagattcatggttgagaggggtgcttagtaaaagtgcagattcccagctccatttaagacttgccaaatgaaattatttgaggatgccacctagtactctgcattttataaaatccccacatgatttatgtgcacaatgaagtgtgagaaccactgtacaaactgaaaatcagtggtggtacctgttaggcttttagacatagggtaagtcttgtgtaaaagaaacaacaaatccatgtaaaggaaaaatgcagctcatcaccagggagtttggtttaaaacagggtttcttgaccttggcactattaacatttttggctttgctttcaggaggctctcctgtgtattataggatgtttaataatatccctagcctctacttactagacaaaaatggcaccactccaccccagctgtggcaatcaaaaatatctccagatattaccaaatgttctgtgtgtgctgggggtggggggtgggggagtggggattacccccagtaattctaaaaatgccaaacatgtggatggttccatacatcccagtgtttgaaattatgaacagcaaacaccttcctgattgaccagatgtgtctacacttgactacagtaactgtgattcacagagcatagtttttcacggagatggtgcacaagtttccagagcagttgggagaaacttggtcactgccacgtcagtggtcattaatgatttccagctgcagcagggcaaggttctgcctctgccggtggaaatgctgagttaataataggtaaaaaacatctttttacctaatccgaatctggttgtgagatctcagtggaaatgggctctattcagttaaaggcagttaaagggccattgctttcatgagtcatgaattgcttttaaatctggaacaaagaatagataacatctccacatccaaatgctggtcatgctggtgaaaggtttggaatgtggtttccccaatcccaaaggcaattaattagtgttcataggagactctccccttaggtggtataaaactccagataaattctggttttccccacaaagctaaaatctccaggtaggccatattagttttggccatcttcaggcttctctttaattcagatgactgctgtagcatctcacctggaaatgttgaaacaaatatcaaacggccaggtttgccatctcacaccatatacaagtgctaatcttggacaggtaggaaggtagagtggttacaaatgcaagcaccaaagtcagaatatccatgtttgaatcaggctcagacagttatttgttatgagtttcaggcaagtgactgaatttatgcgagcctcaagcactcatctattgggtgagggtaataacgatatttatctcacatgaatgtaataaggataaaatgagataacatatatcaacagcacttcacttagtgcctggaatatagcaagtaattattaaatggtagtgattatccttattttaattaaactttatttatgattatttaaattgcaccttcgaaaacatttttatttatgaaacctgacgatggactatttcacttgttattgtaatccatagaagataattttagatgttaaagggatattacagatactatgattcagtctgctcattttacagaaatgagaaaactgaggcacagaaacgggatctgatactcctagatttatgcagaataggttctaacattcaggtcttcagcatataagtacagtcctgatgtagtgcaaaaggaaagagctttggacttagaacatctaggtttgctacttaaatttacagatgtttgactttatcatctgcaaaatgaacataaaaatagctaatctgaatattttatagcaaatgtttggaagcactttgtggctgggcgcggtggctcatgcctgtaatcccagcactttaggaggctgagtcgggcagattacctgaggtcaggagttcgagaccagcctggccaacatggtgaaaccctctctctactaaaaatacaaaaaaattagcggggcgtggtggcagtcacctgtaatcccagctactcatgaggctgaggcaggagaatcgcttgagctcatgaggcggaggttgcagtgagctgagatcatgccattgcactccagcatggggcacaagagcgagacttcatctcaaaaaaacaaaaacaaaaaagcactttgtaaactgtagaatgttacacaattgctacttaatattatgatttcttctttattaaaaaaatgcaatgcaaacaaagattctgaaacacacacataagcctcaataggaccagtcaagatccctttagttagtttttcgtggcctaagaaatagatcaggttcaagcaagtgtgcctttcaacactggccatttgttctctgctccacttggatgttgatccttccaaaagcagcaccttggacagcagccaggaaggcttcctctccgaagccttgtcattccgtcagacctcaccttcaggcacctacaacattctgcatgcactttcttcctaattgcaagttactgttgccttgcaatctaacttttacagtgaaacacaaacagaaattgcatttcacctctatccttacatattgcggtgaaggagatggatggccacatggaatcagggttttctttgaccttccctattggacccgcatatactgattgacagcctgccacattctctagaaagcaaaagtttgcattttcatttggcctgtctacaagtgaacggtatacatttcaggacttagaaatattcagtgaataaatttataatgatgaagcatacagcatacacgcttgagaattttgggtagcttggcaatgccaggatcagagtcatcagttctaaaaccaaacaaaaaactttaaaatgtcagtgttaattttgggtgacggtataaaaggtgaagaagggcacagaataaaactggaaataattagtaaacctaatttaaaagggaaaaagttcaccaattcgccaatttataaacccgcaaagaaaggacataggaaacaggacaggataaacaaaattttagaagttaaaagtgccttaaaggtgacctcagtatataagtgattctactaagaagcattaatttggtaatagaatttatcttatgacattattataaatcattatttgagatgaatttctttttatgagatgaatgtagaactaataggtatttgctgaaaatgatggcactactataaatgcataggcctatcttatgccaatctattttatttgctccttaaacataatttcaaaattataaagcatgggttgcttattatgaatgacttggtaaggtaccaggcccctaactagatgccactaaaaaagcaatctgactcacaattctgtttacatattgctcaattagtcttttcaatatgaacacgttttaaaagtcactgaacacctgactcaaatttagtcccaatacacggtatttttgcccattgctagaatttttttttaaaattgcacctttgaaaatgcttaaagagagactttaggaatactcaaagcttgcaaaagtggaagtgatggcatggatggaggcttggggaaagggtaaagatattacaaacacaagccaatacacacataacttcttaccttttcagctcttgatttgcctgggttttggaatcttttctttttttggattcctttttggtatcttttttagcttctggttcaggtggggagggagttttgctcccttcagggtctgtatttggtggcagcccactaaggtacacatgcatttgttgactttggagagggggtggtcgcatgaggcatgcacagagtgtggccagccataggagaatcaagagcacacgcacatgcacaaacaaaagaaagaaaaagaagggtgcatgaaaaagcaggcgcaaatgcattcaaactaaaataataagaaaaaaagatgcaaacttgcataaggaaaatcagaactgaaaagaaaataagaaatccaaaactgtttccatgacaagatgtataaacctaactgtgaatcaagtggcagtcttacaatatgaaatccagacaatgtgtatcataattcatgatgatgtttaccagggagtttacaaaaacacttcattattttataacactttcttattcagtaacatatgtagaatacagtgtgacaacccagagaatataatgcaacttctctctctctctctctctctttaaaaaattcagtccaagaggctgtaacagatagtcatcaaagtgtacatatttataaaaagcagaattatgcacagataccccccaggtatcagagttttcatgagtatcttttatgcaaataaaaggtcacgtgctgggctagcaaacctcataacaatgggaggtgatgataaccttgttgcctgttaaatattcaaacctatgatgctattgttatctagctctaaatgttgaagttgcatttcgtaaaaatacatcagtgctagaaggaggaaaagcacagaaaaaatcctacagagattttagttgtatagcttgcaaagatgaagacgactgacacagttctgatttaaaataaatgtagtcaattctggattctcccacatgtggatttctccagagcagcgacttttgcatctgaggctgggtttctgaagccacctagtgtttcctgggtgtggcttcactggctgttggttggggagctttgggataatataggcttgtctttatactaatgcaaggctacatacattgagatagtaaactggctgtggcagtgtggaaatttattccatgtctccagagccaaatggcaatgttcttaaattatttgctgctttgcattattcagaacatggatcttttcctccaggagctgggcaaggtctaaagaaagagagtacttagtacagagtcaggagacttgacgttctgggcttgtatataaaacctacaaaatgagggggttgattagactgtgatctcaaaagttcttccaggctctatggttaaattaaaagtgttatcatcatctttgccttccagcttcacctagcttgcttcagctctggaaatgtacttggcttcctccttctgcaggacatttgtacatgctgttccttttgcctggaaccactcaactcctacacatgctttagttctcagctccagcatcacttcctcagggaggtcctccttgccatcttgccattccatctgagtcatgtttctttattaaattttgtcatggaattttattccctttcctcagagtcagagcatcaatctgaatgtaactctgcccttgtttgatgtctggcttttactcaccacacatactaaatgtgtatcagagtgactgacactaaggaagtaattattaagcaattatgaaataaataacaaaaacaaaggcaaatatttattgtttttgccatgtttcaggcactatgttgagccctttataggtacttgcattctctcaacaaccccaggggtatacaatcatcccattttacagacgagaaaaccgtggcacaaagggcttaattaccaaccagggttattgctagtaaatggaagaactatgatttgaacctagattggcctaacttccgagcttgccctagaagccctgcttgccatttattttaagtttcttgaaaggagaagaaagttagtgccctttgtgtgtgtgtgtgtgtgtgtgtgtgtgtgtgtacgtgtgcacataccaccgaaggaatgaagacaggcagatcctaaaagcaagactagccataaaccattgccagtgccatttcttaaggatcacctctagacacacgaacacacacttacctgttcccatggacatgggatgcacagaaggcaaagctgtagtgaagaagggtggggtcgatcatggcgccattttctgcccgttcaagcaagtctctgaggtagcagagatgtcggtgacacccccggactccatttcgggcgcaatactcgtctagtacaaacacctggccaggactgaaccagccctatataaagaataaaggagagactttcttttaaatacaggttgttttctggagagctgctagagttgggagtggctagagaaggggactgaaaaatagccagagctaacactccttgattgcctattatgtgccagccactgtgcacagcatattgcggtttagtcctcacagtggaacctatgaggtacattctgttatccctgttataaagatggaaagattgagttcaagaagggcataaaattttctagtgagtgatggagggggattagcagacagcttggttccagaaacagtgtctcacctactgcttgaacacggaaccatacacgttaaaggagtattggggtggggatgtggcaaagtcgtggttactgataagaggaaatcataacattaatgctctacattgatatagagctttacacttaacagagaactttcagttgagccctatagcaactctgtaaggtagacagagaaggtttattttaaagacaagaaaatggaaatcctggtcgttaagtgactcacacagataatacaaaacagaggcaggactcaaatccagctctgtcatattccaagtcttcttgttttctctactctagagcatgaagaaattttagggttgatctacatacatgccaggacttcataaatcctttcactttggaaagagtgttttttaaatttttcaaatgaaggtaataacgcaactctccaaagagaacagcatggcttagttttcaagttgtgaatcagatgtaattccattaaactgagaggaacttcttgtgtcctggtttagagttttattttctcttctggtaattgtttgtattcttattatttatttgcttgctatgggaccagtccaaactctgctatacaagacaatgggaattcagatctgcaaattagagcaggtttggtggcatgatgggatggaaattgctagccccattacgcacttaagaaaacaggtgctcagaaaggccaagtgagttgccactcaaggtcacccttaagcagagcctgaaataaaattgtgttttctggtttcagtgtctgttcaaagcaagaaataaaccaatttaggtgatactttctaagctggaaatttggggctattttaaatataaacttaattttactttgagggtcttctctgagtcatcttttgaatattgctccatcttgggagagaaaaggcaaaaagagaaagtgactagggggcaggtagaggccacagaagtacagcgagagaggcctttgcaacactctaatcttgtattagggatctgggaatcttcaattgacaacatgcagctcagtgatgcatccaacgaaagacggcatctttcctgtttcaaattataagttactgcagagggcggagagtagtcgaggcagtgggctgcccctataggcaacttctttgccactccatctgctaccccaaatgctaaatcttagaaacaacactgctgtgaaagattaaaatatattttctacgactcagatgacaccaagtcttttgtagatgccaaaatagctgctttgaaaagagttgaagaaatatcaattaggaactcagtcgaagacacagaaaaatttatgtatccctgctggtcggtctccaaaactaactgaaaaaaagattgtaataatgagaaaatggaatatacagaggcaggagataaggtcctttttaatttctgttattttctgaaattttggaataatgactaatatacacaggtatacaaatggggaaggaagctattttatgctattcataattaattttagattctggaccataattttaagcctataagtaattaatggaaagcaagttttaatatttcatttctggtttaatttttttagagagcatttataaactctccttcacagtgaatctcaaaacaaagaaaattgttttaaaaaatgataatgtgaaaaagtcttggaaataatatacctcaaaaaaattccttaagggaatagtaattatatataaaagggaatgatttaagttcagaggcacattcttacaagtttaatgaatgccatttataattatgtgaacaatcacataattgtacaaaacacatttgagaaaaattgccttgcaatgcaaggtaagcttttttctttttctttttctttttttttttttaagtcaaagtgatgtgttcctttccaatttggcaaagttcagatccttttgatgaaggaattctaaacctgagataatcaatgaatctttcatgagatacagattaataaattattccacataattctgtttctgtgtttaagactattttatctacaattttttatatcttggcttttggtacaaaaaaagaaatttaaaataaaaattagaaaaaagaaagattgtcattatacatattagtatcaataatatcttaaccctacttattatatagtataaatattacatagagatattcttctcaactttagtgtttagaatcagggatgagaattttcctctatataaagacatttcatcattttccctcatctttcccatctataaagtgggattaatagcatttacttttaagaaatgaaataacaatttatggcttgaggaagaagtaaattgggtctttttttaggcgtttgaatttgatagtttaaagccaaaaatgtatcttcagaaatccagtaaaaatataatagcactcccttgaatttaaatcatttaaatctagctttaaaataggatttcaggaaatattgatactcctgctggatagatagctgaatttccaaataactaaagcaccataaaaaattccctgaaagggtgaaaaaatgctgtgaatattgtgaagaaaaaaaaaagccatccaaacaaacaaacaaacccaaatcaatttagcttatgaaaaataaagtttatttacaaatcattttaacctttaagaaaatacacaaagagaatacattcatgtaatgagataggattaccagatctgggatggggagggaagggcatcttaaactctaagctactgaggcaatttttacaagttctccacaagcaggtgccaaactcgattaccctcttgggaatatttctcatgtagcagctgaaaagggggaagctaagatagggaggctggggaattggatctgtttctactgataacttcctcccgctcagtcttgtttctttggtaagtaaaactatctcaacccaggaaatcgggaacacatttataattgttaaagggattctgtaatggagaaaagagcttctgacataaaggtagagaaatatttaaatgaaaaaaaatgttatgtttaaattgctgtagaccaaagaatatacttgccaggcaagaataggaatcattaagtctgtgatccaaagtaaggcgttgtaccatctcaaagagggaagcgtggtcaaagttacaggggttggaagagataaattcatccatgccatgtttttgagctctatctgcgtctgttcatttatacatgtagagagagacacaatttagagaaacacatcacattttctttgacatttcaaatacacaggaattcactagacattatgaacgttagctgtttccccgttgcctcccaccaacatccccaagatattctttttacctcccattgtcaacttgcatcacttactggtgagtttattgcatttaggcaagaagatattggcatcaacatgtttatcaaatgatcacatttccagtgcatttatgttgttctttaaaaactaagcataagaccgtaacttcgcctgcatttcaccaaacactgaaagcagatcggatctttgcttaagatagcctatttagctttgctggtttttaatagattctgccattccagtggttatgtctacagcaatttctctgcaattattgggattatctggaaaaagggttatgctgattttcagcaaagtgacaatatttatatcgtcttcttccaaatccccattgccaatttggtttcataaaaggtttgagtccccaccctgcaaaattaaaaataaaaaaaacgattttcattgaaacctggagattaagttaaatgggaatttagtttgtgaaaataaaggacatttccttatagtgtgcttactcagttagcaaagcttaggaaagagacaaacaaatttactcagcaagggctatgatctgccatttattgtgaattaatagtctcaatgtattcacacttttccttacggggtgaaggctgtaggcaaaacctcctaagggctaactaattaatctcaacatgtgtaactaaaatacactatactcaacaggcaaaataactcagagaattcaactcgtgtgtgtccaggcaaatcctaaagaggtagaaatgaaggtgctctccattaaagaaattggctcactccacctcatctttactgactctcctgatacgcagactttggagaaaaagaatcttctatcaaatctagcaaaagattttattcatcctttttcatgaaacatcttactggaatacggggacctgccaggaactagcgatgctgtcaggacacgggaaaaatcgatttctgacttgggagtagtttggataacattttcatgtgtggcctcagtcccaggcagctttttttttttcctctcccatgcttggggtatggctgtaagcttgggttatggttagcagtgtcacttccagatgatgatttctcctattattattgatattgtattaataaatcattcaaacctaaatccatggtatggtcagatttatacctccttattgtttgacttttttaaaaaaacgttgtcatttttcatagaagcagcaagtggtccttgtttgaacgagatgtggcgtttatgcccaagactcgcagaagcaacggtttccagaaggcaagttgaagaatgtgtattttaacagccaaatcgctccattagaataataaaacacagcttttggaaaggatatcacatgtgcaggaattatattagagaatctgagagaatcctccttgctgcattaactgcctcagatttatcctcaggaaagtgctttcaacttgaggttggctgcttcatctaggaggcttctttcagttcggttgtttggtctccaaactacatttcttctttgacttaggatggccaggaagttgttgctcctgggaaagctagctgcttctagggcatgtgtgtgactcctctggcccaaggcaagtgtcttaaacctgctccaactgtagtctcccctggcataatgacactcctgcaatccaggtgacatttctctatcgcctttgatagactctgccctctcacctccaacctgtcagtcccagatcaatttaactcaggagaaactaagcatggggtacacacgaattgctcatgctgtttcatcctcataaaaagcctcatccatccctcgcctcccaattttaacagatagatcaggcattttggctagcagcagcttcttgctctcgggtttctcagaaaaggctgcaaactgacaaaccggccggggccttactctgccagtttggcttggctattttattgccttcaattatgatggtacaactggtcatttagctcagagagaagggggctcttttgtagctgttaaaaaaatatggcacatgtttcaagtctctttctctttgtttgtttgttgaaactcttgaaaactttgctgatgacctatttcactttgctggccactcaggaaatggatctgaaaaggcgacttggctcctttatggagacctggattcagacccactccccacccctcagtccatcacaatggctcaatgaatgcagctttgtggtgctaattctagtcgaagtctaaagaacaatttcattttttactaacgttttaaagcaagcttacagaaaagcctaaaatcagcctgctttcattttcaaaaagtaaccttgtcaaaataaaacttccttttcccttcttcctttctttcttctttctccccatccacttgtagcatgagcctaggactggatctaggaggtctagattttaggttgagctctgtttttaaaaaactgtaggatgctggctgaattgtttatctctgagcatcagttgccttctgtgtaagaggagctgaattttcagttcccttcctgccgttataggctgtaatttaatgatccttaagatcccttgcacactatgtgtggaatggagcttaatgcagtgggaatttccagcaagtaaagcgagccacctctggattttacttgccccaaattatcatttactcaaaattgggctcattattctaatggttcccacaactcaagagcgcttacaagggtggctggctcccacaaaatctttgagtttcattgagcttattatatttactgagcttattatgttataaaaaaaaaaagaaggaggagtaagccaggagtgctgtttcaaggtgctaatgaaaaaaatctgatgtttaagctcatccaagcaggggtttcggtattttttgtttgtgctacattcccagccctagaatagtacctggcacgtagtaggcactaagcacatattagttaaaatcataagtttatcttctcagaataaatacagaaactcactctattaacaaatatttttctttcttgattttatggcatatttatatactacattgattggaaacggcttatttaatgggagctagcatagcaagtggttaagtggctgggcataggcaggtcacaaacactagatttgagactagctctgccaccactaggtatatgatatgaggcaggttgcttaatgcctctgggcctccttggcctcatttgtaaaatgaagttaaattcaagtccaccttcagaggactgttgagaggatctgaagagaagtacctggaaagtacctagggccctggcatatattaagggctcaataaacattagctaggagtaaacaaacaggatctttagtgtttgaaaagccagtttgtttcaagtagttagtgagccaaggatgtctctgcatttatagctaatgttctattccttctttgcttcttaaaccttatcatttctaggaagctgggagtccttccctatctctctgctttatttttcttttctgcccctgtataaccaattcctatgtcctgtttctgtgttttcattgggttattttccagtttctctgtggtcaagacacatacataaaattgaatcccttggtagataacatgttctgtgagggcaagtttctaatctgttatttcccctgccagctcttagaggagccaggtcctcaggaggggttattaactggcttactctgacaccttcatcccagtaaacttctcattgactttattaaggagtcacacacatggggattcagatggtatcttgcaaatccaaaagtaggaacatgtgctcttaggggaaaaaaatcttatagaaggaaacagaattctaggtgcaggtgtctttggataccattcagattgtctgcctgtgtctccatacatgtctaggaccatatgcattacatatgttgtctattttaaaataaaacactgcagtggtccagctgttccaaattctgtttcaaagaacttgtgggcgcttcccaagcaacaccatacagtcattcttgcactgtcccggtctgttcttccacagtgtcaaacataaaaaaataaatgctccttgcaactccattttttccctgtacaaacagttggaattggttgattaaagaaaaagaaaactccaatgttgacattagcagagggaaaacagcccagagcaagcagtatgaaagagtcaattcctgaattcaggacattctgggatcacttcctttgccaatatttggcatgtgtcaagagaatgaaaatgaatttgaacatcgggttaagcaaaaaggaattaggagggtaaagtggctgcttaaaaccccagtgatgtttggatgatctcttgctttgggagatgcatcctaatgctctttttcattaaccgtatttttctagaaatcaacgattgacattttaagaaccaatttcaatcatctttacctgtgtcagacctagtcttaggaagtagttcctaagtcctgcttggtcttcaagggctccagatgtactgatgtactgacagtgagctatatgattttataggctctgcagctagggcataattcaacacaccttgcaaacattgctacctgtttcacttcgggggtttaattgcataaggatttttcagtcctttatgacatgggcataggagactgacttcaaactaagcttggatggataacgctgctattggtactgacattaagaaatttcaagcactgtcaatggtttctatgacatagatgcaggttgatgaacatacagacttacggagagcaggtgcactttcaagcggaaactagtctaaaccttgccccaagtttgcttggaagtaattttggcttgacatttaaggaatgttgggaaaacactggttcctaaagtgatactattatgtgggttttatactctcatctcatttaatctactttattaaaattcaagtggtatggtccctaattgactactctgtcatctatgttgttctttgatcatgatatttgggttcatttcatgtttgatagtcttttccttttttcctccctcacaaatgaaaaccatatactatttttcatgatctattatctcagtatcaagcacacttatatgatcttgtttctaacatatatatttttagatagacttgcaataatgtctagcaaataaatgtaattttcctggaagaataatgtagttttcaaatttttattttattgaaattttcctattatactaacagcttagggattgaagataaaaggtcaaatctacctttttattctgtgatattacattttggaaatttttctgggctagtgaaaaattcactgttgaaaataattatgattatattactaacaaattgtctgaaagaggctcttctctctcatgaatcccttttgtaataagctagaggtagctgttttaacattggaatttagagcacagttatggctgttgctactcctgatggatgctagaggcaagagaatagctaatgcaactctaaagtcatctgtgaacccaaactgcaaattaaaaggtgactttgtatttctcttatacggaaaatgtgtgcttgtcatatctgcttgacagtacaagagtgaatgtatggtttggacaataacgaacaatgacagtagtcagcctcatcagaagacatgaaataaagaaatgacaatgactgatggcagctggttgtttatggatttttctagaagagctttccttggaatagtcaagtaaccaggggatgttgtgccctgcctgagctctgcacagcaagcaaaagactggtcctcacatgcctgctgcccagaggcacaaatggaccacttaattgagaaacaacttaattgcttcgtggtccctttagctaaactggggtaatatgaatggccaaaagaggatggcttctttggaagctctcaaggctcacattgcatcatgcagaaatcttgaatttaaaactactatggcaatacccccaaaaggataagtgtgtgatgtttatttcaatgttaatttctataattatttgtcagacaattgctttgagtaaaaatcataacagagattttgtcaaagatctcaagcaaaataaataaatgattttagttttctcctgctgtagttatattaacttacagagtactcgatgtttttgcactcactccaacatgagcaaaaataaattttctatacctgattaataatcttactataactcactatatggcatgaaaatactcaattaactagtgaataatatgttaaatatgtcttacgtagttaacagtgaggtaaaccttcatttaatatggtctgtttagatcaaatcatggtgtttggaaaattttagacctgattgtgggaacatattcttttaaaaagtgatttacttttacagtgaaaagggacatgatttacagtatggttttgggtcaaacaaattatgttaatattgaattaattatttgatattgcattcctgcaacgtagcaactgcaagttgacaatataagaagatatagcaaaattttatgagataaaactacagaaaggaattaaggcaaacaattgtttaaaaatctactaggatagcaatgcgttgttgtgcaaatacatgtaaacttgtttagaacagaattcattcagttaactattcatccatcctttctttcattctttaaaaaaagtatagcaaaatcctaaattcccactaagtttacattctatgataagccttttaaaatgcctcatcagacattcaagaaaagtaaagtcaaattaagtatctgcttgaagtggtgaaaaacgtctgtctgctagccaggggtacatttatgcaaaataaaagaaaaaagaaagaaagggaggaaaaagcaaattaaagaaggaaacaaaaaaaatttgaagaaaagactatcattaaatggtcaggagaaatgatatgacctagttcttctaaattagcattcagaatactcaaatacatagttgcctgctctcttgaccaatttttctaactccgtctaacgtcaagtctttcctcaacacatttttggttgatagttttttcctatataaattaaggaagtatgtgttcttttttattaataactcgaatagttaagagaaatatttttctaaagttttaatgtctcctttttctcttacatgggtatttttagaaaaattaatacaaatacaaatgatgtcaaaaaagttattgttgtcattgttcttgggggagtagcagaatgacatttgataccagaggttaaatgtcaaccttgataccaaggttaataccttggcattgtaagactgtgaatccaaagcatttgtaaatgagtgacatggattcagtcttgtccttaatttcctgtttttgtgtgtgctagttccatgtattgtagctctcctttcaaaattaatcctctattgggtcttacattagagcacacccttaagccagctagaatgaactctttagtgttcaaataatgcatttgctttcttaattgtattttgcaatttcttctagtcttgctcagttaacaactctgggtttcctaccccacttattttttaaggtatccatggttaccacaccactggtactctgaccattcgaatctttggaatgggaaaggaaaaacaacaacaacaacaacaacaacagcacattatcagagtgcaaaatgatctgttttcaggcattaagcagtcaggtagctgtgaattacatgaaacaaaggcattatttgccattttgttgtgatgttaattaatattcttggaatgaaaaaaaattagacgttaatggttggctttactcagaggatcatttgatgccaatatgaaagccaaggagaggaggcaattatgcacacatcacatgcatcctagtttcagtatggaagcttacatttcaaacctaaggtcaggaaaataacatgaaaagttgtactacaaattctagacatgaggaagatttaagggggagggaagcacattgcaggtgtcagataatctaatctgattatctgagctgtgctagctataggggagcacttacccttcagtccagctagaagttagcagggtaagaaggaacaaaccagaataacataaagactagcaacaaggctcaggaaagcagacaggagttctaacctagcagcctaagttcttgggttcgagcaaagattgaacaagaaaacttaaacaaaacaaaacaaaaaacaaaatcaacctcccccaaaccaacagtaacccaaatccccctaactgttgaagacgttcaggtggtagcaaaaatagaacagttctcaaaaatacccagctttggggttctatgatgtgattaacagttattagttgagaaacagacattaaaatgactcattgcaagtgatatattaaataaccattgatcaaatgtcaaagcttaaaataccctcttcccccaccccaccctaatccaaatgagaattgaggtactaatttttactgttccactaacacataatggacaggggataaggtatctcaatgagaggccactcagcataataaatcgtggaacactcagctacagattgacatcatttccaaggtaagcagcattggccttaaaaatcggggaattgcaagaatttgtttaaaaacattgtatagctaggtgctgacttaattttgttaaattttaacaaaaaagaaaaaaattaaatcaacaatgacacacacaaaaaaactacaaaagaacaaaaaagttttaaaggttggtgaaaccctcccaaaaatctctgtagagtcacacacaaactaatgaatagcaggatctatttttttcagtttttacagttccacataaataccccactccactcttctcgaagtgtcttttcattttaaaactgagcttttgaaattgcaaaaaataaaaactgttaaactgaatttagaaagacccaaataaactcacaattactcccaagttttccaaactataaaaatggtccattcttaagtttcccttaaacagacagtgacatgacaagactggagtgtttctttttctctaccccaaaaatatttctatattgcttcccttctctatgtatttttccatttctacgtagcttccttttgtcttgtaaatactaataaagcgattatagagttaagtcactgaaagattgttgttcttaaaaattattcactagcaagaaaggcaagtactttgaacaaatattcaaaaacaagatttaatgagatgtgtgcagagttaagtacttaacaatgacccttacctttttggaagtcaaggaaacctttttaaaatgcaatacttgatttttttttttttttacattttttgttagctagagaatctgtgattgacttaatttttgtgatgtgacttgattaaaataaatcagtgtatagattggcaaccaaatgtaagtgaagaatgaaaatttgttctttacaactatgttatgactgtttttcatctttcttgcgtggtagtacctggtgaccaatccgtcctactttgctcaggattgaagcgtttcctgggacacaggattttcagtgctaaaaggagagacgtcctgggcaaactaagatgacttggtcacggtaagtatgaatcaacactgtgggtttgactgagttacccatgtgtaaggcttgatctatttagtactgacggtttgaattttacaaattacagcagctgtgaagtaattatgaactaaccaccattctgtggcttactccactaacaattatgcagtcagctcttcagtatccaagggttctgcatccatggattcaaccagcggtggattgaaaatattcagaaaaaaattacatccatactgaacatgtacagacctttttttggtcattattccctgaacaatacagtgtaataactatttacagagcatttgcattatatccagtattataagtaatctagagatgtttcaaattacatgggaggatgtttataatttatatgaaaataccatgccattttataaaggggatttgaaaattcatggattttggtatctgcagggggtcctggaaccaatttcccatggatactgagggaagactgtattccctcatatctagacacttttttctcttttggttgctgtgcataactacccaatgataccatggaatgtaaaattcctggttcctttcttgatctttttgtagatgctcaggcataaaggttgggttgattaaatcctaactggttgtctctgatggcttgtaaattataggaacagaagccacactggctggtactctggctgcagtttttattaagtgcttaaactagcaatagatagaatttggagcagtgttgaagctctgttgcagggataataaagtaaccatgggacggctgggatccacactattagactgaagttctgggtaagggctgccatttattacatggccactgtgtacagttgtgcagatttggcactgcagaactcaatgggtgccattcatatttttgtgtatgtgcaaggtgtttcctgtattacacagtctccatagctgattgtagtggcttgttcttttagaacctggtagatgtagcagggcctcatgctctctgaagaactcccgttcctcggcagtaataaaggagacagtacagaagaaggtaaatctaccactaggtactgataaatcccaatggcatgcatgatctggttttctcactcatttctcagcctactttacatattccctagggatgatatcatttacgcccccccccccccgcaaattctaactcttaggagtttgctttggatgctccatttaacaaaagttccttatttcaactagagtagtgatacacatcaagctgtgtgtattcaattgagtctttctgctgatgcctaacaactagtgttctaatttcacaactaaatgaatcctatccacagacagaaatctaaatcaagagcccccatgcatttccatgaagagacatctcttcttcagcagcttccatcacaggttttcttttttaatcgatttcttgtctctaattttactcctgaatgtccttcatcttatactagtgaggaaaaagtggggtcaatagcaaaccatgtagcagtttcttaatctgggcagatgatagaacagagacactgaatgtaaggtgaaatgactttagaagaaatgaagattatttggaaataagaccagtattttccaaatatcacctgagatacatgctttatgaggttgatttgaatggtgattatagttagaatttttttctgatacagggggtaacttcttttcaagaggttacgataggatgtgttgtttccaaatgaattacaaaggagcatgttgcccaaggtgaaaggagggatttttgtcatactttaaaaaaaacacacaacaattaaacaaatactgggtatgatttatcttgactaataactattactctctttactgctctcaagtaaacctaagtgcaggaagatgttagagaatacaagagtggagaacttggtggtaggtgtgggcaatctctttcttattctttcatgattttctgtgtggaaactcacagccattatatgattatttacactgttccacaagggcatgcatcaccatcagtactggacaggaattcctgggagcatctgatagacagaatttgtgatccaaaagaagttgtatttcctgatcaacaagggtgttgcaaggtgtaagaatatagtcttgttggacagaaatggacatggcagtagaattcactgaaatacaagtttacctctatttagtagttacagctgcaaaattattccacccacatccatattctgtttaagagcaacagaggagagatcgtgcaagcactgtgttagaggttaagtctctgcatttgcatttgttttccttcagctgcaattctctttcctcaaatatctgtggggctgactacctatcctttgaacctaaactcagggaaagcttctttgtttgtctaatgtctctccttctcactcagtcaccactaaatgacattcttcatggtatttaccagtgtctgaagctctcttatttatctgttcacttgtttactatctaggcttccccactgggatgcaggtattataagagctggtaccttgtctgtccttctcattagcatgtcttatttctagacagttgctcaatgacctagaatgaatcagtgaattccatactaaagtaataaatcatcatgattattgctaaaaatgacttgtacctgtgtcatctctgattgacttgatattcagggtaaagcaaaagactctatttagaatgaatgtttggaacgaaaatgaattactttatttctccattttctttgttttaataaatatttccaaacatgtactggctttcacctcaccctgtgtatcagaagtattgatagataaaagccattttaggtagcaagaagacatggaaaaggggcaagaaattaaatgtatgcagaggtaagaggagaaaaaactcgaatatgaactggggctgtttaaggagacagtttcatttttgggtcttcggtattttagctcggaatgggattttaggtaccatgttttgtgttttttttttttttttcgctgcatgtgataatgtcatcatttatttttaaatggttctaaattgcagatttaagttgatttcaaatcaaccctatttttaaattacttttaataggaagaaatgaagcaaggacatacataatctactatatttgaaggactcaaacaaatacatgtttggctgtgaattctgtactctcaccaaaacagagataaaaatccacctaaaatacactttccttcatttagtgcttgtgggagaaggtcaagtattgcactttaaaattactttcatctaacatttgccccaactttccccctgaattcactatatgttttcagcaaacatgattttataaattttaagtataaaagcaactaggttttctaattcaactttggaaggtttactttactctacagagctatttttgtaaaacggcatatttacttacaaaattgagagataggggcatccagctgaggtacatttcctcccttggcgttgagtttctggacttgggtcgggggcacaggcttgtgtgactgccccgtggcccgatacatggcctggacccacaggatgcggtcttgttcatcgtcactggcaaatatcacggtgtctccctccttgacagcattgaagaaggctcggccaccctccaaacctggaagaaaagggagtaacaacttctactaagctgagctgtgatgttctcaactggactcagcctttgaaaaagcagtttctgctgcttttccttgggacagaagaggggggtagtgattaacttaggatgggaagtctgagattcacttgtccacagagtgggaccgtgatgttgaagaagtatttctgagcctggatcttatctttttgtgtcctgctggggatagaactgccaagcaggctgcctgcttgggggataaacatctgcctataaacatactattttctccctcatctttaaacacaaacaaaacaacaacaaaaacctctctttaccacatctctcccttcagctactgtcctattgttcttctctttacaacgaaagggaaatctctaccaaggcttttccaattttagtacccatacgaaccccctgggcatgttgttaaaatgcagcttctgattcagtacgtccggaacagagcttgaggtgcagcatttctaacaagctcccagatgattcagatggcgctggtgtgaggaccacatgttgagtagcaagggtctctcccctccttttctgccttacaacccctccaatcaggctgctgccccactgaaacttgtccaggtttcagtggacacattgctgaataaccagtgacctccacattgctgaatccaatgactgattaaaagccctcattttattgggcccacccacctatcagcagcatttgcactcccttctcttcaagatgctttctttacttagctttcaggaggaaaccctgactttcctcctaccatcctggctgctgctccttagtcttgtctggtggctcctcctcctcctcttcctgatttttaaatgctgggcttctgtccttgcccttcttctcttccttagaagcaccctctctcatggtgatgccaaccagcctttaagtaccatgagtatgctgatggccttcacacttctctctccaacctggacctctcccctggactccagacttgaatatctttcttgacttttccccagggatatctgatagacatcccaagcttgtgaaacccaacaatgaactcctggtctttctccctgacctcctcagcaaagctgagcccatctctcttgccactcaagtccccagtcttggggtcaattctgactctttactttctttcactacccacttccaatgaatcatgaaattctgatggttccaccgttaggacattaccagaatttgatcacttcttccatctccagttgcggccatcataaatgtagccaggatcatccctggattattttaatagcctcctatctgacctgtctgcctccatcctcattctctatagttgatgctcacaaggcagccagagtccctgatttagcactagagtcaggtcctgtcactcttctgctcaaaacctgccagcagttccacgttccactcagaggaaaagcgttggttctgacaaggcctgaaagcctcccatgaattggtcctctgccacctctaacctcctctcctaatactctctctctccctctatgcacacatgtactcacttcattgcagccacactggcctcttgctcttccttgaacaccccaggcatgtgctcacctcagtacctttgcaattgcttttctctgtgcctggagcactcttttttcaggtatctgcatgattcacactcttatctcctttgtatcttttcctaaacatcacattcctgttgagaccttccctgacctcccttcttgtgacctatctcttatcttgcttaatttttcttttttgctcctattactttttagcaaactatataatttactttgcttcataagtgcaggtagtttttgtctattttgcttactgctgtatccctggagcctagaatagtgcatggcacatagtgggtgcacaaatatttgttgaataaatgaatatgctctagatccatctttttccatgggcagttctcaaggttaaaatttagcgagaagtgcatgttctcactcataggtgggaattgaacaatgagaacacatggacacaggaaggggaacatcacacaccgggacctgttgtggggtggggggaggggggagggatagcattaggagatatacctaatgttaaatgacgagttaatgggtgcagcacaccaacatggcacatgtatacatatgtaacaaacctgcacgttgtgcacatgtaccctaaaacttaaagtataaaaaataaaaaattagtgagaagtaggtggaaacttctctttgggttcaggccaaagctacattgtgtccatcaacatattctagaaacctgtattttagattactcagcattctctagctggaaataatacttcatatcttcatcaggttcctcgtcgcctcctcaattattaaaaactaagaggagaatgaatgagttattagcatccccaaatttccagtgaggtccagccagtaatctgtttgacatttgtcattggaaaagatttctggtaacattaagacttcttcattgtgccgatgcaatttattgaggtgtctatgctgcaagcgtgggtgtgtattgatagttttgcacttggaatggccagggatttaggacaataaatagctacttctttatatggagggtctgataatatcacaccaataaagctttactaaaagatttttggtggtttttattataagggactattttgcttaatttcatatggaaagttttaaaatacctaatttgagtaggatgatgtgtagttagcaagctgggaaaatctgatgaacctaatgaatagcacaataaaaaggaaaattctgaaaggggaaggaggaggaagaagagctctgagagttgttttaagcctgaaaagtgagcaataaagagttaaaaaaggaagagcaggtcaatagacctgtagcctagtctcgtggtatccttaggaataagctgttttgctacagtcagggaatgccaggacaaacacgatcaggtatcacttttactagccccaaggcctccccctcacccagggcctgctgctggggtagagatactgtatttctggagctaccgtcagaaagtcagttcatggagttactttggggaagtggacagccctctccactgtgcagttatttagaggtagagatggaaagacaccaggaagtttttatatttttaatcaatcctcccaacagccttatgatgtaagtactattattccattttacagatgaggaaactaagtcatggggaaggtggtaactagcccatggacacaaagctgggttgtatgtgtcagagctggcttttgaccttggctgtttgtctccacagctgatgactataaccactgtgctttactgcaccaaagcatgaatccagggctgggccctcactaacagctctcttaagagtcattattaacaataaaatgaagcctaattttggagtgggtaagggcaaagagaaacatctaaagaaatggcagcaatgacaagcacagcagcagagagcaacagggctttttcagaaagcaccagaggctgaggacacaccaaggaaagcaagaaggagatagaagagcgacagatgaaagagaaccaagagaggagaaagcaaagtgaacatccacaaagtgaagatccacatgtcataaccacaaggccatcagtcttagaaaaagcaacaattcctggggactgaatctgaagaatgtgatgtgtgacctcaaatgggctctccttggagaacgaggggcacagtcccacaattcaaagacaaaaagacacgtctgggaatagatggaggcagaccaggcaaaggaatgctggccagctctctaggggaaaggaattgcacttccaacaacttgcatggccaaagtccatttatgagggtaaaaaaggtctttatgagtcgtataagaataattcagttgtttgataaactgtggcattgaattattctggattaatattcttttatttgaaggcttaattatctaatcggatagaaattgagattatttcaaactttccaaaccatacacagggaaaggtaaagtgatgcatttttatttttagcttaaaaggagtagcttgtaagtgaaacttacataatttgccagttcaccaaatgaacacgtcaaggacccaaacaggtagagtttatttagtggaaatgcttgtgtctgggggaaccacgtagattgtaggctggtactaaggcaacaatattaattgcatccctcccttctatggcagagagcaacaggccacaagggttcttagcacacaaaatcgccaccaggtggatccactgacaatttggataaaaccaagagaaagagggagagaggtagagtctgaagtcctccccatttgcacactcacctttcagggagcagttgaggagactcctcaaatctgaggacattggttaaaatgtgcattacttggctctccagctggcaaatgttactgtgttcaggaatcccctgcagtgcttatttaaatacaaagattctgacctctccctacttctggttcacaggttagaaatggggcccaggaacatttatttttaataattacttttttgttgtttgtttgagacagagtctctctctgttgcccaggctggagtgcagtggcgcagtcttggctcactgcaacctctgcctcccaggttcaagcgattctcctgcttcagcctcccgagtagctcggattacaggtgcgtgccaccacgtgcggctaatttttgtatttttagtagagatggggtttcaccatgttggccaggctggtctcgaacccctgacctcaagtgatctgcccacctcagcctcccaaagtgctgggattacaggcgtgaggcaccgcgcctggccaataatcactctttaaaaaattctgagttagactttcccatgacaactgagagaatttaagtctccgttttcaatcagacattacttggggaataaataggacttagcacatggaaagatagaagaagctgcttattattctcaagaacataattgatttacattttacatctttccatttacatctttcgtatagaaatttataaattatatcccatgggatcgatgtaaaaagaaataagctttaaaaatatatgtgcacagttactccttacacatgtagatagaatagctctctccactcctgccctccccactgagtgaagataattttgctttcatctgataaagtaacaaccatagctttgctatagctgttcatgcagctatgctttactgcaagtgccaaagcgtgacatgggttagacccggagtcccagctcagccaccaggcagtcttaaacaatagcctttgatatctcagaatctcagtttcttcatttacaaaatggggtaatgatcctggtcttatccactttgtgggattaccctgagggctaaatacaatcacatggggggaaaggaaaatgaactggcttaaaagcaattattgtcataaggtggtattgatttcccttctcatattggccctttagcgtcccattttatgtttaaaaatttattattctttacaattctattttttgagttggggtctatttctgtcacccaggatggagtgcagcagtgcaatcatagcttattgctgcctccaactcctaggctcaagcaatcctcccaccttagcctccctagtagcctccctgtagcacacacctacaggtgtgtgcctccatgccctggttattttttaatttttttgtatagatgatgtctggctttgttgcccaggcttgtcgtgaactttggtctcaagcgatcctctcgccttgggattgcagatgtgagccaccactcctcaccctagccttctacttaaaaataaaagtcctaaggaggactgaatctatttttttgaaggatacacaatggcttaagaagaacacaaaccatcacagaatgtcctaaggactggtttcctaaggcaggagccccatcctttccatgagaagttgcatgaaattgtttgtttcaaactcgttggttctgctcatgaaggatttccaggcagagcatttaattcatgccttatgtggtcagctctgcattctgctctggcaagtagcaaataacatatgaaagaccgaaggggtggcgctgggcccagtcactcggttgagattctgcaggtgctaattttactaagtgggctgggcccaaggccttccctgccacaccttttcaggttagcaccccatcttctctcaaactctgtttttcttttatgtgtattttgttgcatgtggaagagcaatatgggagtagaaaaaaaggttttgggccaaataatgcagtatggttggaaatgctttccttgtgcagatttggcataaaaataaacttctccgggagagggctgttggtgcttgttgttcattaatatgctgaaatgatttcgcacccccctcccattttgaaggttctttgaggctgatttctattcattttttttttctgggaaaaagataaaatgggtggggggagaggtgcgagggggcaggatgtagaacttatgcggtgtagaacttttaagaaatactaccgctcgtgtagttttcttagctacataaggcttaagggcttcattgtctctgcttgtggattggtgtcttcttagggaaaaagacatttagggagggttttcaagtgctaccagctaaccttatgatctcttgaattgtagctagggaaaatggatatattgggcaggctcccttggtcactgaaacctgccaagcccacacatcactggtgaaaaacaacacacacacacacacacacacacacacacacacacacacacacacacacacacactccttggtgtacatgtgggactacttctttttcagaattttttttttagcattgtatggtggagtccatatttgatgtggatacaggcaggtaaaagaaaaatgctcttactttttgggtttaaattagagaatcccttgagtaaaaccaaagcactaggttaggatggcatttaaccaaccgggatggaaacggcataatatcagggattgtgactgtcatgcacacagctgaaacccttagtgaattgacttagtgcctagcatggagtaagtgcccagcaattattagttgaccattgatttgggaaggttgagggtttgtgggctcgtggccttgagggtcggtgggtacctggctgggggtcggtgtaatccacagtgtagccatccaattgtagaagttcctgaggctccgctttcttctcccgataactgcacatggcaaacgtgtactgactgacctgttaaggaaaagcagattgtgaggttgacccctggagcctgtcttctccaaaaaaccctcccccatgttctctcctctgaggatctggactgagtggctgggttcaaactgagttttgctacctcctggctgtgtgacgttgagcatgttacttaacctctctggtccttcataacctcatctgtagactggatacaatcttagaacctacctcattggcttactgtgaagactgaatgagttcacgtggggaatgcacttacagtctgttcctggcacttagtaagtacttgatgaaggttagctattatcattattgcttttaatataattgggttaagctacatgtgactgccatttttgtaggtcaaaagtggttaaacgacagcaattttgtatgttctacctaatgtgactgtggccttggctgagactgccatgctcgcagatacaacatgggccttttggtcagaagttagaggctagacattcatttattcatgcctttttatttcagtattttattttttgcagcattttgatcagcatcaaactacatgttttgtccccttcttcctgctgaaggagtactttggttgctttgaagtcttcttcttatctcagacaagtgcaggagtgacatgctgtcacaagcaatgagcgcttgatcgctaggtgccagtcacagtagagcaatcctcagcccccacaatggcgtggctgttgtcacttgtgccctaatggcagccctcactctaccaacacaaaccatgccagtgcagggcgggtgctcacagctgcaggcccgccttcaggaccctgtcactctagtgcatccagatccagcacatatacttagcatttctacatctggcttgtctgcaagtagcccgtgggaaagcaagcatcctcctagctttgggctaaatgctctcaggcatatttactatccacggatgtcaaatgtcttagagaaggagtgccacatccctcatcccttagtttcctttattaaaagagacactttctaagtgaactttgatcccagtgggggacatttttagtctcttctatagtgagatttgtttttgttgttttaatggtgataagaaattgacgctctcgagtgctacatgcatctcccgcactgtccgaggcttgagggtcccagtggagagatgaagggtgtccgcaggaggatgtttttggtagttggtttgtctgttgctgccctctgttggctcctgatggaaactttaccgccccacttgggtttctttataatgtatagggtttgcagaacttcttccttatatcacaatgccaggggaaacctaaggctgggtcactgagagtattttcataaaggaacacatattaattttttgtaataaacaaagtaatcaatagcacactcttctaaaatggaaggttaagagtgtaggctgagggttccatgggcctggggtcccatcccagctctgataagctgtccgttctgtaagcctcagagtcttcatctgtatttacctgcatcttattgttgctagagaattaattgagttttacataccatgtgtgatacccatagagcgaacacttcatatacacatgcatttatacaggccccttccttgcatttgacacactttctaatatagtatagcttaataggtggatttacctactggattataaattcattgaagacaggtctagggagtcatatgtcttgattgtattttcagtctcataagcaaaatctgccatataatgggcattcactagttgaatctgattggttctagaaagttgagtacatacaatccaataaagaggttttaccccccaaatttacaggggattccaagtacagtaccaggcctttccaacttgttattattgatcctagggataacagatttcctgtgaccctctgcatgacaatgatcatagatactgctggaacggtcccatggggaattttttttttttttagatggagttttcttcttgttgcccagactggggtgcaatggcatgatcttggctcacggcaacctccgcttcctgggttcaagtgattttcctgcctcagcctcctgagtagctgggattacaggcatgcgccaccatgtctggctaattttgtatttttagtagagacagggtttctctatgttggtcaagctggtcttgaactcccgacttcaggtgatctgcccgcctcagcctcccaaagtgctgggattacaggcgtgagccaccatgcccagccggatttttttttaacctggcatttctcatctgacaacatgaaagatgacatagtttgttaatgtgattggccaaacagagagttgccgacactcacttaagatttaaaaaaaaaatcacaacagaagggtgttatttcaagatttatgcatttactattactacatggtttgggctttttaatttttttttttttttccttttctatttcagtggcttccttcttggagagctgtatgctgatgccctcttctggttatattgctgaagtcactctccacaaactgaattgctttgagttggtaaaccaaattgagttggtttattgggagcatcttgatttaggattttgcaatgtactttaggaaataaaggaggggagaaagaatgatttctctttgaatgattctaattattggaaattttggggggaatctcactttttatagactgattgaatggtgggagaattgcaaagatttggaaagccttacatttattttttaaacttccacaagaccacactaagtaaaagccatttcccatgaaatgcatgttcctctgtcgtagtagaattcttttaaaactgtattttgttgatgaaaaattaatgaggcagtgagcactgttgtaataaaggcatggcagagcctggaatgcatgttagaagtgagaaagtcagccacccttgtcagacagcctggcctacaacagaaagcataaaaatctagtgatctcaaatgatcagcagacatctgaaagtgcactttgcagagaagggcttaaagaactctgtctttcacatccttgggattttcatagggtaggtaccttctcatggaatcacaggacaggccgttgggacttctgagggaacagtcagcgaggttttattttaaagctggctgcacctcagacacacctttaaaaatccttagctcatttccagtcacgtgcttaaactacagaatgctttgaagtaatgttccttaaagagtggatggtgggctgggcgcagtggcttacgcctgtaatcccagcactttgggaggctgagatgggtagattatgaggtcaggagtttgagaccagcctggctaacatggtgaaaccccctctctactaaaaatacaaaaattagctggacgtggcggcagactcctgtaatctcagctactccggaggctgaggcaggagaattgctggaaatgggaaggcagaggttgcagtgagctgagatcgcaccactgcactccagcctgggagaaagagcgaaactccatctcaaaaaaaaaaaaaaaaaaaagagtggatggcgacagctgcctttattattagatagtgtgtggggggtgagggggtggattaggctgtaaatatgtagattctttaagtcagaccagaatcagaatctcaggtcagagtgggccttaggattatacatttttcataactgtctcagattctctctctctttctcaaaatagggtcttgctgtcgctcaggctgaagtgcagtgacacaaacatggctcactacatccttgacctcctgggcttaagtgatcttcctgcttcagcctccccagtagctgggactagaggcatgtaccaccatgcctggctatttttttttttttttaattttttggtagagatggtgggggggatgtctcactatgttacctaggctggtttgaactcctgggctcaagtgatcttcgcattttggtctcccaaagtgctgggattacaggcatgagccaccacacctggccagatatctcttaatacatgttaaaatctgagaaccacggttttaatatataggaactgtccataacctctaagattgcccttgagtttcaattatagttagcaagtagattccagtcatgagatgaaaaggttagacttttctgtccccaactctcctctccccttcttatcacctatgggagactaaaatacttggacatacaacagtagaatgtattttgtctaaatcttctttccttgcttttaccatcattctttgaaaattaatcagctgttatttttactgaactctggtcaccagcccttgtccaaaattcatatacataatttagaaaagagttgtttataatagatacattcattctttcaacaaatacgtaggtagtgtgtttggttcgaggactataaacatgcaaaaaaccagatgtgattcctgccctcatgtctagcatgaaggtagacattaatcccatgatttcacaaatgtgttattttaatagtggcaaatattaaaaagagaggtatatggtactgtaagagcttggagatttggtctagatgggtggttgggcaaggaattcctgaggaagcattgacggattgagccaaaatctgagcatggagaaaatttttatggtgtgaatcacagttcctggagactaaggactatttttaatgtgatgtagttgcgaatgaaggatcacagtgtctaaatcccagactcctgattggcactgaagtgaaggccatttggtggaggagaaggagaatagattttagagtcatgcagaactggatttggttttcagatccattattttctatgtgaaccaaggcagttcagttaacttttctgggacatggttttgtgatctttaaatggggatgatgataacatctgtgggacatttctttttttgataattaaaaaagaatttatttcttgtagacatggagtctcactgtgttgcccaggctagtctcagactcctagcctcaggtgatcgtcccagctcagtctcccaaagtgctgggattatagatataagccactgcacctggccttctgtgggggcatttcttatgtgtgcatgcaggccattcattgccctcccacaactgaatcctggtcttcctttgggaaccactctcttttcaactttcagggcaagtggtttgtgtgggagtaactgcacatctagctggaagtagggtgagtaaaacacttggcccatgcctggccaatcaacatagtatctccttggttgcagtgactggtgcaaggatttggcaccacactgggccaaagaaagctaactgagggcctgtactggaacaattgttaaagaaaagttttctctggggctggtaaacttttgtaaggcttgagctgccagagatcatgcctgagggtgaagtcaattcagcggaaagcagagccaaaagattaaatatattgagagacagaggcttgataatattgcttgagtcctggatctagtcatgacagaagaccctccagctaattactagtttaattagttaaccaatacaattcttgcccttttaaaacttaagtctgtttgggttgatatctgataaccagactatatctgataaccagatatctgataaccagaatataaatataaatgtcttatagagcaattgtggagtggcaaaaacaaacatttggagttacaaatccttcaactactcatatgtcttacaattcatttttgtggttaactcattttaatattgtattcccaggtgactactattgtattccaaggcattatatattatctaacaatattttatcttattctgatttagtgatttttctgaaagctggaacataatttttggtaacattctcagttgggaatcagaaacagaggagccatgttggttctatctgagtaattcagttctagaacattcttttaacacaatgctttatttaaaaaatgttttatttccataagtttttggggaacaggtgatattcagttacatgagtaagttctttagtggtgatttatgagattttggtgaacccatctcccaatcagtatacaatgaacccaatttgtggtcttttatccctcactctcttcccaccctttccccctgagtccccaaagtccatcgtattattgttatgtctttgcatcctcatagtttagcccccacttatgaatgagaacatatgatgtttggttttccattcctgagttacttcacttagaataatagtctccaatcccatccaaattgctgtgaatgccattaattcattcctttttatggatgagtagtattccatcatatatatataacattctgtatgcatcaatctcttcaggtgccagtcctgtctaagtgctaggagttattgaaggcacttgcaatcaaaagacctgtgttaggtttctttttttttgagacaaattctcgctctgtcacccaggctggagtgcagtggcatgatctcggctcactgcaaactccacctcccaggttcatgccactctcctgcctcagcctcccaagtagctgggactacaggtgcccgccaccacgcttgcctaattttttgtatttttagaagagatggggtttcaccatgttagccaggatggtctagattccctgacctcatgatccacccgcctcagcctcccaaactgctgggattacaggcgtgaaccaccgtgcctggcctgtgttaggtttcatatttggctgcttacaagccattgaccttgggcaggccacttatccactctgagccttagtttcctctaatgtgaagttgcgaaaagccttgtcctcactgtagtacagaaaggttgtgaagaccagcttgacgaacactttgtaaactctaagaaaccatataaatataagtgattgtccacattattagaggaaccacagaatattacagtttgtacagtgctaaaatggggagaaatgtctcagaaattatttgaacaccaatcaaaaaagtagattttaaccagaaatctttttttttttttttttgagacagaatcttgctctgtcacccaggctggagtgcagtggcatgatcttggctcactgcaacttccgcctcctaggtttaagcgattctcctgtctcagccacctgagcagctaggactacaggcacatgccaccatgcccaggtaatttttgtatttttagtagagatggggtttcaccatattggccaggctggtctcgaactcctgaccttgtaatccacctgactcagcctcccaaggggctgggattacaggcatgagccaccatgtctgggcaccagaaatcttttgatcacagaataaaaatattttttaaataaaaagatgaaagcgttaagactttctaacctgatatgggtgataagttggcctgttttcactgttctccttacacacacacacggggtggggcgttctggctatccagcagtgctctatggaattggcacctttatcattagtgttgatttggtcacattagagttactaacagtagtaatcaatgtgtttggttctcaccatggacccgagggtttagaatgaggccccagtaatttcttgactcagggtgctgaaggcccatttccccttgatctctgggttagggtttgcagccagccaagtttataggacatatattggaatttcaaggaagatggcgagaggaggctttattgtgccatttgaatatagtcatctatttagctactctgatgctcggttccatagagaacataaactctaagatggtgtcatctgaagggaatgagacccttcactttaagcgggataatgacctccaaggcagtgtttctccaagggtggcctttggaccacctgcatcagtatctcctggggtgccttttataagtacggaatactgggccccaccccagacttactgtatcagagtcttctggatggcaccttggggtctgcattttaaacaacacctaatgcagatggtccaggcccccatttacagacactctctcattgcacaggaatgcttgaatctctgtcacagaagctcctcgcaactgcttcattcccttcacagttggtagggtagactctagccacatctatagtaattttagctctgatccttaagaaatgggaattgctactttggtccagcactcctctgagtatatcctttatccctggctagtaggaagtccgtttatagtctaaaatttggttccccaagacagtagtactaataggaaatctcagtcagggagaattttaattgttacacgttataagcaaaaaagtagactctgtgtgtatgtgtagagcaggagatgaattttgaggagactaatgttggatgtcctctcttcatctttgttttttcagacaattttcgttgttttaaatctaatgtattaaatcataattgtgttggaaattgtgtgctgctagctctctacataaacacattccataagatctaacatctgaattgaaagacacaaagattccgtaagtcacttgggtagatatactttctgtttggtggtttccacactgttttccagggagttccctccaaggctgcctgggagcaggggcggggttaggggaatcttctcccttccccagaactctcacgcttctgcaaattgaaccagggtggttctccgggtttcatgtttgcattttgagtttcaaagtaagggtttggtggctaaagagaaactgaaaatcgtttgtacatatgactgaattcaacattgcatgcagctgttgggggccaattgccaccgcttggattgacatcctttccttcagcaacctgagacattttagcttcctctgaattggaccagcactggtggccttgaactttcctcctgcagctctgatggcattggggttgtttcaaagggagtgtgtttttttctttatgatattgataaagtgcttctaaatgtgatcacttaaataggggagaagaaaaaatggaaagaatttaaaaataatgcagtattttctgggtatgccagcaaattgcttttagatattgttgtggtgaataggacaagaattgaaagagaagacctgagttgtcatcctggctcccccattatctttgtgatgatgggactctcacgtcacctctgtgtgtcacagaggttgttaagggagaaatctgattcaggctgaaacagatttttttggggggatggatgtccccaacataccttgacagctctttaaagttaatgagaatcatatgtacatgaaaaatttcacagaattctgaacttattttctcctgcctttctaggaaagatactgagctttagatgagaagtgcccttttatgattctcagaagtgagcacagagcttgctttttagctgctgtgtgactttcatcttctcttattagaaggctcagtgtgaaggctctaaacacctgtgttcccgttgcctgaaaaaatcattctctcccttttggttctccctgtacttactgtacagacatggctttactgatgttttccacatatttcctcttgtttttcctgcagagtttcctctcccaaaataagaggtcatctacttctcctaagtacttcatcatatcaaaagttctcagaaatctgagaatggttgtcaccagccacttctcggagcacatgatctctcctttttcagcaccacccaaggtattgcctgagcttttctcctctctcttcctttttcttttctttgccagacactgggctagggactgtgtatgcgtgtggtggaggaaagagggaaagacacaaaaaagaatcagaaacaaaactggccctgaaacagtgcacagtctatcggggaggccaggcatgctcccaagtgattccaagagagactgctgtgccaagtgcaatgagaagcactgaggggcgagaaccatccatgactaagcactgctttttttttttttttttttttttttttttttttagagtctcactctgtctcccaggctggaatgcagtggcgcaatctcagctcactgcagcctccgcctcctgggttcaagcaattctcctgcctccgcgttccctgtagctgtgattacaggtgcgagccagcatgcctggctagtttttgtatttttagtagagatgggttttcaccatgttgcccaggctgctctcaaactcctgaacccatgtgatccgccctcctcagcttctcaaagtgctgggattacaggcgtcagccactgctcctggacagcactgcctcttgatgtgtcttgtcttcccatttacattgtatgctctttaaagtggataccagttatttttaccttcccagtatccatttctccttctggtaatggcatcctgattttgcatgaaagacaatccagtgggactgtcaatccaagtgccatcccttcttcctgctaaaagttgggagtgaaccaggttagactaaaccaattctccctttatgaaatttgaccctcaaggagagatgcaaggatggaaagtggtcagagccagtctgtctcatgaccacactagcagcactggccatggttccaggacttgtgatggttaatattaggtgtccacttgattggattgaaggatgcctagatggctggtggagtactgtttctgggtgtgtctgtgagggtgttgccagagaagactgacagttgagttggtggcctaggagaggaagacccacacgcagtgtgaatggacaccatccaatcagctgccagtgcagctagaacgaagcaggtggaaggaggtgggataagactgcttgccgagtcttcaggctttcgtctttcttccctgctacatggttccttctgttcctaatgcccttgggcatcagactccaggttctttggcctttatacactgggacttgtaccagtgacttgctgggggctctcaggtctttggcctcagactgaaggctgtactgttggcttcctttgttttgaggctttcggactcagaataagccactatcagcttctttcttccccagcttgcagacagcctattgtgtggctttgccttgtaatcatgtgagccagttctccctaataaatgccctttcttatatacatatatcctattggttctgtctctctggagaaacctaatacaacttggatttctggaactatgctggccctgttcttaacatggatgggtaattcagcctttttcacaattctatgagttaactccaaagccttccatatattcattttttaaaccttaattagcttgagtctacttctgctgtttgcatatgtagaactctaacagattcctttctgggagctaaataccagacctgatagttctccatgtcctctcaatgcactccacacaaagtaggtgctcaataaatactggtcagttaatagtctgaggaaatgtaccacaagctaaaatagcctcaattgcttagccatgggttattttaattatttattttttttggagacggagttttgctcttgttgcccaggctggagtgcaatggcacaatctcagctcactgcaacctccacctccctggttcaagtgattcttctgcctcagcctccctagtagctgagattacaagcatgcaccaccatacccggctaattttttgtactattagtagagacagggtttcaccatgttggccaggctagtcttgaactcctgatctcaggtgatccacccgtctcggcttcccaaagtgctgggattacaggcgtgagccaccgtgctgggcagccgtgggttattctgagggacgggcatcattccaaaatgttctttgcggctaaatcactttaaggttttgttctaccctacaacaatactgaaagcaaagatgacctcttgcttattagagccagagagctgtattttgccttagcggcacagcagagacttaagtagatctatagacagtctagtcttagaagttcagagttggtgaaaccctcaaggtcatttagacctaaaagggagttgctttgtagtcaggtctctgagtataaagcactctaaatattggtagcactctaaatattaatcctagtcaagtaacccagtaagaacctttgtcactcagttccaagttgactcactttgtgaaatctttcagagtatagcataaattagatttctgcaaattgaattatagtttaaatgctctggtggagtctgaaaattaaaaacaggcactggaaaactttgtaaactgaaaaatcctgatgcaaaaaataaacaccctcccctaccaaaaagatggggtctttcaaggacaggtattactatttctggaaaaaaatttaagaaatgctcaagagtaaaggtgttatttatatatgactaatgtattaacatcaatatccgcatctacatttgtatccatatacacagatattccctgcagccttgttaagaatagcccaaattgggaaagtccagaagtctatccaaaagggaaaagtttacagatatgagagccagagctatatatgtaaacattgaaaggtatctaaataacttgtgtggaaaaagcaacttgcagaacaacttgaagaatttggtttgtttcagttaaaaaaaaaaaaaagaagtttaatagaaaaatttatcctagatattaaacatagttatgggacgttggctaagacttttggaagcaccaggcaccaagaagagtagagcactcccacacagataattcaaattcaaacacactaaataataaaatagaggcaaaaagtccaactaaattctgactttactcataatgcctatctcagttcttttcaaaatactacattgttttcagccaaagttaatgtccctatagccctcacttggcatgagcttgctcccttctggaatcctccatccctggcaggagactgggcaggggtgggagtctactctccccgacttatctcacatactactgtattgttcgaattaaaaaattatgagtattcattaattttttaaaatttaaaagtgatataaaaatagagaatagagcacaagggagccctttgggtattggaaatgttctgtatcctcctctgaatggtggttacatggatatatgtaaaaattcattaagctaaatgcatgagctctgtgtatttaagttatacctcagttaaaaagcattcattcattctagcaaatctttaatactgatgtctcttaagagttgaagagttagttacctgcaccaatacaaaaaaccttttcttccatctcttccagacattcttaccgatggcccataaatacctaagggaaaggagaaagaccagagctgcattaatgcttgagtgagtgaattgttgaacacactttgccgtgaagcttggtacttataaacaaggaaacgcacatggctcaggaacggggcgcagattttggagctctgtggttgagcataaacaacagcaagcacttttcacttccacttacaggaggaattgaggcctatcatgagacttagactccttgactgattccagaaagcaccttggaaaatgtgacgctgcaacttaatttgtgtatgtgctaaaagtcttttaggtaggggaactcctgaaagacattgcacaggaaagaaaaaagagggtgctaaatctcacaactcttttgcatcttgtcaagtttcactcaggaaaaccttcccttgttttcttttgctgtattgcaggtgtattacagggaggaatgcaggtacattacagggagcaaattccaagtcaacataggaaggtctccccacttccttcctccttctccaaaagctcttctgttgaaagaaattaatttttttatacagaaaaataaaataaaacggagggttgagaactacagaggcagagctcaaagccgtccggacatgttaagataaatattacttttttttttttttgggacagagtttcactcttgttgcccaggcgggagtgcaatggtgtgatctcagctcaccgcaacctcctcctcctgggttcaagtgattctcctgcctcagcctcccaagtagctggaattacaagcatgcgccaccatgcttggctaattttgtatttttgatagagatggggtttcaccatgttggtcaggctggtctcgaactcccaacctcagttgatccacccgccttggcctcccaaagtgctgggattacaggcgtgagccaccgtgcctggcgtaaggtcaatattactaatcaattcatgtattatcctatctgcattgtggattgttacatattgaactggcaccgatctaggaatccaggcctggcatttttcaggctctatccaactaagaaaggagagatctggtcataccgaaatacattcaaataccgagttctaaaactggctttacctgtctactgtcatcaacacccactggaaaacttccaaatcctcactttacctcaaatcagacagaatttctgctttggaacataatgaagaatgcacctaattaaaatttttcctgcctgacaaatttcaggggcccttaagagtggctggcagccaaaatctattcagatcttcaagccagaaacccaggagtcatcctgggtccttctgtttcctcatccttattcctcagtcgccaagtgcagttgagtttttacctcctggggagttcctcacggctctgtcttccctcttcccacttccactatttcagtccccacccacattttttgcttccatggacaattatagaggaacctcttaattggtttcagggacacgagaatgattttcatcctattcctggaaacgagacagagcttaccacctgcaaatcttatcatgccttttccaagctaaaattccttcagtgcctcccccctacccccaccatttatatgaaaagtgcctcaaactttggcctcttacatttcatcattggtcccacatctgttcacctattctatgatttacttgacatttttctttaaattaacttacttaacatgaataaatctattttgaaaagtaaactatattataggcttgatataccaattatacattatgtagcacatattaaaatacataaatgattacacttgtccctcagtatctacagggaattggttccaggacccctgaagacatcaaaatccacagacaccaaaatccaccacccttacataaagtggtgtagtatttgcatgtaacctaagcacatcctcacatatactttttttttctttctttgagatggagttgcactccgtcacccaggctggagtgcaatggcatgatttcagctcactgcaacctccacctcctgggttcaagcgagtctcctccctcagcctcctgagtagctaggattacagatgtgcaccaccatgtccggctaatttttgtatttttagtagagatggggtttcaccatgttgactaggctggtctcgaactcttgacctcaggtgatctggctgcctcggcctcccaaagtgctgggcttacaggcgtgaggtacctcgcctggcccctcccatatacattaaatcttccctagagtacctataatactttgtacaatgtaaatactatgtaaatagttgctctactgtattattttttattcacattattttttattacggtatttttatttttccttgcttttctccccccacatattttccatccatggtttgttgatttctcagatgtagaacttgtggatggggaaggccaattgtatttgatccatgctcgtctatatatcattaaaaccatcttgtgcactatcagtgccatgaatgcacttgggaaaactttagcctatagggacaaagtccagcatcttgacctagcctaaaaaacttttaattttccatctctgcttacccccttgacttggcttctgcccattgtattatctacattgtgtatctgtaattcctgaccacaccataaaaattcacacctctgtaacttggtacaacctatgctgcctgggatgccttctccctgctcctcatgggaaaactcatattctccctcagtttaaacctttactttgatgtcatcatctcctaggccttgtagataattctgctgttacagttatcacacagctttaatttatttgtggttatatttattgttcctactgaactgtgagtttctggagggaaggaaccctggtcctgctttctaaatacttagcatagaaacatgttcttctttctgaattcctttcagttcctgatagatggtaactggtcaatagacatttgttatagttcagttggttttaagtgccatgctcttgcgagatcagagcgatctttttaaagatttctgatgagattttaaaacactgcataaaaacatgtaatccattgccaagttcttcaagctttccttcccaaatgtatcccatctcattccatccccactgcaactccccagtcaagtcaccatcaacaccacctggaccatgacaggagtccgctaactggcctccctactttccttctcatctctatgctccattcatcccatggtagctagactgacctcttaaatgggtaaatcagatcgccagtatgctgattctaaatatgaatgggaaactatggcagggttttaagaatgcaggaggggtgacaccatcatatttctatttaagaagatctcactggctgctggatagagaatacactgtaggaggaagcggggcaagagagaaagcaaagagattagtgaagagctggtcacaggggctcaggcaagagaggtgatggctggaccaaagctgagccagggagcatcgaccggatgactgataagtttatcaaccttgtgctgctgatgaggccagcacaaacagctctggggttacatagatcatctagctgtcctggtcagtgcttaaaataatatattaatgttttcatgcagtaaatagacataagagggaggttcagccagggctaaggagacagattattggcttgtaacagttaagagtataatcttccagttccagttctaccagttactgtgaaatgttggtcaagatgcttaacctcttggtgctctgtaagacaggtcagtaatggttcctaactcacagggctgttgtgaggattaaacgagacagtgcttgtgaagtataagcatgaggcatgtcaggaagtaggtgtacaataaatgtcagctttattacaaaatctctgtacggacagagaaaatgtatcattttagcagcaaacaataacttaaatatgtgaaaggaaatcttggacttaggtacaaagggaagtagatgacttcaaagatcaaattcaggaagtgggcaagaaattttgtagttgttttagtaatgactagcaagattgtaacagcctcacacttttctggaattatatctggcagctactaaccatttccctttactttgcatccatagaaagagatttgcaaaaacgaatatagctacaatatctattgtgtatataatcataagacatgagaataaaagtagaaaaagaagttcatagaacccatagagtgtaattcatattgaatcattaactatttcttcataataaaaacaatagctactacttagtgaagtgttacaagttttctgtgctgtgccagtcactttatgtgaatttattacactcatctggaagagttaagtgcttaaatctggagatatgttacccagattcatgtgcaaacttgggcaaataaattactagagttatctctacttcagttttctcatctttacaatggggataataataatggtacctacctcaagggttgtgaggattaaagtagaaatataaagtgcttagaacaatagctagcttaaagtaaatacttgctattagatatatcattatatactattattcctattttacagttgagggagctgaggctgagaaagtttaagtaactttcctaggttccacagctgatgaaggacacagccagaaattaaactcaaaacagcctaactctaaagcaccctcttcttcacactcttcctccttccttctagatgacaaactttggtttctttttttgaagtaagaacatgagtcacgattctaattgaacagaggggatttctggttaaaggcttccgaatgggaaagctggtgggatcagagaaaaagtaacaattttcctttggaaagtctgcttgagggaggggctttccctctgaggttttcctcggaatttattgctaatttggcacataccagaaggtgtcaaaaccaagaaaaactgagggctgagatgtactgtttctgtctagtcagctccggctctgcgttttcttgggtggaaacatgctcattaaataggatacacagtacctggagcagatggaagttctgttattgcagacatacaggtggcttccctcctagctcctcacactacaggcagatctatttgtgtgggcattagtggccctgaactctctgttttcaagctgtccgggtatgtggaaatctggatttaccaatagacaaagcagtattctaatgtagtcagtggcagtttagacgagtggttatatctcagactaaaggagaaacacctaagtgggaattctggccctgtcattaactttcctttggcttagctgccctgtgcctcagtttccttagctgtaagatggggataacctaacagttactttatagagttcttgtgagaactcatgggggtgatatgtgtcaagagcttagcacgctcactggcacgtggtaagggctggataagtattattgttattgttgttatgtgtgctactatttgtagtattaaaaatagcagtcctcacggtggctcacacctgtactcctagcactttgggaggctgaggtgcacagatcagttgaggttagaagattgagaccagcctggccaacatggtgaagacccatttctactgaaaaaaaaaaaattagctgggcatggtggtatgcatctgtagtcccagctactcgggaggctgaggtacgagaatcagttgaacctggaaacggaggttgcagtgagctgagatcacaccactgcacttcagcctgggtgacagagcaagactctgtctaaaaaaaaaaaaaaaaaaaaaaaaaaaaagcagtcctagtagaaagagtaaataattttgggtgcacatctgttgggaaggaaagtgaggtacacatgtctgggtttggagctccaggccatattttgtatcatgatttgaatgtatcctctcttatgatatttttgtaaaattcttgctactgggtcactgacatctctgttattcactggggacgttttagttatatgagagaccagagtgagcgagctacaaaggattaaaaaaagaagaggaagattcatctgtgttcaactttagttccaggaatcccccaaaattgctgaatcctggaagacccctctggcctcagtgtccctctgctctgggactacttggtagggtagcacccatggcaatgcttgtaacttttcatttgaataaaaaaatgaggcagtcttctctcatatggtatttgtgaatttaacgtgaattagtaacatggctctttttattaaatatctactcttggaattttcaagtatacaatgtattgttattaatcatagtcaccatattgcacaataggtctcttgaacttattcctccttgtcagaaattcttcataaaaatttcttataagaacagaagttgcagtgagacaagaaccatgattcctacagggatgcttttgtcctcttcttgggtgtcaaggagaagatggagagcagggagactccaggtacctcagctatcttatagcagcccagcaagaagaagcatgggctggaaaaaagtacaaagaataaatgaaagcaaataacaatgatgattacaaccaacacgactaacaacaataactcttctatagctgtagctattaaccatgtatgagaccttgttctaaatactgcacatgtattagctcacttagtcctcacaacaaccctacaagacaaacactgttgttatttctgctttacgttgagcaaaatgaagtccagaggggttaagaaacttgcctacagctagtaagtggttgtggcaggaattgcattctaggcgatttgatctaattggcatttagggataacaatacaataaagaagacaaagtagaatcacaaagatattcagctaattccaaagaaagcagaaaaataggaaaaaggtaacaaagatcagataggacaaacagaaaataaaaagcaaggatgacaaacaacaaaataagtttaaacctatcaataataacattaaatgcaaataggctaaatatctcaactaaaaggcaaggatcttcaaatttgagttaaaaagttagacctcactctatgctgcctataagaaatgcactttttaaagacacgaataggttaaaaataaaaagatagaaaaaaaaagatttaccatgctaacactttttttttttttttttacaaaaaaggctggaggggctatatcactgtcacacaaagtaaattgcaggtgaagaatactgctggggatcaagaagattatttcataatgtaaaaggagtaagtcaatcaagaagacataacagccgggtgtggtggctcacgcctgtaatcccagcactttgggaggctgaggcaggcagatcatgaggtcaggagatcgagacaattctggctagcacggtgaaaccctgtctgtactaaaaatacaaaaaattagctgggcatggtggcgggcacctgtagtcccagctgcttgggaggctgaggcaggagaatggagtgaacccgggaggcggagcttgcagtgagccgagatcatgccactgcactccagcctgggtgacagagcaagactccgtctcaaaaaaataaaaaaaaaaaaaagacttaacaatcttaaatgcttctgcatctaataacaaagcttcagaatatatgaagcaaaaccagacagaactacaaggagaaacaaatttaaaattctagtaagagcttgagagcttcctctaaataaatgaaaatcagtaaggatatagattctttgaacaacactataaactgacttgatctaattgacgtttattgataagaagtcaacaagggagataaaatgaaacactaaagatatttgattagtctagtccagtaccctggtttcagagtctgtaccaaaaagcatggtgtcttggagacctatgaggaggagagaagtgtgatgattttgaagaaaaagaggtctagaacagtggtacagctacagaaatggaaggggaaaagagattttaagaagatagccaagtgttacaaactgtattccttttgaagtttgttaaatataaaaggaaaatcagaattgctgcaaattactcccggttggtggactgtggttcattgaatgaattaaatgtggagtcatgaggagctctctattttagtcaagcttcaggtcctcagttaaggttggatcgaaagcaataactgtggaccgagctctaatgcttactctgacttgggcaagtcttttaaccactttaagctccaatttctctaagtgtaaatgggggttcatttattcacttattcatctaaacaataaataattcactggacttttgctacatgtcagtctctgtatgaaggtcctatgaaaaaaggaaacaaatttcccttctgacaaggaactcacagtctagtggggaagacagacaacaaactaataaataaagaagtatatgatatacatgataagagctctggtgaaaacaaaacagagtaagagagagagggaggacacagcggggccaggtaaggctttctgataaggtatagaaatgttggagatctgggtgaaagggaaaggaaacagccaggacaagggtcttgagatgggggtgtactttgtgcctaggaggaaaagcaaggaggccagtgtggctggaacagtgatcaagaccaggtacgtagggtcttgtagtcatggtaacaacactggcttttactctgaatgagatggggaatcattggaggttttcctgcattcgagtggcaggatctgacttgtgttttttaaaaaaaattgcttcacagtaggaaataggctactgggaggcaggggcagaagcagggtactgcttacgaggcaggagcagcaagtgaaggggagcagcaatggaggcttggaagccaatggtgagatggaagcaggggtgaaaggttgaattctagatttatcttgaagatggagtgaaaagaatttgatgacggccaggtttggtggctcatgcctgtaatcccagccctttgagaggctgaggtgggaggactgcctgaggctaagagttcgagaccaaaggactataaatcatgctgccataaagacacatgcacacgtatgtttactgtggcactattcacaatagcaaagacttggaaccaacccaaatgtccaacaatgatagactggattaagaaaatgtggcacatatacaccatggaatactatgcagccataaaaaaggatgagctcatgtcctttgtagggacatggatgaaactggaaatcatcattctcagtaaactatcgcaaggacaaaaaaccaaacaccacatgttctcactcatagatcggaattgaacaataagaacacatggacacaggaaagggaacatcacactctggggactgttgtggggtcgggggagtggggagggatagcattaggagatatacctaatgctaaatgacgagttaatggtgcagcacaccagcatggcacatgtatacatatgtaactaacctgcacattgtgcacatgtaccataaaacttaaagtataataaaaaaaaataaaaaaaaaaagaaagaggcaagaaaaaaaccactgactgtatatgagagaaatccaataagattaactgctaatatctcatcaggaacaatgaaggccataaggcagtgggaagacatattacaaatgctaaagactaagggtaagagaatgtgtgccttgcttaaagtaatgaatctataaaagattagaaatagaaattaagcctaagttttatttctctaaatcagttagtttagtagtattcaatggatctctgacctaaatagacataaaatttccctgatgttcttatttaaaatgcagatatttggactacaaccttagaaaatcttatgctggatttggcatgggtttcaagaatctgcatttgaatgtgctttagaagtaattttatgtgggtcatttgaattacagtccaatagcacaaagaggtacagtaaagagtgatcatggagctagagagataagcactggaatcctcattcatcactatctgcctatttaactggtgtaaagaagaagtttcttgcatttctagttgttatagttagtaaaaatggtaactctaatatcttgtagagctgttgtaagaattaaataatatatatgaagctaaccgccaaatctgataggcatttgttttcctctcattcctactttcttgctcattctgctggcattcccattttctgatgctaccttcccctaaaaccataattattttcatctcaaattgtaacttatttttcttctattatgtcttttcacaagaaaaaaataaattttaactgaaattgtctgtttggataattaaaataaggacattaaattttgaacctggttagaaaattaaaaaaaaaaaaaaaaaaggagttcgagaccagccaagacaacatagtgagatcccacctctacaaatttttttaaaaaaacttagctgggcgtggtggtacatggctgtagtcccagctacttgggaggctgaggtgggaggactgcctgagcccaagaggtcaaggctgcagtaagctatgatagcacctttgcactccagtctgggtcacagagcaagaccctgtctcaaaaagaaaaacaaaaattgatggtggatgagaaagaaaaatgtcaaggattacttcaaggtttttggtctgggtatctgggtgtcgggggggcatttattaagatgggagaatgataatacctaatccttgtgaggtggtttcagtgataaaatgagagaatggatgtgaatgcacttcctgaacttgaaaacaccatgcagatataaaagatgaaaattagaaaggcatctaggagttgctgattctcaaatatgcccagatactaacattttaaggtcaagaagcagtgttgatttttcccattgacacatttctattcaataaagttattctgaatggcccagtggctcattcaaagaaccacagtgcacaccaatattcataattcccagtgattcttatgttccttttatgttagaaaaaaccttaacatgggaacaatttataacctcagctatgcttcttaaaaattgctttttcggcagggcgcggtggctcatgcctgtaatcccagagctttgggaagccaaggcaggcagattgcttgagtccaggagtttgagaccagcctggccaacctggcaaaacctcatctctaccaaaagcacaaaaattagctgggtgtggtggtgcacacctgtggtcccagctacttgggaagctgaggtgggaggatggcttgagcctgggaggcagaggctgcagtgagcagagatcacaccgctgcactccagcctgagtgacagagccccaccccatctcaaaaaaatttttcttttcctttttttctcccattttccaagctgtgacattgctctcatatttctaccctcctttacacaactgggctcagtaaaactattttaagtttaaatggaaaaaaaatgtactccataaacatttttattttctctgaatagtcccttaggcaactaaggttgctcatccctgatttaggccacgttgggtccgatggtgttattaaggcactcaccgttcacttttcagagctattttaagctctcttggtgtatctcctggcaggggtaattttaaaatggaagtccagcaatatgaaatagctatgaaacctgtcagaagtgagctacatatttcttctgtcatctgtagggtcaaggtagcctgaaatatgttaataattttacaaacaagtcaacacaaaaattccccaatccaaatcaggtagttcagtttctagcagagtgaatgaagagaatgtgggaaatgggcattcatccaatagggaaaataatacctgtgtcaagtggttgctgtggagagtaagtgacacaataaaactcctagtacagtgcttcagagagaactcgaatgtaggttgaggcactgatcatttttttaaaggaagtttaaaaaaagcactttagaggacagatacattcattcatattctgttctttattttctctctttgatctgccctaccctctttgtctctctctctctctctctctctctctctctctttctacgtctgttctgctcactcatgtgctggttcctttagcaaatatttatggagtatttatgaggcaggattttgctaaagatgaagatcttctcttgtgtactacagaaacctaactgaattatcaactcctttgtcttgaaagtaggatgttcatcacagagggggaagacatattagggagaaattccacgaatattgtcagaatatataccaggagcatgataagaaggaagaacggtagacctcagcaatgtttcacggcattctaatttaatcgaagaaaacctggttgtacttcatcctggacacttgacaaaggactgagtgtgtccttagggccctgcacatgctcctgtggctttttcacaccccaggcagaagagctttgccataatcccagctcaggcttggcataatttggcctcaagacaatgcaaagcaaattctctaaatccaaaccaaaccttgggttgagtcactggtctccagctcacaggtgacctttgcttcctctggaacccttcatacctgaacctctctggtgccctgactggtaggtctttgtttttctctggaaccttgggctttttttgcttcctagaactctgaggcaccatggctaggctcctgttctttactatctgactgcatgctgctgtggtctgctcatctactgggaagttcaattcctgtcctggtcacgccctcctggacttcatgtgggcttctgtttagacctgtcttaatcacggctaggccctgaaattgggtttgtgaattccccaaacctctagtacatctacccaatcctctttttttttttttttttgagatggagtctcattctgttgcccaggctggagtgcagtggtgcaatcttggctcacagcaacctctgcctcctgagttcaagtgattctccagcctcagcctcctgaatagctaggattacaggtgcccaccaccatgcccagctaatttttttgtatttttagtagagatggagtttcatcatgttggtcaggctggtctcaaactcctgacctcaggtgatcctcccgtctcggcctcccaaagtgctgggattacaggcatgagccactgtgcccagccgtaaccctcatttttaatggcacttttagtactttgagctttatcatcaatatacatatacccaaaaaagaattaacgagacctctctagggcccagaggggctaagcagaatgatagccagttggcagcgtacctgcagaatacccgccaaacactccattcccttctactaaactttcccttttcagagttacacgattatcatgttttctgagataatgacatccatgtgatttagtttaataggtcatggctcagcatatactcagtcaccaacaaacatttgctagaaaaatcactggtcttatttggcatcttacctattctttttgctttacttgaaattaattggtcatttttctcaaaccttaagaaaatgaagatgatcacaaattttctatttttttctcattcatttaaatgctgcactaaatactaaaatatattaaatgtgagttgattgaaggtggcctctccctgctgctcacacctcaaagatgtgggttgctgattgaggtgcaagtgagtcatatgcagagtttgaatgatctggatgcctccgacaaggtacgcggagcctgtaagacctctccaaactagaatcacctagcatgctgctaggaaagttttgaattgtcctagaaaccgtattagagaaagagaaggacatttttctattttgacagcaaaaatgcaaatacagtcatcctaagaattgaggaagtttacagtaaatatcaaagtcgaatattttaatatgaattctttatatttccttctacatagttctctgaagatcttgtgtttatttttgttttcattttgagaaatgaacagacgtgtgtccaaaactgctagttggggaagaaacacttacccagaatgcttcatgttttgaggcttatccattcggacagcaagtttgattttgagatcttggtcggggcagtttttggagactgtcattttgtgccactctgactgtttggggctgttcggggtgggatggagaataacctgtaggggaaaaaggacaagcaactagaaaagagaagcaccattatgtttttatagattagaaactttgattctgagtagtggagtgacttgaacaattcccactgtggagcagccatacctggggatagaaacacattcttttgatccttcctggctaattttgtaaaagtaaagatttctgtaattctgtgatgattctgtcatgaaaatcatgatctctgtgattctgctttgacttttctaatgttcagacgtactaaacaaacccagaatggagaatattgtccacacattattctctacatctttgtataagaagatggatgcataaaaggaagaaatatgcttatatattagacagtccttttagtccactctttttctccattctttaggatttctttcacttttcaagaggagaaattcctcaaggcccccaggggaaaatggaaggaaccttattagatggatgagaaatgtgagactcagggaaggaaagggacttgattggagtcacacatttcaacctgatttcacctggcctggaaatcttatcacacaacatccaactttgcccgggcatggaggaaagcacacatgacttgaagaaggaccatttcttaggaaatgcctttcatcagtgtgcttcagagatggcagtttgatttgggtcttctgcatccattcttattgtctggaattctgagagtgaaacaggaagtgagtaactcactaaatccacttttcgctttgtgatcacggagttctcaggagacacatgggatctggggaatatgcatttagggaggaattgaatatttggaaaatccttgaaactaagggaacatgaactaaatataggcacaacaaaagctgggcttgctaagatttgcttctgtgatggcagcacgccctggtttgtggcacattgttttggctgttttcaaagtatttattttctctaggtgcaaggatggcaggcccctttcctgggcttctttcacctctggaggtggccgtgaggggctcatggtcttatgggtggacactctggccttctagatgctgtatcagcttcactagtcatgcaagcttggcccatgcttgaagggcagacacatatggctccctgtgtgattgtgaaacaagactgctgagaggaggaggaggaggccatggcagaaaaaaaaatcagcccacttagatgtgcttcatttatgccgatttctcagcccttctctttctgggcctgaccctttttcttcattaagttccctgtctctgatgaaatatacattcttgctaaccacaaatttcaagtcttcccactgtcttatgacatgattgaaatacagaaaagcctgatttttcagaacagaggctgtcaatgttttttgatcatgccctactttagtacaatgttgttgagcaattagcccagtatctgtatactaacattttatattacataagtttactttgtattaatatattaccttatcacatatatcataaaatatacaaaaatcaaagatgggctaaagatttaaaaatctacattttggaataacttgctaattgtggtggctgtggtgttattagctatctttaaggtaccacatatatttagggcaaggtacattgttgatgacattggttataaatctgtagtttgagttgtcttctcaataatttcgtcatgtcttgactgacatcttgtcccatctgattacattggcattgtttttatctcatgatatgagtgacagagtgtttgccagtaggtcaggtgttggctccaccattttcttgtttgccaggcttgcattgctagtactacctccaaatcagagcttttgtgcagttatcttctgaggtcgcttattttgtaaaggttgatttagttaaagctccagcataaaatgtataaattcacttaactggcaccagagaactgcaacatatcataggacagatgctgggaggaaatgagtgagatagggcactgctgggttgtggagacctctcccttttctccaggaactgcctgttcttacacgtcaccctgtatcatgtaccacatcccgaggcctgacactttgtgggagctgctgatttcagtgaagctgaccctccatcctgagctggtctggcctgagagaggtaggggtgagatgtgctgggaagccagaaagggaggtgctggtaagagacaccccatccagggccagaaccgcggtaagtaagaaaggccctgggcttctgtctgctcctgcctgtttggcaaaatcacagagggagcagtgctctgggcacccgcagctcattaacaggcctttcgccatatggattctgggcgtgcttcccactggcaatatggtgtccattcgtgacgcaatagccgcagctcattaccggctatgccacaaagactttgtcccctgtgcaactgcttgctggggagccctcttttccagggtggatggagagatgaagtgaccacagctctcttctgtctttgcccccaccctgccatgcctctgacaggctgatgactcatttgtatgtgtcagcactgctgaattatgagggtccttctgggtgcacatgaatcccaagcagaccagacacctcatctggacattccaggctgctaatcaagcactttgtcaattcagccgaggaccatgtgtgctgcactttgatgtggggatgctgatgtggccgccacgacccaccccctgaagtagctgcactccagccagccgtggcttctcctagttgcctgggcacacaggcagggcctgctagggggctgctttaccctcagcctttacctgacagatcccctcctcgacttagcctatatctcttcagtacctcttgcataccccaggaaagaatccctgtccctgagactgtatgactggattctgccttcttgctaggtgcttcatttccaggtctttcttttttttttttttttcctagcagaacacttcccacattgcactataatttctgtttttatgtctgtgtcccttatgctttgtgaggttaagggttttttaccagtcattattcctatttgctctgtgcacaggacaaatgattggacacagagggcctacaatcctataatattgcagggttgggaaggatgcaggaaaacaggcattctcttatgccttttgtggaaggatcaattggtgcatgcactttaggggacaatttggcagtagctgtcaaatttcaaatttcagtcagcaaaatattttttgaaaatttattctatagatacccacacatatacaaataaataaattcaaggctattcactgaagcattgtttatatagccaaagatgaaataatctaaaaattcatccatagaggatttgttaaataaaatatatctacataatggaatacaatgtagctatgtaaaaaggagacaggtcagtctagggtcatatgaaaactaatcaccaaatataatgatttcaggcaccatgtagagaagtgtgtatatagtagcttccaactgtgctttttttaaaagagggggaatatatacatatgtgcttatatacgctatgttggtacatgcagagactatctggggaaggataccataaattgaaaacaaaatctttctctgggaagggatacgagggtgagatagaagagaaaaattaattttcactatatatcaattttaacttgttttcacaatgtgcatgaatttttttttaattaaaaaggttattaaaaacaaaacataaccctaaagaaacaaaccaaaaagtggttgaataagtaaatgtaacgccaggattctaaacacaggtctgctaagtgtgggaagaattcgagcatagaaacactctctcgtgaggtccaagtgtggcttcactgcactcttaggtcacccagctgctgcccatgaagatgctgccagcagagggtgtccagccagcacaagagccaggcaggccagctccgctgcaattggcagaaagtttctttggcacaaaggaggggtaaactagcatctgggggaatgtatgaggggcctgaagaagagaatgaaccattatgaaatgagtgtgtgtggggctgtggcaagcccatggtcttcaccaccacagcacagcccagggttttatttttgtgtagggacaacacagtgtagtgcaaatagccctggagatgaggcaacatgattcctgaagtaactgaaccctctgggcgtcagcatgctcttctgtacaagagaggtgatgactgtggctgcctcagtagggttgtcttgagagagcactgaggggctgtgcacaaagtctttgggacagtggcctggcccatgcatgggtccctgactggcttgatcgctctggagaggtctcccgctttccatgggagcaagttttctcatctataaaacaaaggatttcaatatgtcagtggccttaacttttctgagtagaaatggctttgagaagtcagtgaatgctttggtagccagtccagaaaaatgcatataggcccaggcacaaacacatctgtaaactatttccaggctgggtgcagtagctcatgcctctaatcctagcactttgggaggccgaggcgggcggatcacttcaggttagcagttcagaccagcctgaccaacatggtaaaaccctgtctctactaaaaatacaaaaattagccagatgtggtggtaggcacctgtaataccagctacttgggaggctgaggcatgagaatcacatgaacctgggaggtggaggttgcagcaagccgagatcacgccactgtactccagcttgggcaacagagagagactccagctaaagaaaaaaaaaaaaaaattccagggcatcctggatcctgggtcttcggaggctcattgtggacccaggttgagcatcctgcgctggtcagttacacttgttccttctaacactaatattcaggatctctgagactcgtgattcttaacatctgccttactggaaaaggagaaatttgaagaaaaatgaaaggcaggataattcttccactctatgtgtgtctctctttccctagggacagaaatgagtatcgtttctcaaagaaaacagctaaaccttttattttctttcatcatcccctttcctcccacttttctgggtagggacactgtttttttgtttttgctgttagctttatttacttttcgttttatctccatctgtagtctatgctgcagtaatatgactccaggttgattctatagatgaaagccagattggaaaaatgggtgaaagaaaggaagaaaaaaaggaagcacaggagatgaattcttgctggcatcgttaggtgtgtgtgcctgtgtgcttgtctggggtggtctctcattatgctatagatgttatatcagaggctcagagagattctctgggctgagatcacgtagctttcaggagtgattacacattaaaccagaatgaaataaaatttatatttatttatttattttattattattatttttgagatggagtttcactcctgttgcccaggctagagtgcaatggagcgatcttggctcattgcaacttctgcctcccgggttcaagtgattctcctgcctcagcctcctgagtagctaggattacaggtgcctgccaccacgcccggctaatttttttggtatttttagtagagatggggtttcaccatgttggccaggctggtctcgaactcctgacctcaggcgatccacccgcctcggcctcctaatgtgctggggttacaggcgtgagccaccgcgcctggctgaaataaaatttattgaaagtctatgtgctgggctctgggtataaggtagtgaacaaaatagtttaggtttctgtctccgtggagattttacagtccagtggggcagacagaagcctgaatgtctgtcaattctgtttctttctctcattggtgatcactttagtagtatatgtgaacaaggagctaagatagcaaatgaaggggactgagctgtcaggaaaggactctccaaggaggtggcatttatgcagagaatgcatttatgctttttgaagggttgggaggtggggaaatgacaacagatagaaagtcccctgaggagggagagaatttggtttatatgagggattgaaatttggccaatgatgctggggtatagtaggcggggaggaatgtggcagcagatgggggtgaagaggtgagcagaagccaaattaaacgagttcagattttaccacaagcaggtggggttattggcaaaatcaacttgtgaaaatattactggcttcttggtgcagagtcaatggttcagatgcaaacagaaatttcactattatctctgtggtttttaagggggttggtaccacctctcagggatgtctcagaaattttcatgatgttttgattgacaaaataattggtgccagtccctgttggcactgagtgggtgggtccagggatgctaaacatcctgcaaggaatgacatgatgctccttagtgaggcatcttcctgcatcccatctgacttttgaatattcccatgggatattggtggaggtgaaaaaatctgtttataatgaactacgtggagatcttaactcttgtcttacatttcaaatcaaagtctttttggcacatttctaaggaaatcaaggaaactttacaagtattgcttaatatgtcagtaaatcggtttactgatcctcaggcttaggagtcaccactacagcatacatccacaccccacagtggattttgtagctgtcaccttcacagtgactcttcatatgggagcaagcaaagcactcctctattagatctttgagtatgtacattttgaagttttttattattaatttacttccttttgtttctctcttatgtcattgtgttgactttaacattgtcaggtgggcaggcagttaaatcatctaagaactccactttaagacagtaaaagacattacaaatcttaactctaaaggatgtttgggtctgatagtattgagaactcctgctctatctcctgtagggcacactcttgttagtccagctttgtagaagagaatctgaggctcagagaggttgaggaacttgcttaaggtcacccagccaatgtagagtggagtccaggacttaatgttcaaaactgagcctctcagcacttggcaatgctgcctcttggtgacctgtgcactggagacctagctggggaaatcctctctgtggagttccccttgtgataagaagtgcttacccgcccaagctccttgtcctccaacgccaggacgcctgtgctctctgtgaacagcttcaccttcacagctggcagtgcatgggttgtggagaagtcaccctgggtgccccagctgcagacagaatcaaagaggtcattgtagacatatctgccttgatgagtctaaactattccattgttcccaggtcaggtgaatgcagggttaacccaaggcagcattagctgtcacatcctcttctcctccccttcaaagctgccagagtaacaaacgtgttaattaacttgttaggcaaatgaaagacagatgctcagaaagttgccatggtcttcacagagcactataaggaatgacttgaaattagcataaactcatgttggtgagaacttgttcccatgcatttgctgtatctacaaacgattccagggaaatcactaatatttcattgcatcctttgacttcctcattcatggaaactgcagttgtacatcttgggatggggcttcatttggttcaagccaacacctgactttcaaatgagacttcaacaatagtggtggggaggtggggagccccattttcactggcattcaaagatgagttgaataaggagattatggagctccaccctgttaaggtcaaagagagattggaagggagaaggatgaggatgtgggaaatgccattccctgctcatagtttgtggatatcggagtctcagttttccacacacgggagcctggcttacccaaaatctgggtagagcaccaggtgcggctcacatgagcccttgatgtgcccttcaaatgcagcctcttcattcactcattattattcttacagagaattcatctctatccattctgtgcctgcaagcagagtgatcttccagaagtgttaactggattgcactgagccccaggtccagggcacctgttccattgcactcagggggcaatctggacccctacctatggactgccactcatctgctccaatctcacaagcctcctgactctgccatctcagacctgttacatgtatgtttcctctgttggcaatgtttctccccacccattcactgggctatgtcttttggggctcagcttaaaaccactgtcctttgatctcccaatctaaactgggttctggtattaacctctctttagcatactatttaattttgcatcttagcaatcactggatttaagttattgatttgtgtcattgttttatagcagaatcccctaatattctgtaagctccatgagcacagggactgtgtttttatgttgcatacccagaacttagcacagtgctagacatatagaaggaacttaacaaatatttgttgaataaatgaaagatgccaaatataatgtcttttacagcactagaaaacagcatagatacaatttcatttagagaactttttcattttactttatacaatgaccaacttccatactttaaaatgctcattatgattttttttattttttttatttattttttttattttttttatttatttatttattttttgagacagagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacgcggtttcaccgttttagccgggatggtctcgatctcctgacctcgtgatccgcccgcctcggcctcccaaagtgctgggattacaggcgtgagccaccgcgcccggccctcattatgatttttaatgattctataatattacactttctatatgtaccataatttatttagccattgttctattattgaaatagaattgaacattaattttgttttgttttgttttttgaggtgggggtctgactctgttgtccaagctggtctcaaactcccgggctcaagcaatccttccacctcagtctcctgagtagctaggagttagatattaatttttgatttcatctctgattgtttccttgggatagagacctagctgggagatcacttcttccatcaacaaaaatttagagatcttacactgttgcaggagctgtgttcctcaatgcacactttcaaggcttgagatgcctattcccaaaatgctttccacaaaggcagtgactatcctgccaccatttgggaacgagagttcaaatcacagggcttccttcttgcctgttctgagtatcactattcactttttcttctggcctattttatcattgttgttttcatggatattttcttgactactagtgggcttgaacattttaccctgtttgttggctgcttgcattcttcttttgtaaattatggaaacctgcatcctagtctcagtgttgccttcaatcaaataaatcctattaactcaaagacacagggaatctagtgagagttgacaaaagaagaccagaaaaattgagatgaggggaaaccagatccatggggatctcagtgcatgaaaccactgagaaagcacaacagtcatagtagagacagagaggacatggaggaggccatgagataggacaaaaagtgacaggtttcaaacacattagcaaaacgtttgaggtacagatagaagctcctaagtggttgtcagcaactgcagcaagaccccgagatagggaaatctttgtcttagcaatggcaagggttttgaaccagatatctttagttcaaattctggcttagtcacttgcaaactatgaaatttggggcaaggaattaatgtccctgtcaatttcctcagctataaaataagctaatttcacagactagttgtaaagaacaaacagctgcaagtttggaacaggttgagaacccaacaaattttggctactttcccttcccaaggtaaggagatgtattctagtaatagtgattattgcttatctatttatatttatttatttaatgattagatgacatgtaataattgtacatatttatagctatgatggttaatactgagtgtcaacttgattggattgaaggatacaaagtactaatcctgggtgtgtttgtgtgggtgttgccaaaagagattaacatttgagtcagtgggctggcaaaggcagatccacccttaatctggtggacacaatctaagcagcttccagcgaatataaagcaggcagaaaaacgtgaagaggagagactggcttagccttccagcagcctatatctttctcccatgctggatgcttcttgccctcaaacattggactccaagttctttagttttgggactcagactggctcttcttgctcctcagcttgcagacagcctattgtgggaccttgtgatggtgtaagttaatacttaattaactcccgtttttatatatatgtatacacacacacacacacacacacacacacacacacacacacacacacacacacacatatcctattagttttgtccctctggagaaccctaatacaatggggtacagagtgctatttttttttttttttgacagagtgtcgttctgttgcccaggctggagtgcagtggcatgatcttggctcactgcaacctctgcctcccgggtacaagtgattctcctgcctcagcctcccaagtagctgggattacaggtgcccgccaccgtgcccagctaatttttttgtatttttagtagagacggggtttcaccatgttagccaggctggttgcgaactcctgacctcaagtgatccacccaccttggcctcccaaagtgctaggattacaggcatgagccaccacacctggcccagagtgctattttgctacatgtatacaatgtgtaataatcaagtcagagtaattagcatatccatcacctcaaatatttatcattttttgtatgtgttggaaacattcaaaatcctctctagctatttgaaaatatgctattaattattgttaactatattcaccctgtagtactagagaacactagaaatcagtccccttatcttgctgtacttttgtatcctttgtggcttctacccaacacatatttatcaagcacttactaagtaactgaccctgtgtaaaggaagcaagattgacactgccctttctactacacagatgaatggtaaaatagctattatcattgccatttcacagatgagaaaactgaagagacactcaaagatcttgcctattttattccagggaattatgaccaagctggaccagaacccaaaatctcattttaaagctgttgctgttattattgtaaaaattatcagtaataagcattattagtgattagcaacactggaaaaaatgtgaccattaatttacttatgattaattgtactattaatctctttgcatggctgggtgtggtgcctcactcctgtaatcctagtgcttttggaggccaggaatttgagagtagcctgggcaacatagaaagacccaggctttttattttttctacaaaaaacaaagtaaaataattagctgcatatggtggtgcatgcctgaagtcctagctacttgggaggccaaggcctaaagatcactttgagcccaggactttgaggttactgtgagctatgatcacgccactgtactccagcttgggtgacagagcgagaccttgtctctaaaagaaaataaataaaaataaaataaaagatacctctttgggcattcattatacttggtcatggggaagagaaagatttctgctggaaaccaaaagagttctgaaatgagaagctttaacactaagccacaaagagaacttgagcccagtgtcctggagataccccactgtatgtttccatgctactgtcctcagtgtggatggatttcttggcatgttcagtgggtaccaacccaggatgcctgaacccctgctgctacccaaagatgctcagctcataaggcgtgtaacaagagtctgactgtggggcagtcagtgcttccgagaacccatcagctggacggaattcaggccgctggaggctgccctgacaacccccatcctattggacacagagtttcttttcccttccaccaggcctgcagctgtgcttcccaccatgacccttggctcacctcaagctgtcaggtcactaatgaatcccagtttaactatttaactatcagatttcaaaatggtaacctggtccagtgaagcaggccaaaagagaagttctctcatctaatcaggactggctgtgcaattttcagggcccagtgcaaataaaaaatgcagatctccttgttaaaaaaacagcaaactccaaaactccaaaacaaaacacacacaaaaagtgccattcaaggtactaaaatataaagcattttcattttcttgagtatttcctctcctcaaatccacagtccatcgttccatgggatgtcacaaacacaagctcgaagataaaattattaagaatttcgagatggcaacaaaagagcattaaatcaaatgggggccccttctgaatgtagaagatgtgcagctatacaggtcacatgcccctcaagctggctctgatccaatgtcaccccagtctggttagcctggactgagaagtggatgttggctgacactggctgttgacatgaaacttttggtcttagccacagtcattggattctgtgggaattctggcctttttttgtcaatgcttcctactcttagtagaatcaagaaggtttaaatatttgcacccttccttatcttcctttcctctgtaggaaaaaatgtcatgaaaaatattcattctttgtccttttgtagccacggagagatctggctatatttgtaatagaaatagctaatagttattcagattactatgtgctaggcacaaattcctatctcaaaagtgggacacagccatacatgcatttgatcatttgaaagcctcttggacatcctgtgaaatgcctacaattatcacctccagagttataaatgagtcacagagaggctgggtaatatgttcagggtcacacacaaggagtaaatggcagttagtgacctcagaattcaaactcctaatcaggccaccatgttgcctcccttgctcattccatcattcactgctttatgtcttgattaaatcaacatgagttacctctgtaactgaaaagggaagttctgtttcaagactggtgggacgttgggccactctggctttttactttgaatttatttcacgtgttcaatatacttcacagagcactatatcccagacagacaaattagccagtggaggaagcatcaaaaaccttggccttttggtggggccacacacccaaaaatgaatctattttgttctctgctcatttctttgcccttgctgtgcaactgattgtggctattaagatgaatacctctttaaagtgtcccagaactgaaatacaattgcattttgatttgaaaagaccagaggtggataatatttattgcaagcagaagttggaaaggttaactgactaacttctctctgaagatgaagtagataatgtaaaatgggttaggtgtccctattctgtgatcccatcctttcctccactgtactcacactgtatgactagcttacataaacgttaaaaatagccaccaattattgagtacttatgatttgccaggccctgggcttagtgcttctaatgaattatctcaattaatatttctgacaaatcacagaattgggcttcaaactcagagtttctgacctcaaagcccatgcattaaatgagagtgctttactgtggtttcttttattatatatatattttatatatattatatatatattacatatatattatatatattatatataatataaattatataattatataaattatacaaattatataaatatattatatatttattatattatatataatatataatataataaatataatatataatatataatataatatatattatatatacaatattatataatattataatatatatattatataatatataatatatatagtatatataatatatataatctattatatatattgtatatataatatatatattatatataatatatataatatataataaataatatattatatattatatatataatatattatatatatataatatatataatatataataatatataatatatatatattatatataccatattatatataatatacaatatattatatatataatatatataatgtacgatatataatgatatacatggcacccaacacagggcctggaacacagtaaatatttgcttagtaactaggaaagcaacaaattcagaataaccatgtcactaaattcaggggattgtagagaggtgagacacatgaaataaccaaaggtgtgactgcccctttcaactgagggcttttatctctttgaggagttgatttctttcttttttttttttttgagcagacaaactctctgaagtgcacacagcagctggcagcatgcagaggatactcagcatgcaacagctctcttgggagcaaggcgtcaatccatgaaggctgaggaatggctctccaagggctggcagcaatgtggctgccaacggtatagtgatggaaagtgccaccaagctatataataagctgctattattacttttggtcttttcagccacaagcacataagcagagactgtagaaatgccatcacccatagaggcacctccaaagatgaaggaatgtgtattgggacatgtgtgtctattccaaaccaaatacttcctgtaagagggtggcaaataaatagatgaacagtgtaactgactaatctaaaagcgccatattggcatcagatgaggctctaactttcactgcttagggattctatctccaaatagtgctccatttaggaaacacttcctgaatgtctactgtgtgcaaatcactatgataggcactgctatggatccaaaggtgagtgagatgtaagttttgcccccatggatattacattattttgggggagatgccccgtgcagaaataacacttataacgtgtgagagtgtctcagctttcacatctataaattggggataagaatatttagttttattataaatatagccagatgggaatagtggtctgcacctgtagtcccagctactcaggaggttgaggtgggtggattgcttgagctcaggagtatgaggccagcctgggcaacatagtgatacccagtctcttaaaaaaatagaactgacccagaggatggagtccttgacggaaggatatgtaggacataagctattggatatgtggtgtttacctcaatacgtggcacatagaaagcactaaaaaatgtaagtcttcattttaggattatagaccaggggttgttaaactatggccatgggtatgggtctgcttatgtatggctcataagctaataagggctttgtattttcaaatggctgaaaataatcaaaggaatatttgcaacacatgaatattatatgaaattcaaattttgatgcccatcaataacgttttattagaacatagttagcttactcatttttgttttgtctatggcttcttttgtgcagcaatggcagaattgagtagttatgacagagaatatagggccaacaaaccgaaaatttttactttctggtcctttatagaaaaagtttgccgatctctgttacaaacagttaaattgctgacttggcctaatggaaatacttttattttcattagcagattagcagaatgctcatctgggcatacccacaaagacgaactataaacatgcactcacaaagacagctgaccccatggggatccaatttgctgctctaaattcttcatggagctctttctagcactcttagtttattagaaaattggggcttgtgtatcatagcatttcagacacgtggtgcccaaatgctgcttcctgatccacttgagctggctgactcatttagtcacactacatcattattaatatcaaataataaacatgagtagcagatgattcatatttagggggatggggatgacttttaaagtcacagcacattatttctccaaacctgttccacagtaccaccactttgaaagtgaacactttgatctgggggagaaaatgagggagaagaatatgcttttgggagagtggagctcagaaaaatctatgggtaaaacaaccttgttctctgtgtttggggagcatctgcttgatcacagtcgcatctctgtttactatttaaagcctcttatttgcggaagcctcctcagaccatatgttatcaacaaatgttgctaatcaaatacacacagtaattttcattagaatttttccccccatgaacaaaaaacaacatttgccacatagggaatatacctcccaaaatgacagtaaacatccactgcaaacctttgacaacagagtgatatttacgaatgcatatgtgagtaagccaagaacacatctacgttaggcaaataaggacccttggagaattggattttgtgcaggttggtgctggggtcgggggtggggggatgtcattagttgccatggtgatgctcagcataaggccataattcatgtctcggagactggatttgcatttattcaaggtatacggctcatgtgaactgggtgttaaattggtgcggttcataaaattaactgtgggctttaacaagagagaagtgtcatttcaaggaatgaaagtgccgtggtcctgttgctaagaaggaaagttaataattgcctggagacagctgcattaaaatcttgtggcctgcctttgaggtggactgcatgatattccactccaagggaatcaattgtgccatcgcagtgtgtctcatgcaaactaattgataggctgggctttgggttctttagtgtactagaaaagctaagctacctctcatctacataagtgaggcgtttgctttgtagaaattgggctgtctgggaggcagagatgaaggctttggtttgcctccttgacatttccactggaacgtctcctctccaggagtctgagatcaaatgtgtccaaacctcagcttgatctcttctccctcacatctgttcctctaaggcttccccggcttagttaaaggaactgccagccacccagacatcattcttatttgcctctctttgccacatgtccgtcttgtcaccggatctttcaaatcccctacgtatatcacaaatctgatttttgctatggagaaaaagaaagcagaaaatggcatttggaagtaccaggaagcaggcgggggcaatatttaaatagggtggaacatgaaaacttcaccacgaagcaattgtcacctgtacgatgcactcctttatctgttttgttggctgctttgtctctggccagaatgtaaactcacaggacagggttctatgcccctggcttctagcacagtgcaaagcacatgagcacactcaataggcatttgctgaaaaaatgatttcaagaaactctgagttcctccacacacacaaatgtgtggagatgaaattcaagttgaaaatgaaatttaacaatgcttgattatccatggacattatttggtatggttcaagaggaagtgaggaaaattccatgctataaacttcataaggacagagaccaagtccatcttacttattgttatattccagttgtttagctcagtgctcagtacagaggaaactttcaataaatgcctatcgaatcaaggctggagggaataatgtataccacactttatgcacatatagaagacctgcatctcagtgcttattttctcactaactgtgtaaccttggccaagtcattggcagagtctgtttgcatacctgtataatgggctgattttttttctgtcctaaaaccaagagcctggtatttgatttttagcatttccttttgattctttcttagagcttccatctctttgcttatattacccacctcttcttgcactttttccattagaactctaagcatattgatcatagtttttatacattcttggtctgataattccaacatctctgccgtatctgaatctggttctgatgcttgctatctgtatgctgtgttttttttttgagacagagtctcgctctgtcacccaggctggagtgcagtggcgtgatctcggctcactgcaagctccacctcccgggttcatgccattctcctgcctcagcttcctgagtatctgggactacaggcactcaccaccacgcccggctaattttttttttttatttttagtggagacggggtttcactgtgttagccaggatggtctcgatctcctgacctcgtgatcagcccgcctcagcctcccaaagtgctgggattacaggtgtgagccacctcacccggcctgctatacgttttttcaagtatgatttccaatttttattgaaagcaaatttttgttgatgcactgagtaaaagaaaccctgcactgacttcagtggccatttctgctcttgggcttctgctccagtaaggtgtgattctctggatctgcctgcctgtctctccaattttgggggcagtggtttgccctgtaacctcatttctgatggatctaagaagagatgctgattttcagtttgttcagcgtttttcttgtggtgaggacaggaacaatgacttccaagctcttcacatgcaggactggggactggaagtccggctgagcctgtattattttgaaatcctattcagctgtgaaagcttagattgcattattcattgaaggttgactcataagaaaatacagagttgggcaacagtaaagtctacattttccaaggttggagctaagcaacaggatggcatagtgaggaactgtcaaaggctaaattagagagatcacctgatttgaatgtcagtgttgccttctctgaaatggagctcatggggcatcccaaggatctccccctttgttgtaaaaggaggtgagatttttgtccttcgaaatgttggctctgtcttcccagtctaaggctcttctgccccatctccatcacccagctgccttcttctagacatctgtttattcttagttcctgagtatctttagagaaaatgaactgctcaccgcatggcagacataaaaaggagctcctatgaagttatagggaaagcattcatttattccctcctctcagcaattctgctaaccaactcctatttaatttccaacactgggtgtttccctataattacttttgtaacctgagctgtttgttatggttgcaactgtggttcccataaataactgggagactctggctaattgtgtctttggaacttgaatctgccttaagacaccttacaggctccagaagactcaaaagtttacaaaacctacactacagccagctaggcaaaagccactgacaggcttgggccaggggaattgtaaaatgcattgcacacccctttgcattccaaccagcttctctgaaaacaggagccaaatgaggggaaaaacaaaaaaaaaaaaactgggagagacagaacaacagcctctgagctgaagaagtcctgaagacaactttggctatgcccctcatttataaatgaagaagctggtgcagtggggaggaattttggagtaagactcttctatatctatcatctaacagctttatgatctcagacacatttattagcctctcaggtttcagtcttcatgtctgtaaagtggtcacatgaatagcatctaccttatagggtttctaatctgccttgctcccaattaagtgggagaatgtaagttcttaatacaaagcagtcagcgttatctgggcagcacaggattaagagtgcaggctctggaatctggcagcctagcttctacatccagctgtgccactttctacctgagtgatgctgaacagctgactctcctgcagactctattttcttacttgtaaaatggagatgtctatagtgcttttctcctagctttcttttgtgaggtgaggaaatacgtcctagcctgattctcaataaatcctaaaagtgtggtgataattattcagtgacatctcaaagatgcacaagtaatccaagtgccagtactggaatcaaacatcatgaaatgagctgaccttgcaaatgttttccaaaccatctgagcaatggcttttgtgttttctcagtctgagaaacataaaatcggggcttgaatttgggtctgatttttttttggcagctatggcaaaaggacttgttctcatttttctgacttccttctctgagtgcctggaacacttcctctcactcccaatcctcttatcttccttcactggcccttcctgaccccaggggatagatgagattattgttcaatgggattcacactctcctgccctctctaagagaggagtcttcctcctgcccacttgatgttggatttgttcatgcgattactccttttggcctctgctatggtttgaatattgtcccttcaaaaacacattgtaaaatgtaatctccaatatgacagtattgaggagtggggcttttaagaggtgattgggtcatgaggactctgcccacatcaatagattaatctatttatggattaatgggttaacagattaatgggttatcaaagaactgagacttgtggctttataaaaagaggaaaagagacctgacctagcatgctcagcccttttgccatgggatgacttgtgccaccttaggactctgcagagagtccccaccagcaaaagtccctcaccagattcagccccttgaccttggacttctcagcctccatgactgtaagaaataaattccttttctttataaattatccagtttcaggtattctgtaataaacaccagaaaatagaccaagacagtctcctaggcagactatacatccttgcagcttgactttaaaattacccatgtgactttcttcggccaacggggcattggcaaatgtgatgcaagcacaggcttaaaatggtgcttgagtggttgagctttttctcctgtgtctttgtcaccaatgtgagcaaagcctcctccaggtagctgctatcctttcagcctggatcccagaatgaactatgtggagtagacctaagccaaacccacagtgagaatcgaaggccagccagatccagaactgaaagcagagccattcagctgagcctggcatggatcagccaaccttcaactgattttcagatgacaaatgagaataaatgactatggctttaagccactgagtttcggggtggtttgttacacagcaacagtgaactgatacaacctctttatctgttaatcacatcatcctgtttctactctatgttctgttggtctgtctgcagtccttagttagaatatcacattatgcagtgcccagagatattttatagcccttgcatattatataaagtccatggcagtcactcaataaacacctgcctaatgactttagtgacttgaaaatgacagctctgttttgccagtgtcaaattaagcaggatctacccacggtgtgagagctgcactgaggcctggctatgctggccaagcctgccacaggcactgtctaggttcccgaataagcaagtgtgttaacacctcccagggctaaggcaggcagccaatgtctctcaaatcacgaacgctcaagtgctcccaggaaaagccctaaccacatcaaaggcactcccgatcgagcctcccacatggaagcaatgacaacaaagccaacctcagtagcacttgagtgtccccaacatttgtgtctctgaatggggacccaaattgtggtgggtacacagaagcagcgcttaggggtgctcagggatagccattcagggctttggctgccctccaagcagccagccccatcccgtgagacctcccggttgcctttgatagaggggattacggaagctgttgttggtttgcattggggcgggggttggctgctttcatgggctgggttcccatcatcctactgaaggggacccctgaggacactgtgagccatgcttgtctctttccccagggactggcttgtgggtttggtctttattttctcttttcaacacttatgagaaaccactaggagtggccatgaatgccaggaatctcaaaaggaaatgatgaatgaggccagctggctaaatgcccttcagtaaggactgaggtgttgtcttaaagaattggggaaatggctctggaggccaagtgcatgacataggctcaacctggagccagagagttgttcttgaaaagtgatgaatctcagttgtagagaaataactggaccctggtatattgacactatcacagcagagtgaaaatactacctgagttcccagttgcatctggggctccttacactgaccactggggctatgttaagttcaccacaaggcctagtcactcttactgtgggaccccacacccacaaaataacaaacatactaaaaactatctttgaaaaaaaaataccaaaaaactgtatgaaagttgtttgttgttgttgctttttttttttttgagacaggatcttgctgtgtcacccatattggagcatattggcacaatctcggctcacgtcaacctccacctcccgggctcacgtgatcctctcacctcaaactcctgagtagctgggaccacaggcatgtgccaccatgccaggcgaatttttgtatttatagtagacatggggttttgccatgttgcccagggtgcaaactcctgggctcaagtgattcacccacctcggcctcccaaagtgctgggattacaggcatgagccactgcacccagctgaaagttgaattgagttgtaattaactagctgatataggttaaatttaaaagacgtataattaaatatgatttttgattttatagttatctttatatattttggagtttatacagttccttttaaaatgtagcttcctaagctcttgaaaagcatttgggccccacaggccaaatgtcttaatcccagacataactaaaatttgatgaccagtactcaatttttcctctgaaataataaatttgaaggcttaccaactgataagggccagaattaactttaatttccttgaatgccaacttgtacgcctccttccaacaaaaattatcttcatgtcctttgcccaggtaaagtaagagagcaaatatttctgccatgcattttctcctaaaaggtattcatactctcctttatctcagtcccaaggagacatagacgtaagcgagggtaggttcaaccaagactgtctgaaatacccaataaaagaaccaatcgctcacccctggaacttttctttcaatgcatttgacaataacaaaacttgctttctttaacccctggggtagacaaagcagcaagttatgaaccttaatgcttctaaggttcttacaaatgttagttgatcttttttcagtggaccctctttttttttttcttttttgtgacacttccagcctgcctgcttccttctttcctgcatcctcctctctcctttctcatgttagagatagattcacggtatacagttaagtccatgtggagcctgccagcttctaggtacctctgcattcccactgctctgtttgtcaggtgctctgttttaccttttaaggtttccaccacattgagtgaggctcaggactttggaaaattaagtggcagagagtaaagccaggcatagccagtggggaaatctagagatgctgtggttataaatgtggactttgtagttagatggcctcatttgagtcttggtttcacttactaggagctgggtgattgtggccaggagatataacctctctgagcatcagtttcctcatctgtacaataggaataagcaaagcacctacctcatggttgttagtaaagatcgaattagataattcaggcaaagcattaacacatgaacacatggtatggcttgaatgaataaatgtagctacttttattaacaatgtcctagaagtgacagaagtttaaaaggccctttaaaaacccaagtagaggggctgggtacagtggctcacacctgtaatcctagaactttgggaggctgaggcaggtggatcccttgagctcaggagttaagagaacagcctgggcatggtgaaatccaatctctacaaaaaatactaaaaattagccgggagtggtggtccgtgcctatagtcccaactacttggggagctgaggtgggagaatcgcttgagcccagggggtcgaggctgtagagagtcaagactgagccactgcatttcagcctgggtgacagagtgagaccctttctggaaaaacaaacaaaaacacaccagaaaaaaaaacaacaaaaaacaaacaaaaacaaaaaaccccaagtggttgaatttggagccttttctttttttccttcctttcttttcctttcctttcccttctttctttcttttctttttcttccttttcttttctttcttttctttctttcttcctttttggagtcttactctgtcaccccagctggagtacagtggcacaatctcagctcactgcaaccttcgcttcccaggttcaagaaattctcctgcctcagccttcccagtagctgggattacaggcacccaccaacaggcctggatcatttttgtatttttactagagacagggtttcaccgggttggccaggctggtgttgaactcctgacctcaagtgatccacccacctcggcctcccaaagtgttaggattacaggcatgagccaccatgcctggccagagattttgttgaggaaggccataactaaacttaaaaacacctttctttggtacagctgggttgttcagtatcagtcataatcagcttaccattaaattctatgctccatgatggacttgcttgtagaggtctttatcaagataactacttagaatcatttgaatagcaaggggagtgtgagaccccctcttctggctctcccctgtctcactagccaggcctcctcagtcccctttgctgattttcctcatctcctctctaaaccttagcacacttagccgaccttaggcctcttcttttctgtctacaccaatggttcttaattgggaggggggtgtggggggctgattttgctctccagaatacatttgcagtgtctagagactcatttttcggctgtcacacaggggtgtgggggagagagtaggactactactggcatctagtgagtggaggctggggatactgctaaacatcctacagggcagtccccacagcaaataattatccagcccaaaatgtcagtagcactgaagctgagaaatcctggtcagcactgaccaccccactgtctcataggcaccccacataacactcggcttctgatcttccccatcccaaacctacactggcttttctgaaggcttcctcaggtcagcagttggcagctccatccttccagttgcttaggcccaaagtgtagagtcatccaggactccgttttgttgcctacatcccacacctaatgcctcagcaaacctgttggtctgatcttcaaaatgtaggtagaatctgaccacttcccaccacttacactcattccaccctggaccaactttccatcatttcctccctgatttattgcaatggccttctaacttgcttttctacatttgccctgttttcctcagtccccagaagccagagtaatcctttaaaatgtaagtcagctctcactacttttctgttcaaacccctcaatgcattcttttcactcagaatgaatgacagtgttttcaccatggcctacaaggcctttgatgagttgaaccttcactgtctctgaccttatctcctacccctctcattctggttcatttagcttcacctacatcaatctgttatagctgttcttcaaaaatgccaagcatgctttccattcaggatcttcatacttactgttccctacgcacaatctgctcttccctcagctccctgcatgaatcactcagcttgttccaggagtgctggggatattactttacgcaggatgatctaggaaggcaaagtcttccctagcactccttactcttcttccctgctcttttttctccttatcacttattgccacccgacatatgttttatttctgtttttgtttgcttattgcctgtctcccccaactagaagccaagctctgtggaggacaaggactcttgcttgctttgttctctgttctatctgtgtctaggtcaatgtcagacacactgcagacacttaacaaatatttttgagtgaatcatcaattttgaaatagttctactgaagagttacaatgtcagaatgactttcattcattatgtatagaatactccaaatgggaatctcttctttgccacttaaatgctatataactatgagaagctacttaaattatttgggcttcagtttcctcacctgaaaagttatcagagttcttatgaagttcaataaaatcacatattaaggtgtcatgaggttaaatgaaataaaacacataaagcattggacgcatacaaagcactgaataactaataactgccacagtgatattaaatggtgctacacatagggattttctctagtctgtacaggagcacactaagaatttcctctccagctgcccaacctcaatggactctaccagagtgttgccacttgccccttccccattcatcccttgtgggactttccaggctagttccagggtctcacaggcttctgaaccttctgattccacttattttaatccaaataaattaattgagtaagggactcattgctgaagtcaatagttatgtctataatggagatgagtcaccaggtaccaaccaaatgacttctactctgggcttgtgaggagcacaagatgagagctggagcagtgatagagaatgggagacaagagggaattgattggacagctgtccttgctgtatcctctgagttttccagtgaatgggggcaagtttactgatttagcctcctttgttcccatttgttgatgttcatccattcatccattcacccacctctccaatccatagtgagcacccaaggcactgttctgggcgctggcaagactcaaatgaataagacagaaaatccttgcactcagaaaggagttcatagtgtttgggcaagacagacaataatcaaataaacaaacaagaatgacaggagttgtgaatacagtagaacagagtcaggacacagagaatgactgaggcaggaccacattagatggggtaatcaggggacatcctgcctgaagacatggtgcttgagctgagaccagatggaggaggggtccccatcaagctgctcctccttctctgttccctcttagtgtactaaagggataacagggtgtggaagcacagcttcaaactcaacagaaggaagcgatctacttaaacccctgttcttcactttgtctctggagcccagcatcctaaaagtattttttgagtgtctaaatccatttgattgataatctctctctgtggctcagctccagagttcctaggtggtaatacctaagcattggcagtttagttagcaggcaatacaggtgtttatgaggaagaagggtcgtcctcataagactcttcttcataagttcagaaaacgttggcttgaacaaagatcagttcctttatgtaggatttctcagagcctttattatgttaatgtgcattccagattttcaagaggggccacagcacataatatttcccaaatttttgtgactatagaaccctttttccaaagagcatcatgaatggttagtgtttggtggaggataccttgacaaacctgaaagagtttgacaaatgtaccaaagaatttcttattggctaataatcagttttagataaccaagataatctcaaagggatgttgagaccaggggtatcatctcctagacatatattggtgtcttgatgaaatcgggtaaaaccgatagctgaaatgaaggagacaataatcagaccaattaagaggcttggttagaagaaaggagggcagccattcaatttgctgtgggtggagtcactggtgggatttatctgggagatgcagagaaaggaagaggagagatctctctctatgcttctttccctactcccctctgtgctccccgagtgactgccaatctgcatgaccctgagagagtgctcccacctccaactccctgcctgctacaggggagggcctgggaaaatctcagattgttaaactcaaggctgagtaagataatattttaattattaatcactaccatcatcatcaattcagcctaacagctcctatttattgagcacttactatgggccaggcaatgtttcaagaggtttccacatattattttatttaatcctcacagtgatgctatggggtggtgagagctgttagccctgttttacagatgagggaactgaagcttaggaataaataatttgacaaaagtcacatgtttgctaagtatatgtgaccctccccctgtccccatcttatgttcaagtcccactcttatccactttactctgatgaatccactgcaggatcacagggtggcttacttcagtcaatgatccttgttgagcattttaatgatgattttctgaaggcagagaggcaaggacctggccactatgtttgaaaaggcatcacacctgggcaagcaggaagcttacacactaaaagcgtagctcctttatcttgtcccttgcctcagtttcaggcatctgtattctgtatttgttgtctggctcttgtaaacatttacgtttgtgatccctgttgaagggaataaggtgtctttggcaggggagtgatataatgattactgtgtagatatgtgcatgatgtatatgcatataatgtgtacataatgatgtaattattatgtaatattttgaagctggaactctggaatcagacacacctgggtttcctgtgccaggcattggtgtctatacaggtgtggcaaaaccagatatatgcagatcactaactagctatgtgatcttggataagtaccctcacccttctcagcctctcttttcttgtctgtaaatgggaacataacatatgtgtctcttagggcagtgagaattaaatgggacagtgcatgttctttaagagctcagcaaagtgtcagataccattgagagctctcaataaatgttagcaatatgtgatttaggatgaaaatttgtcaaggatacaggacctcagagtgaggagaggctggcagcatgtaatagtttaggtgggacaagagaatggtctgagaataatggtttgcagggatgatggatgtggtattgaaagagattttcaggctccattccataaatactgtgcaagacaggtcttggtctcccagtcatgaaggaaggaaagagtaattactcagttttattgagatgctgaccccaggcaaaccaccttctctaatttgtagccatcaatgggcacattggaacagtgactattggaatggcagctttgaaagggttactacaagagtgactcttagttgggagttatgctaatgactctcccacttcccagcaaatgatgatgacagtaacaaagcatcagctgagtgcttactctgaatcagcgactgtgttaagtgcttttacatggataatctcattcagtaaattaataattgaacctgagttgaatgaatgttgattattatgtctcacaaggtcagccacagtcaagaagacttgattcatgaagcacgtctgggaccccggtttacactcagtttctgaaaaacagctgcatgagcagagaacgctttggctaacagtgactgtctcacaatattgtgggaatatcaagtacccgatggatacaaggtcaaccacacccccaatacacacccacccacacccacagaggaatgagagaagagaatgagaaagtggaagaaaaatgcatttgtcctagagtaaaacattatgataagtaaatttgttgacaatcagaattctgtgactattcatgttttgaactctcctcttatagctttcagatttataggaataataagacaaccctgcaaccttctgagtggtgtcatatagcttcacctcccttctcatgatggagaagaacagattcgatactgcatcactttacagctaaactccagtctccatccctctctaaagatgtctatgtgttttttttcctttgcctacaaatgtttttccccttttctatcagtagcttaggctctgacagttcattatgagcacaataaaatccagtttattccctccatcaatcatcgaagaaaattcacagaattgtagtcattaatttcatcactttaagcacagaatgataatttcattttccattctgattgcttgtaaatttttatgaattatttgcatcattaaaaatttgacatgtgtccaacatgaaaattcagagctgtttggattagacagactttttttttctccttctgtcttgtgtcaggcacgtatattggttatgtttagtgtgttgaaactttctcttctctgtggagggtgacaaaaaacaaagttacgttcctgggaagtgagagaaaatgccaaaaaaaatcagatacatgacacaatgagtgactgatacataatttagctcttcctacagcagtggtgttcagggacttacattcagatcttaccatgtggagttaaattgtaatttgctggtcatgtccagggaccccggctgggtcaatgttttatctgtaatcacgttacagcacatctagtttgcaaccccacatttttgtatattaacaacagtaacatgtattaaatgtttactatatcctcaatataatgctcagcactgtacatatagcatatggtatatgtgcaacagtcctgtgatcgggatatgattacttccattttacatatgaggtgtcaaagagactcaccaaggctgaggaaagttttcgtctaatgctacagatacttatcatattatctatatattgttattatgccccaaatgttaaaagtttgcattaacttagacatgttctttctcagaaataatttgttttaatcaaatgtccctttagccctgtaaaaaatatcctgcagacaaaaacagacatcttagattttgtaattttattttaccctggcattttgggaaaagatgtatgatcagtctctcaataaacattaattgataatctactctttgtatatcacaatgttaaatattggagtgctgcaaagatgtctagctcctggtttgtcttagttcatttgaagaactgagtaattacctgaacagttagagagctacacagaggaactaaacagtttggtatagttcaagaaatgtcccaagtgagaacacaatgagccaataaatgaaaaatagtgctaatgaacactgtggttcagaggagaacgagattgatgtggtagcagggatttgggaacccattactgggggtaaggggcagctggaatgggtcttaagaatggaaaaaaaatatatggatgaacagagtaagtatattggagatgggaagttgaaagcaattgttactgagcatcctgaagtattttccttttgctttcaagataaatttctaagtctgtgtttatttcttcaatcagtaaatatcaagtatcccctgtgcttagagttagtgtggacatggttcccactttcaagggggctcataggctggtggagaaaccccaaaatgaacaagacatgtgtgatgagatttatgaaggtgaaagttgaggggctaaggatcatataatgtgggagcttatttaatttggggatgagagaggggaaggctgttcagtatccctgtaaggacacctaacacacatggtgtcagttctttcctttcacagagaagtgctggtggttatggagggtggcttacttaggttgctgaagaaagggtagaaacctgtaggttgggtaggatgaatgaactatgtgagggtaggcagagttgggaaaattggtgaagtaggcaaagttcgtgaacatctgttgtttttgcctgctcaacgtccttgcccctgcttttggtcacagcattcaaattcttctttgggactacctctccttgaacttggtacacatggtttgggtgaaggtgaccccacccctgaattgacaggtggtcgttcttgacactgcatttcctgggccatggactggttcatgggtggatatctgactcaaatgactcaataagagtcagccacaaaatttaggctgaaaccccagggaagggaaagctattcccattggagttactccactgcagaatgcaagccatgagttactggtagcaaccagcttgcctccatgaggagaaaggctacctaagactaaagaccacccagaggaaaacagctgagggaaggagagagagaaattcttaatgtcatcgtttgagcatctggatccagtcatgcctatagccctaaactcttcatttatatggactaatgaaatcctgtctcagtttaagccaatcagaaatggggttctgcacctgttgggtacgatgtttatggcctgagtgatggtatcattgggactgcaagcctcagcatcatgcaatttacccatgtaacaaatctgcacatgttccctttataataaaagttaaaataaagaattggagttctgttaattgcaccagaggaaaactagtaaagcagagccccgcctatccgtatttcttcacctgactcctgatttttcatttgcttcttcccatcttccatgttccatgctttccttcctttcagatgccaactgtttcattctcagaggctgatattttgttcttcccactgggctggcactactgcattatttgaaactttcttaagaactattaatcaaacctcacctctcttgagttccattccttcaggcttttaatagaacatagagtagtttgaaaactaaaatttcctttatgtatgtattcatttgttggcacctagaaggcctaggcattatgctagacatttcaagtactagataaaaaagatccctgctctcacagagctaacagtctggattgttgtataataatcttatcttaattaggtattgatgactagggatggtctaatataggaaaaggcaaactaaggcccttgggccaattctggcctattgcctggttttgtaaataaagtctaattggagcacatccatgcccatttacttacagaacctctgtggctaatttcatactacactggtagagttcaacagttgcaactaagattgtatggcttgcaaagttgaagtatttgctattttgcccttatagaaaagtctggtgactactggtctaatttgtttccctacagtggtacctgcagcataaatgagatcccaagatatctagtgtcttagttcagtgcttctaaatggtgagggtaaataaaaggtaaacttgaaccctcaggaacttggtggtactatgtgaaatcccacacaacaagcacacctatttgaaatattctggttttaaaagccctacacgtgctgcattctaccccataacatgattgcttgtttcaatacaaaaatgtttcagattttatcaatacattgatatgacaagaagatgctctctgttgaactctatgacctcaggttccagcttgaaaaaacatggcatgaattagaaataacatgtttctaatgtgagacttttcacactgtggcttagaggagaggaggctttctctagtccctgcaacccctctgcctcccattagagagacaatagcaatcaggaaagaccattgtttccaggtaatttttggcctcagtatgtcccatccgcctctttggaatacttggaaattacaagggacagagaaaagtttttgttgtactatttgtttaggtttttgaagtgttacagttttcctaatgagaggagacattctgatattattcaatgtactgtgttttctttcctttcccctagtgactgctctttgaggtgctttgttggagaccatcaatatattattatttgtggacagaggctgcttcaggacacatctcttggtttgaggtgacgattatggattattttgttgcctttgtttggcatgcttggtagtagaaagactgctctgtgtggttggagcattgcatttgttattgatgcacaaaaggacattcattatttattgggtgctattgatttttttttttaactcttgggaaacagggatctgttcatatcattaggtttcatttaaccgtattggaaagagaatcacttaattagacagagccagcttttctgttgttggaatagggatggcaggcagggctgagagactgctgtcatttagggatctcttccagttcactcattaaagacattgactgagagcctattatgtgtttggtgctgtgctaagtgcttttgctgcaggatctcattgactgagcaccacaatcacagcaaggtggagtttttactcccatcttacagatgaagacattgaaatttagagtctctaagtaacttgagcaaggtcactcaaccaagcaacaatgaaaacaataacaattataatttaacatttactgaacacttaatatactaggcactgtatgaaacacttcaaacacagtgtcttgtttaattgccacaacaaccttatagagcaggtactactactgcttccatgctttagaacaagacactgatgtccaaagaagtcagagatcctgctccaggtcaccagatcagtgaggagtgaaactaacattcaagcccagtttgacttcagagtcctttttgaaaaacctgtgctagtatagctgtccttgcttcttaggagtggaactggcattcagcaaatgcagcaccctttgaaaccaacacccttgctctcccattagagctggcctccaccacctgtgacagcctggtacctgtgactgagggcctggaagggattcctcacttcaagcaggaattccacagtgggagacaaactcagcctccctttgcctctgtcaggatgcaggatgatgattaaaaggagcactggactgagagtttggaagcccaggttctagcccctctccagtcttgtgtaatgctctggcagtcatttcatctgtaaagtgagaaggttggacaggacaaactcaacactctcttctggatccagcatctttgtttctgttatttaatctgtatccaaagtgtcataggttttcctgtaaaacttctgtgaattaaaagacaaatctctggatatgggggcaccgcagattgctctgtgaagtgaactttgattgctgtattcttggaaacttggtgccattcccatgtccagaggactattacctagagggaagtacggaggatgggggagaggagcagaaagagaatgctggtccgtgaagctgcttggaggaagttgagttgcgtgtgtccctgtggcagatcagaacatccaccttcaaggaatgggaatgtttagtgggttggcagaatcccagtgagcaaagctctcctttactcactcctaatggtgacttcattccaccacaagccccaaagtcctattcacttcttttaagaaatatatattattttgtaattttaaaacttaatgtggtatatgtatacatatttatggggtatagtttttaacagaaatatacataattacaattttcaggtgatttttgggtgtttttgtttttattaagttcaggggtatatgttcaggttacttacacaggtaaacatgcttcgtgggggtttcttgtgcagtttatttcatcacccagatattaagcctagtaccctttagttattttttctgatcctctccttccttgcaccctctaccctccgataggccccagtgtgcgttattcccctctatacctccgtgagttcccatcatttagctcccacttacaagtgagaacatgaggtatttgtttttctgttcctgtgttagtttgctgaagataaaggcagtcctacttacttcttttttttttttaaatttagagtttttatttcatctggagcctgccttctccagcagtaatggctcttcacttccttcttatgtaaatcccactcatcccacccatcctcctacaagtttcacgtcctctgtgcacctttctggataaatccagcccttgctcatctcctcttgcattcaaacttctcatgcatattttatttctcagctgcctttcactggtttcctgggttggtttggcccgcagctggtctgtatctccagagaatcagccccgagctgtatgctgagtgggccctcctggtatctcagagggtctgaggtgtaaaaaggagatgggatggagttcaatgtctctgacttttggatacttctcgctctcaaccacaaatgtttattgaatttctacgatgtccggggcttggtgctggggattccgcagggaacaagaccaacatagcattgttacttgtttcccaggccttttagttttttccgggccactgaaacttcttcctaaagctgaacaatcaggcccatatgcatacacacatctgatttattttccagacatggcaattgtaggctttccaattttagctatgattttaaaggtagggagctaaccttgatgaaataagaaatatttttaaaaagtcttagaaacggaaggggccaaagacacattaactactagtatttttagggatcctggttccttcttttataattctatgttgtttatccctgagctgagctgcatgggtacactggtccacttgatggtttgttccctgataagacactgagatataaaaggttgctgaaacccaggaggaaaaaaaaagtcatgatagaatttagccactagatggcaatcccaggctgtaaatgttccctaaagtttgacaatagccaacttcaaaggcctgcgctaaaattcagccacagcgcatttttaatcctgcgcttccaagtacatttccatttgttgcagaaatatttcagctcatttggaaatgttcatgaacacactaagtcctttgcattcttaactactttttaaattcaaccaagtagagttaatcaactaataaagaggaattgtaattatggctaatattcaaatgtaattttgaaatgcacctttgttatttatttttaaacaaactttgattctgttttataacaatgatatggatacagtattacggtgatatggaaggtaagtgtatctcaagaaaattccattttctttctctgggagtaagtcccacatgtgaggtgaagatgggctcctgggtttacatctagcccctgtggctctccccagagctgatccagaagagagagctgaccaagaagagagagagacacaaggtcaacacagagtcattccaggtcttattctttagagaataagaaacttagatcaaggagacagagagacagggagttgactttttggaatggaaagctccactggattattctttattggtggttgataactcctcctgatttaattagtactgatacacaatccctccatttcctctgattgaatcattaaaatcaagtcctatccctggacaccatcaggaaatatactacaccggaatggatttctatttatttttggcatataagaagataatatgacccaagaatcaagccctaaattgatttacaataaattcctagtccttctgcatgctagctgtaccttggtccctatttgtcaatagtgtgaggagtgttagatcctggaaggatgatttttctgagctaacccttaggtaaccagacttttcagcactgtctttcatgaaaatgttgccaacaagaacaatgaacataaattgtaacttcccacggctgaacaatcattctcttaaaccactgtttcagtcaataaaaataaattaaaatgctttgatatcataaataaaaagaattcttggctaaaagagatgattctcaattgggggtgattttgcccttccactccctggggacatttgagagtatctgttgacaattttttttttctggttgtcaccacgagggtgggggtgctcctggcatctactcagtttatagttatagatttctttcttctctagtccttttatgccatttgagagccttctagaacgttttaaagtccagagatgctgctaagcctcaatacaacgtccaggactgccccctggaaccaagaattaactggcctgaaacgtcaacagtgctgaggctgagaaaccttggccaaatctttcaccttcatccagtagtagggaaattttaggtagttctaagagttgcacaggtccttgaaggaatgatggggttgtttgtatctgactgctttggtagaatacaatgtttgggccctaaatctctgtccttctgaatctcttctcctcattcccatcccagtgtatttgcaaacccttcccagttccagctgttggtgagttgcatcagaccatccatatgtttcagaaaaaaagatgccaaaaatgcaaatgaattgttctctgttaagtatacagctttgcaaagaaccatttaaactagggctggtaatatattttttttaaaaaaacctattccaaaatgtctccagtctcttaaagaatcactggaaaaaaaaaaatctctggttaagagattaagttgcccatcttttttcagatgaacttgcttcctgttttactgagaatctggaaattcccaaacacagatttgcttatcttctttgcttgtactttcaagtttcttctccttccatagggcaagctacctgatggtactaagtcttggttttctctatttgtaaagtgggaatgataatatctacttcacagaattgttctgaggtggggtgtgtagatcagggttatcctttctctatggccccacctccatgccctggcttggacctccaggagccatgtctgtggtacatgatcttgccctcctggccacagctgcttgatccaggtatgagcacctgacccaggacgagccaatcattgcctcattctgaaatttgaaacttacaatggagagtcttattttgtctggtgatgagcagagagggtgtgtgggatccatgggagacagagtggtcccctcttcttgggttgactacagcttgttggaggtgtgggtaaggcacttagggtctttgctcctttgttagtctgaggccccatgacaagtttacctatgtaacaaaactgcacatgtacacctgaattttaaataaaagttaataattttttttaaagactacacacattaaaaaaaaaactagtcaattcccacaccaagagaaaacatggttttatagcagaaacaaagacatagattatccaagtataacggctgcaagcttagatgcataaacattgtaaaattcaatgtcaaaatgtatgactaacaatgtcatttcaattttgtcataaaagtttttcacacacacacacacacacacacacgcacacacatgcacacacatgttcacatgaatggagaggcacagaaacaggacaccactggagccgggtcacactggttcaggagctctctgtccccagtgtttatcctatccctgctaaatgtacttgtttctttaagctctcttcctcttagtttcgtccgcaaagctcttttataccttgactcagcctatatttatagatttctttcttttctcttcctccttttatacctcctttttagaacctacgttccctacacagtacagcacttctgagactataggtgttggcggataccacttcgttttgctggaatgcccttgccaccctttctgtacttgcaaatgctttctagccaaattcaagggccattttcaagagccatcttctccaggaccattctttggttttctcaacagaagcaatctgcagttttccccagaatggaatctttacttttttatattcactactaaatgtacatgatttatttccctgtaagtatgctgcatcctgaaaacagggtctttgctctttattttttaatcattcgcatctatagtgttttacaccttgtagataattgaaatttatcaaataaacaatttattcattttatttatttgtgtcctgggaaccttgtcaataattgtcatctcatcttttccaaggctgtaataaaatgctaatgtctatccaaataaaattcagagaaaagtgagagcctctgttaaatgttctcttcccctgaagctttcattggtatccccattaagaattaacacgttcacttgacatttcattccggtcattgagaagacaaagccagctaagggggaaaatgttttctttcttttgtcttgagtgttcacattcaacaacattactaattccatctttctcattcacgtcactttgcaagctggcacggatttactaaacagaaaagaaaccatggaatgctctaggaaaaacacccaaaaggatgagtgtaaaccagggaaatacacagactatagtgaaattattcagtaaacagagattgggtactgtgactcttcaagcacaaatcttgtacccctggagatgatttgacatggcacaaagacgggacatcaaatggcactgtgaggcagttgttctcttctgtttctcctgattaccctaggaagaagttctcagtgtgaaggaagaacgtcttaaatttgctaagccttttttgttgtacaaagaaggcaattttgttgacgtttggagttccttctgcagggaacagaatcaatctagaatttactaacatggtttttactgaagttatttttatggctactctatatttacaatcagacagaacaagatgccttttaaaatctaagttaaaaagtgaaaatagatttaaagaaaaatataaaacaaataatagtatcaatgatatgctgatatgttgtgaggggtagacagaaatgactgaagttttagaaaaatgtagctagtaccttaccttgtatatttaattgcagtgaatgttaaagatatgtgtcagatttgaaaaagggagggtgtcttacaagtagatatatgtcctaattcttttcaaagccatatttggaatagattttcctatgaaacctcatcattaatatgtgtatatgaggatttattcttaatcttaagttcttaactcctctgaatcatttccatgttacattttactttccagttgtgtgtgtgtgtgtgtgtgtgtgtgtgtgtatcctgagttaacagaagagcaaacattaattgtcatattctgattctgagaaattatgcaaacctccacctaatccaattattcagtataattaaagcagttagttttaaattataactgagctcaattttaaaggaaaaaataaatctctctttttaattttctagtgctttagttttacccagctttgcaaattgtacttatggcctgtctataaaaataaacataatgtaaattatgatttaaatccccatgggcaagctgttctgccttctttgttagaaagcaaataagacctactttatggcctgtttactaaaacggaaatttcaaatgcagggatttaagagacatcaactatattggtgttgtaagtatagaaataactacacagactaattctttcaggataatctgagaatctttaaaacagaccactatttgatgcttttcttttaaattatatggtaatacagaattaaaaaaatgtatatatccacattacttatgctcacctcctaagctgttaagaatctatatattcagaagaccctaacctgtgaagttctggtaattgagttttgatcatcatgctcgctcgagtctgcctttgttcccctccctccctcatctggattgtgtcattactgatgcttccaaaaccaatgggaagaaacaggattcccctttcctcaaaaagccattatatttgaggtctcaagtatattcaacctcaaactgtcatgtgaaattctaatcgaggatcctcatggtaagcaatgtgttcataaatcagtcaatccatcccttcccctaaggaaattttagcaggtgaaattttcatagtagtcatatctaaacacctagctcttttctattgtgggtgaagtagagtgttcctcctctgttcagattcacagtttaggaagaaacaaagtaggaaggcgttctgctgtgtgacttgctcccgtaagcatatccagattggagagaaacactccctgacacgtgcagaggagtaaggcattataccagtttgtattactgcaacagtgaacacttccttagctgcagtcactggctgggggccttgacacagatatgggagaatgcagatgagatgaaattctttgtacatgttagccatcatgcaatcattttcttctgggctcagaaaaaaagcttataaaagtacaagagaattacagagatcttaatatagagataactgaattttctatatttaatgaatttttttgaatgtcagcaaaatctagtaatatgctttgtactgatagtgacttcccaggtggggtgacaaattaataacctgctcttttgcaactgtctggttgctcagcctccaaacctagatgctatccttgattcctgttttgcccctactgcttctactcctttacacacacacacacactctctctctctccattcaaccatgagccttttttttttcttttttcttgagacagagtctcgctctgtcaccaggctgtagtgcagtagtgcaatcttggctcactgcaacttctgcctcctgggttcaagtgattcccctgcctcagcctcccgaatagctgggaccacaggtgcccgccactacacctggccaattttcgtatttttagtagaaatggggtttcaccatgttggtcagtattgtcttgatctcttgacctcgtgattcacccgcctcagcctcccaaagtgctgggattacagtcatgaaccaccacgcctggccaaccatgagcctttttgtatcattctgtaaaacatctatttttcttcactgtcaatccagcctaagccaccattgtctcttgcttggaggactgcaataggccccccacttctctccttatgtctactctcttaagaaaagaacatatgtaacatggataaaattttctctcctgatgatttttttaaataaaagctttagtgagagatcatttacatatcataaaattcatgttttaagtgtataattcaatgactgtttttgtaaatttatagcattgtgccactattgctgtactccaattttagaatataaccaacaaccccaaaaagatcctttgtgtctgtttgtagtcaaccacactcccacccacaatcctaggcaaccactaatctactttctgcctccatagatttgcattttccttataaatggaatcagataatatgtggtcttttgcctctggcttttactctgcataattttttggaggcttatcaatgttggagcatgtatgaggacttcaatcctttttattgctaaacagtacacccatagatgtaatttctaaatgatagttaaaaatctgggacgccatcactcaactttgaactagaatattacaaagctattaagtaccctgcatttccctgcaatccagttcccacaaagtaaccaccaccatggccattctttgtataagactctctgagggcttcctgttacagttaaaacggaaatcaaagacctttcgtgtcctacaaggcctccatgatgtggtccttgcctatgtctctttttactttacctcttgctcacagactctggtacagttttttttttgtttgtttgtttgtttttttcctgtcccttgaatattacaagctttttcccatcttggggactttaaacttgctttttttcttccttgactgttcttccacttgatcttcaggtgagtggatctttgacattgaagtgtcaactcaaatagctcctctataaggaggtaatttgaagctaatctcaagggagtttttcccatcacaccagtgatttcccatcacactactctgtttaatttttttcatagaattcattggtgtcttaaattatttcatttgtttacatacttttttttggtctccacccactagaatatagggttgctgagggtggagactgtgtctgtcttgctaattggtgtatcccttgtgtctaaagcagtgtctaatacatatttttttgtaagcatgtattgaatgaataaggaaacaggtaacaggctaaatcagaatgcaaagtgaatctggagagttaaaacacataaacagcaaacccacatcaaactacagtctttaatttggttgaattgataatatatttgaatccgaatctgtattttgccccagcctcttttattttattttcttggaaatagagtctcacactatcacccaagctggagtgcagtggtgagatctctgttcactgcaactcccacctctcagcttcaagccattcttgcattcttgtgccttagcctcctgagtagctgggattgcaggcatgcaccaccacacccagctttttttttaatttttaaatttttggtagagatggggtttcaccatgttggccaggctggtctttgaactggcttcaagcgacccacacacctggacctcccaaagtgctgggattacagccgtgagccaccatgcagtttctttttaaagtaagtattcctatgaagaaaatataatcacttgtcccttgattggtttaacttcatacagagagagtatgtacctgtgatttgtactttgggcataaaaaaatcagtgcaaataacatgttataatgctgacttggagttttgtgtgatttactcccactttttaacaaggtgcttgatgtaaattttaagagacttgtggtttcagtcaccctgacaaccaaggtttagaattaagtcctattaactgcctttctattttgagtgtcctcaaggttatgtaggtttctcatcttatttcccaagtgcctaaattttccattttaaatatgggtcaaatattttttttttagtttatttttaaaaagagacaataaaagctgaaatgaaaagagacttctttcctcaaattataaatgcatactttaaaaactttatctgtataatacacacacacacacacacacacacaaatatacacacacacttattttttctatatgtaatactttttcctagagcctggaaaaatttaggtggtaggtaatgaagttggtagttaatctgagtttactgtaattaaaactaattgtattaaccttggttttaatacttgcttggcagacccattgtcacttaaacttaacatgtacaatatggctttggtgccctgatcacggatggatttttaaaaattaggaagaaagtaacaaaacactctatttacaaaaggacttatactgttactagttcctgtgaaagacctggaaaattcccacaatgattgtgtttgtttcatgtgcatttctctgaatattttaatccatggctttgttttctcctgatgcttccacgcaagatcctgcacaaatataactaagacattaattgccctcagttccatgtacaaacaccacagtggaatctgcttgcttagttacatgaagtatcactctgctgtttatacaataactctaattgtgcagctttttatatatccagacaaatggagcaaattgagattgctcagtgagaccaggcagtgaccttcatttgagcacaatgatttgcttgctgtttgtatacaaacagctgaaccatatcttaattccaggctcatatttaaaagctgcaatgaattctctgaggctgcaagagagagacagcttcctaatggtagaagccgaagagatagaggtctcccaaaaacaaatatagcaagtgaccttcagccattcactttctctcggtatataggatgatggaggttgagcagatgtgatgtattcactaaaacaaggtgaccaactgtctgtttgccccaggatggggcaatgccaataatgaaaagtcctgggtaaactagaatgatttggtcaccctattcaccaacatacaggacataactagctgtgaactaataacaccatttcctaggaattgatgcaaaaggaacaatcatatatgagtatacagattttcatacgaggttatctatcatatgcatatatctctggatgggtgtggacacacccacagatacagaaaaactggaaaacaacgccaaaacatatacagtgattattgctggatatagggatcatgagtaatatttaatttttccttatactttccctcaattttctacaacaaggattataactttttggtcagaaaaacataaaatattattttaaaaatgtagccaataataagaccaaccacactgccttatacaaaatagttaccaaataaatattatttgaagtgtatgcacaaagtatgcatttttcctccagactttttagcggttttatctgttgggaagggtcctgggtccaagattccaccgtagagttggagtcaagcctgatttatttacatgtaattaaacattatcctcatgaaagacttcaagtacccaacactgacattatctacagagaacagctcacttgctcagtgggactggactcactgtaggttatttctcaaaatagtttcccgttaataatacctccctacctagcagcaagcacgaccacaagcacagtgcaatctgacttataaaccaagcaggaaatgaaatctagaaggggaagggaatgcgtttattttttttggttaggtgtcaatgtcaccctaatgtcagcatgtaacattctgtaaaagacacgtctctgctaaagtggaaaaagaacaaatttggtacagctgtagaataatccttatgggaataaaacggccagcttgagaactcactgccccagttcacatctgtacatccactacccacatggttgtgagagatgccaggtgactttaactcactcaaggtcattcaccgagacgctagcactacaacttacaaattgacaagcagtgtgtgcagagcagcatctggtggtaataaacaattgcaaactccggagagaagagccaagtgttgtctgctgctagaatgcaacctccagagggcatagtaccacccttggaaaaagagcggacaatgggaatgaaaaggagagagtttgggctctatgtcccaatgtgtcttgaacctgtccctctcacttgctttcctctgccatcatcgaccaccaccctgtcttacatgatgacagccacagcctcccaactggtgtccccactcccattgctgctcatgcctcatgcggtccttctccatatagcagccacactgatctgttaaatacataaatccaaccaggttactttgggacataaaacccaagcctcctgccttgacctccaggtcccgtgagatctggccccgccagccttgctgacttgctgtcttctctcttccctctccctgtgctccaccctcaggtcttcttcttgcccctcacaggtgccttcttgccgtagagtctcaggacttggcaattctctctgcttaccatgctctttacataactggttccctcttgcttaggtttaagtgcaaatgccacctcttggggatattttgtgacccctctaattaaaacagcttctccccaacttggtaaatctccaccaaatcaccaccctacatctttgcttcacagcagtggtgcaggggccctgaacccacattttggctgaatgctaaatgggctgaggattaaaaatgaacatttggccaaagccaaatatagatgtcactgaataaacttctgagggtacaagaacaatcgaaattaacacttcagttatttttacaatgttgctattaaaaacttaattagctaaaatttaaacttttttttacttccccctgctgcctctatacaacacacttaggacagacggcaaatggatatttactttgacttgaggttagtgggaagtgaaatattttggggccagctctttcagtatggccaatcgttgacagcgacattgacagcgggttgttaagctttttctccttccggataggaaagaattaaggtaagccttatcttatttcatttaatatgatgaatgctagtgcctcaaacaggtctagagaaattaccgttatgatatagcctcatctttacttttctgctttgcatcattatttaatttttttgaagatttcttggctcagaagtgatataatgttcttcttaaagatatcgagttgtactgttgtactatttatcttcttagtcatttgtttattcatataaaatagttttaatgaacaatttttacatgttaacatgttaatacatatttgtacatatttttgtagttccactaatagaattcaacatatagagcacatatgaagattttttactccatcgtgcatttggaatgctcacctattttaaaaatgaatattcagattttaacaataagtcagaatgatatgcattgcttgtattacagacattgtcacattgattgggtatgatgattatctatgtgtttccaagatcactgagcatgcgcaagtccagaaatttcagaaatgactttgaaataacacttgactatttggtctcctaaaggcaagttgaagccaaaggtatataaaatattttaactgaataataaggccaaagccaaacttgaaggtatctctacccaatgacttaaatgtgccttgtctattgtttgtgccattagattgtgggtgacataacagctacatttctgcttttgttccctgttgtagccccagtgcctcaaaggcacagtgtttatagcacacagcagccacccagataagtgagatgaaggaagggctgaccaaatgaacctaggagtctggccaatagcatcttatgcacttctctctgtgatttgattctccccctgatttttaagtatttgtgagatctgcattggacgcttggttctgattacaaatgacaaaaattacacactaagttcttccagaggctgctatttctagagaccaggttgtttttgagattcatttcatttgaggtctgtttaaagcaggcaggtgaaaaagagaaacattttctaggttccaagtcccgctacatttggctcaacagaaaatcacctaattctgctcttggggtagaaataggttgagtgatttgacacagcagggagaaaaacaaggtgacatcacatggcagggcagaactgggacaacacacccagagccttctgcctctaatagtcctcaatgattgatcctgcaactctactgtactactgcatgtataaagtcatgggagacaagagccctcttttcattccttccctctctagtaaatttacagaagaagaacatccaaaaaacaacaccctgtcattattagattgtatagtgtgctacttgctaaaagtcaaatttacagagatttacttgtgttggacctagcaattccttggtgcatatatttttatgtgtgtgtatgtattttattcattacttagtaaatgacagtgatttggtgtcaagcactcatacaatgggttcattttacttttcgggctttctctgtttttttttttttttttcccctccccagatattttgcagccatcttctgttcttttaggtatggagcctcatctagatggagagatctgcactataattatctttatggtcatcagtactctgaagaggttttcaagcccatcacattgggccccttctcagcttttccataaccctttaccacttgctgctaaggtttagctctgaatcaaccaacatttattaatcatctttacatgtaagcattataagaaaactagcttgctatatagtttttttccaagtacaagtaagggatctacatataaatgaacacattccaaaggaaactaaaaaaggcatctgagagataaagcgtctttagcttctttagttcacaccaactgactttgatggtctgtgctgttttccttttttaccctgggtccactgacagcaataatgattaaaataagaataacatctcttacatttgtgccaagttctttgcatatgttaaatttgaaatgttattaagcagcctatggtgtaggtatcatcagtattattttgtaagtgaagaaactgaggttcagaaggatttagtagctcacctaccataacaatgacagtggcacaggtgagattcaaagtaggggttgtatcaccccaaagcttttgctcttatgcccatgctgaacctttatttttcatataatcactgaaatgtttccacccagactgcagctgttaaagactgcctgaaatagctgcctcatcccaaaccatctaaactagcagctacgggctggcatgaaagcttctgaatccttaccaaggaacccaggtgactctgaaggactccagagtttaaacaccagagctctagaaatttccaaaccccctgataattggcatcatgccaagatgctgtgtcctccccgagggctcacatccatctgcacctttatagtgaagtgagttccatatcacagcacaggggcgttgctggaagacaaataagtaactgataaacacatagaaagtattatcttagctgcactctagcctctggaacaatggccctgatccagaaagaagccagaataacaggcttgtggatacccaggctgtagagggctgtgcctctggaagacgactcatggaggatgttgccttttggattcctcttgcctttgagaactagttcttttatcatcaaatcgaaggcagtccaccctcagaatatgtcctctggctctggaaagcattttggcaatggtactcccttctactttggcacccttggccaattgatttccaggtgtttgaagcctgggtgtgtggagttgtaggatttgggggcaggcttcctaatttctctgagcttctcttttttccttctatttcttaacagtaccatgtggagttcagtgacattatagtgagttttaggctattaatactatttcctgagaggttacaatatgctggtcactgaactcagcccttaacatagatcagattgattttcaacaacaacccgatggggcagttgtgtcttgtctctctttcaaatttagggaaactgaggcttaatggggagaagctacttggtcaaggttacccagctggtgaacggtgaaactgtgatttaaacccagctccatctgactcttagccatatggttccagctagttcagtgcctggtacttagatttcaataaatggtaggggcagttgttattgataatgattcccttgaggatgatgatcattatcattagtgtctctcctgggattgtgtaaatgcctcaagggcagagagcctctttttagactcacgtgttacacctcacagtgctgatgtatgtgggtcgaattatgcctgctgagtgtgtacactaatgtggaacacctgtgctggtgtgtgcgccagcacgttcatctccctttaaatataggctgggttttaatccacaaaacaaccgaatttatggaaaggaaatgcacgcttttagatagttttgttgaatattcaatgctaattaagttactctgttttagagatctaatttcttttagaaaggtagggtggcagaatggatgaaaagtacaggctttgggtttggcttttggcttagctattgtatctgcaacttgactaaataacttcacctctctggatttcaatatttccattagtaaaatgagaataacaatagtacctatctcataggttatggtagggcattaaataaaatgatgactgtgaaatacctagcatggcacctggtccatagaaaatactgaatcaacgttaatgatcactgttttagactcaggccaccttgttttcccccatgtccccttcgtccatctaaacaagaataaagccatgattacaatagtcaataggactactatctgcccaagcattgttttaagcattatatatatatatatatgtatatatatatagcaattaattttcataagaatatggaaatggaggcacaaagagttaagcagcctgcccactcacacagcggaaataggaacgcagtgctctggctctcaattttgtactcttgtccatgacaccatactgcttgtgaacactgatgaatctaaatcaagtatctgttattttcttattagtgaggatttagaatttccccctcattctatcattacagggaaataactctatgacattctttcctatgttctccctgatcactaaataaaaaatacagtggcttttcacatttggagagaaatgtattaaatttgatttctactgaacagtgatagaaaaacagtccagttcttagatttactccagatgtaagtggcaagtaatcttctctggcaaggtaatagagaagctgaatcagaaaggaaatgacctacagtcacttagtccttaagggtttttttaaaaagagtacagccttgtttcatagctacacaagattagactactcatgaaatcagaacttttatagatttttcacgtttagatggagtatcaacgtctaactgacaaactccagccactacttgatcatcccattctgaaattccaactaatttcagaaatttcaccaactcagagtcagttgcaattcctgaaacctctgtcttaagttctgccattatggttcttctctggaccagttagttggatgaaataattatagaattgttgaggtagaagggaccttggattccacttttcaggacttggagaagttggaaagcttggtggcttacataacacaggttggcaaatttatgatggagcttggagaagaattaggagctctctctccaaaacttgttccctagcaccttgcttccttcccactgtctatcctactgtctgttgtcctagcagtctgcccaccttcaccctccagctcacaaacacacacaaactggtcttaaataaacattgggaattctggaccaagcattctggtctgagaggcagtacagtgtctgagcatcccaaagtgtgattataattttactttctcccaacctacgtatcttctgggagcctagcaaaatttaatttctgggtcagtgttgacttttaccatttatgatttaattaacttagaaagaaattaaacctttttctggaaggaaaaaacagaagaaatagtatccaagctccacgttctcgctacataatgtctctacgtaaatatctcctggactgtgaacttgagcatggagtgtcaagacaggaaaggagctgattctcaggaagcctcattccctttcccattcagtggcctttgaagttctcaaaagctactgaggctcctggaatatagaccatgctcaggcgctcagatttttccaatcaactctcctccatgggtgcacaacttcaaaggtcgtatctgtgttattccccactctaatactaaagcctggcaaatagtgtgtgctcaataaatactagtttaccaatatatggttccaagtttactccagtccttaaagatatttcaggtttcaagatggaaatacaatcatattttccctggcttaaactccgccaatagcttctccagggtcttggaataaagtttaaaccctttgcgtggcccctaagacctgtaagttgtcggccctgccctgctctctgcactctccctgtaaacactctccctcaatgactaatttctaggcacattgttcccccttctggtccaggacacatcaagcccctccctacctcaaagccttgcacttgctgtttcctcttccctatgcccccactactttctatcacagcagcctgctcatttctttcagaacacaaattataatctgttgttacccttatatattcatttgttcatttgtttattgcctatgtcccttacttgaatgtttgatccacaggccaaggtttgagatatgttattcacagctgtagccccagcactggttggacataaggaaagcatcctgtgtacacttgctgaaggaatgcaagtatctaccctttcatatcatcgtatcacatttgaatatcaaagaagccattcaggaaagatattctgccttgatgtaaaccattccaaggcccagtacacagaaaacattttgcttaaattgaaaaaggaagcaccattaagaagataatacatgaggcaagcaactggagggaacaacttccttttctgactttgtaactgacttaatgtgggaacaatttaatagaactccatttctatgaataatttgggtataataagcctggcccattctacactctaccattaggatgagtaatatatttcacagaagaaaaatgttacaggaagttgttgtattttggttttgtcttttgtctcatcagatgagatgtcattgaagaaccctagggccgtggcaagatcccagttagggcattttattttctcattcccttggaaaataccaattttccaagtttggttgtgctttctaatccctggcaataatgaaattcatatgtcacgaagcccatggcctgtcagggagtaatgaacttgttaaataatcaaatgccaagtggcatctttggtttcaattcagtagaatataatttcagatacattagcacaatactgggttgctaattcaaatttcctttcttttcagcaaaattatttaagtgttccagtatttaatccttggggcatggttattacagaggacaacttacattatacaaaactaccaataaatataattttggaatatattttctactcagggaatatgtcaggtttctttacatcatttttttttcaaatttactttatttgcctaccatcttcccaatctctgccatttccgtataccaagatactttcatgattacttttcattgtatccaggtaccacctgtgctattatttacttaatatattttatttaaattgattcactttttaaatgttaatgtatttctttaaaaaggaaatcttatgtcattgctacaaaagacaaaacagcaccaccagccatgaatggaaggtaagcgtaatgggatctaaacaaggctatgaaatcttaactggatgctgttgcctgcagaaggctctgagactgagacctgtggaggtgttaatgacctactagcatcgaattaaaatgttctccttgacctgatcagaagaattgaaaaataaatggtaaaggagtgccttctttttcacataatttcatctcactcaatgccattttctggtattacttaacataatctctgttcttagtaaaggtaagagtgccaccctttgaaatatatcaccttagagcaagaacagccctctgctctatttcaaagagagtgggaaaatatattccaaatgctttggaatccccaaagcatttccttctccatctccctgccttcctgaggctgctgatctaatggcaggatttcaagcacttctgcctaagtatccccattggtttcccatcagaagcaaaaacaacctattgcaaatggagacaatattgtaaaataagtacgtctcatgaaaacttgatcgtatattctcctggctttctatgttaaaaacgcaggagaggaggacaacagaaatgagaggatatagtctgcttggaaacaacccacaggtagcaaacagattgatcaactgaaggataagtatgggccacaatttagctgagagtataagaggctgccggccttcaccacacacaccattttttccaaccacaaagtattaatatatttaactaatgaacgcagtgttattatattatacaactgatccaatatgacgatgctgagcagggtcctggccataagtgaagagatggcactgataaaaggaggtgaaggatgtgtaatgtcaattcaatacatgaggattccaaataacatactcttagacaaattgggttatgttatgtactcctaaatttttggctatacttgaaaaaaaaaaaaagacaacagccaaattccttgtagacatgtgctatggcacaatgttagggttccagttatggggtgtagtacttggtagcagcaaccatggaatttgagtaataaacaaaacatgcttgaatggagttttggttttagaatatataaataaagcatgggcaccagctggctgtaaaaatagtcaaagacaagattcagaagatgaatagggcaggaaaagggctaagcttgtcagaggatgaagtggagttattaggacaaattaaagataatccccgaaaggaaaatttctggaataataaaaatcaagtagcagagatgacagttggagattagtaataggagaaagtgtaagtgggaggggtggagaaaaggagaagaaataaagcttcaaagaaaagagatgatgaagaggcttctgagtaagttaaaactagggaggcaggaagaaaatggaactgcacaaacaggctcgttcatgctaccagataaaactggaggcaagccaggtgcagtggcccatgcctgaatccttgtactttgggaggatgaggcgggggcaggtcacttgagcccaagagttcgagaccagcctcagcaacatggtgaaaccccatctctacaaaaacatacaaaaattagctgggcgtggtagtgtatgcctgtagtcccagctactcaggagactgaggtgggaggatcacctgagcccaggttggccaaggctgcagtgagctgtgattgcaccactgtactccagcctgggtgacagagtaagaccctatctcaaaagacaaaacaaaacaaaacaaaacaaaacaaaacaaaacaaaacaaaacccaaacctcaaaacaaaacaaaacaaaaccacttggaggtagagaaaaactactagaagtgaactgtgacaaagaaaaatggttaaaaagagtattgagtacagaattgtggatttagaaggaaaataagtaaaggatataggagagtctacatgtaaaggataaaggaagagaggaagacacacgagtgttgtatatttcaagctccacgtatatccctttgggatactatagaaatggcaaatacagggcacttgtactccttcctcttccacggcagatgttacaagttgaccttggcactattttcctctgagtatggatttggcctcgaacccttctcaatacagcacttcaggtagctaccactgactgatttcacttgaccctggtcatgaaacctgaatccttaaggtattacaaatcaaccaacctactgactgaagaggaatcaaaaatgtatacttcttactggaaaagcaaaatgtttcaatgtgagctgtttctgtacatagacatcataagccacatgtatagttatgagtaagtatgtgtataaaacatgaatatttcatgcaggtagacccaatcattctgtaattatttgtaatctgaaattctgttttaaccatttacaaacacaggaaaatcaactcatgatttaccctggtaactgaaaccgttgcatctgatcgaatgttacaaactatgttttgaattataatagctcatatgaaacaacagtctgttagaataatcagaactttcttcttccttctcaatcttataacgccatattgggcccagcatcttaaaaggttgccagaaacacgaaataggttgttcttcccccatgtatcacacattttaaaaaagcacaaatagtgcagtataacataagagcatggaaaacgatcagaccatttgaggaataactgggatttcatcaatggcagtaaaaaagaaaccacatttattgtcagtttgaaacttggttgtaaaaaaagggaggaagggtgacgtgtgacaaggtgcattggtttccatttcctcttgtacacactcattaatttctcccagcttctgagcatctgaggcttttgcctattcatgcaaagagccacttgaaggtatacaatgccctgagattttctctagtccaggaaacattccgtgctttctttgaactattttgtttgaacatcctggcaaattattcatgttctgccaaacagctcataatgctctgggggaggagaggcagtgagctgctgttcagggtttctcttttgatgactctcttatgaattaacaccaacacaaaaagatgctcattagtctagatgggcttaactgagatagaaaaggaagggagaggaaagtagtgggtagggagggaagggagcaatgatctctcaagaatctttgaggcctgagagtctactgaccctaatgaatgaacccattattgctcctgtggaccgctgaaacagtaccctaactgacctcctgcacaaccctgcccacccactccccatccactgcagcgagagtcatcttttcaaaatacatctccaatgcatactttcctcaccaaggcctaacaacttcctcatggtatggccctgcctgcctctctggcagcttatccaccccttattctccaaactccagccctgctggcctcttttgaatttctccttgcccagggcctttgctaaccacaggacctttgcacaagctgtttactctgcctagaatgctctccacccatccccactcccattgctcaactttaataatattagttcaaatgcctcatatgtcctaaggaaggcctattctgcatctgtcctcacaaactggttcaggtgcctcccactatctcctctcaaagcattctttgtcagcatttataactatttataattatatatttgtgccattactttctgatgtccccatgaaactgtgagctgtggagggctacagcagtgactactttcctttccaccatacaataataccttgtacacacacatttgactaaattgtattgacccaatgaattaatgtattatgtaacatactaccttgctaatacattcagaactatgacatacaggaaaaaattagacaaaaacccaaatatcatatgttctcactaataagtgggaccaaagctataaggattcaaaggaataagaatgatacaatggactttggggactcaggggaaagagtgggaagggggtaacggataacagactacaaactgggttcagtatatattgctcgggtgatgacaccaagatctcccaaatcaccactgaagaacttagtaatataaccaaattaccacctgttccccaaaaatatatggaaatgaaaacatttttatgtcttatactgaaaaccaaatatttagaaaatttaataaaagtaaacttatatcaaactttcctgcacattatattgatgaatggaagttgtgactaatctctcgagggtgaatacttaaaaccactagaaaggacactgtttctttaattttcttcagttctctgctttgaaggaactagaatctttgctgtggctgccaaataaaaatgtaggcaagtcatcttgtttgaaaaataaacaaggtttatgtcttctcgtatcttctggggaaaccagatctttaccttggagttggccaaaatggaactaatggcagcaaccctctataagatggaccctggagaaacataacttacgttggtttagaagcctcggcctgatcagtctgtagtttctctcctccttccacctccattgtgcaatatacgatgcgatttggagccaaagatttgaggccttggacttccataattaccacctgaaaagagaattccacataatggaggttattggcaaggcccctggcagcatcgcccagaggaaaatacacaaatgagaagctacagagaaaaccaacaggtatctgatggcttctgttaggtttgtaccagtcatgctgggaccagtctagcacgaagatgcaattcctcatagtgtagctgattgcctgccagatagaaagacaaggctcaccaattcaaatgctcacaggggccagacaggcatataaaatgggctactctttctgtgttaagcaaataagatcagtttttcatttctaccaaggaattggctcttttttttttttttttttgagatggagtctcgctctgtcacccaggctggagtggtgcaatggcgtgatctcggctcactgcaacctccacctccctggttcaagcaattctcctgcgtcggcctcctgagtagctgggattacaggtgcacgccaccatgcccagctaattttttttttttgtatttttagtagagacagagttttatcactctgtctagactggtctcgaactcctgacctcaggcactacgcccgcctcagcctcctgaagtgctgggattacaggcgtgagccaccacgcgcggccaggctcttattttctttaaaaatagtctggcttttggttcagcactttaaagagccacaggctcataaattcactttttgcttcacaataagataagtaatagtgcaaatactaaaataaagggcaagtactattcagcattagattcagagatgcaacagggattagcagggactatgacaaactggagagcacatgctccttctgaagggagcagctgccagttacaacccgttgttgccttgtcttttctcactttagagttaccagatactccaattttgccttccagaaaatgaaaaactgaatcagagtcacagtgagaaagctgattttgaaatgctgacaataattcaaatagggagaaataaaatacacaaactctgtacaggccaatattattgagtcaaaacaaaaacatgtctgcagctgcatagtctttggtccagactgagagaaaaagccggtgtcatgatggatcaagatgtatcatttacagtttctggcacttcctaccacctccccaaactccacgtaatcacctactattctgatatttaacagtatggcttgtcacaagagaccggggagggagaagaatgcagaaagcagagaagaaagagatcaatttaaaaatctgaaacaaatgactcacatcagagatatacaattagtccttatacatgaaaaaatcattcagttgtactccaaaacaggtaatggtattacacaagaagaagaatgtgagtgcgcaaaaaatgaatacttccttagtggatcagattcaagaaagtacaatagggttagcattgaaccaggattccacaagtcacagttttgctactggttctcaaacttaatgtgaatcagaatcatttatagggcttgttaaactagagattgctaggctctatgatctccagagtttctaatcagtaggcctgggttggagcccaggactttctttttctaacaattttcctggtgatgctgatgctgctgacccagaagccatactttcaaaaccattgtactactcgcgtgatgttgggcaaatgatttgatgttgaagtcacttcatttttctttcaaatctccagggcctgtttcctgatctgtaaagtgggaataaaaatatgtatcccgtggctgttgtgtgaggatcaaatgagacgatgcacataagtgaacatttttacattgggaagaaccatataaatagaaagaaatggaaggcacagtgaaagagcacaaattttggaatttaaaatatctgacttcacatcctgattatgcattttcacaagctgtgtaatcacgtgcaggtttctcaacctctctgaggcttagttactacacctgcaaatacctgaaaagactattgtgaggattcactgtgttatgatgaaaaagcacctggcccacagtggcattctacaaacacctgttgctttctgttagcacatgccctttgccctttgtcctttgcccaaggcctggctactgggcaccctggaccttccttccctcactgcaaagttatttactacctggtggcccctccagccatgcaagtgtataattatgtaaaatatgacttgcaccaagctgcaaattcaaatcctagtctgccctgatgagatgacaatcctttctccctcttcttgcctgccctcattgtgcccaccaaaacacattcacaaacagatgtgcaatggtttttgctggcagttttctatgatgtgcaattcagtgttctatttaaaaagtatttggggatcctaggacatttctttctgtactttcaattacaagtcaaaccatctgaatcaggtacacataggagtacggacttgtctacatctatatttcagataatcagctgtgtaatatcgagtactgacaaagaattagaaaattacagatttagcagggcatggtggtgcacatctacaatcccagcattttggggggcttaggtggatagatggcatgagtccaggagttgaagaccagcctgaacaacatggcaaaaccccatctctacaaaaaatacaaagattagctgggtttggtggtgtgcacctgtagtcccagctacttgggaggctggctgaggtgggaagatcacttgagtccaggaagttgaggctgcagttagccaagactgcacctgcaccactgcactctagcctgggcaacagagtgagacgttgtgtcaaaaaaaaaaaaaagaggaaagaaaattacagatttaaaatactcatgaaaatcaataaaccactttccccccgtttctgtaggaagacaagaggcagtagggaataaattgacacctttaattggcaataatcaaattcagacacctaagaaaatacattcagtacctcaggtggcagtattgttttttaaaaaagaaagtttctgtgaaattacacggatgattttttcacacactaagtactctatatttaattgaatactgcctcttccaactgcacaatacatgttgaaaacactaatgtgagtatctccatccaaacttagcacagaaaaacaaattacctgcagttaattcacagcaggctttaatgatgttttagaaaattaatttagtttttacatattctaatcaactgcacagaaatttgatctcttctcttggtctccccaaatctagggttatcataaaacccttgtggggttttgaactttagtaagttacaagtggttctcaaattttggagtggataagaagcatgtaggggctggttaaagtatacagtccagggctgcatcctgtctagaattttttttctgacaacttgattgtggcatgttttacatatcatataataaacccattttagatgcacaattcagtgattttggtacatttactaagttgcatgaccatcatcataaattagttttagaatatttttagttttcctaacaagatttcttatgccctttttcaccccttgccccagggaacattaatccacttcctatttctgtagatttgcctttcggaccttttatatcaagggaatcatacaatatgtggtcttttttttttttttttttttttttttttttttttaaagacagggtctctctttgtcacccaggctggagtgcagtggcatgattatggctcactgcagccttgatctccctagctaaattgatcctcccacctcagcctcccaaggagctgcacaccatcacactcagctaattaaaaaaaattttttttttgtagagatgtctcactatgttgcccaggctggtcttaaactcctgagctcaagcaatcctcccacctcagcctctcaaagtcctgggattatagacatgagccgccatgccaagcctggcttttttcaccaggcgtatttttgaggttcatccatgtcatggcatgtatcagtgggttgttccttttaattgctgaatcatattccattgtacgggtataccccattttgtcgatccattcaccagttggttaacatttacgttgtttccattttgggctattataaataatgctgccataaatatttacagtcaaatctttgtgcagacatgtgttttcatttttattgggtatctgacagtggagttgctagatcatatggtagttttatgtttaactttttcagaaaatgctaacctattttccaaaatggctgcacaattttatattcccatcccctcgagatcctagctcagtagatctgggtggtacccaggaatctgcatagtgaactaccttcccatgtaattctgacataggtagatcagaactactccttagattatatacatatgaaaagaaaatgtgtgaagagaaattatagagaaacttattgacatgttgagcattttgccacaatactagcctgaatgggtacttactttgggagctgagataaactaaaaaagcctccaccacaagggactctctaccttgtagccaacaggaaggatgatgggaaagaaaatttacagctcaccacaatatgatgctagcttgcctctcttataactgtaaaactggctgccaaaatttttaactttctaaattatataaggtctttataaaatccttgagcactgttttaagacagaaagtaatgcaagattaaatttagtaggtggttttcagattgcatttccttaagaaaaatgtgggctcctggagatggggaatcacttgctgattagctgacctaagcttagcatgctgttattttaataactgctcctggggtgcaacagaaaaaacaagctgattgtgacgcatctaatcgcccatgtcctacttgctgtgccaagaaactttcaagggctcagggctttttacctccaatgagaaagacagcacgacatctgacttggagagctggttctcactctcctcgcccatgtcgatgatggaagcattgtggctgcgtttgagtttctggagcttgaactccccgcctttggataccggcatgctctccaagttggccatgagcaggttgacagatgacttcagctcctcaatgtacatgttttccatttctttggatacaaacttgggaaatttgcgttccttgggaagaaaaagaaaagtatgagcagaggagaaaatagaaagctgatttataaagaaggtctttgtcccatggcccagagttagaatcacatctactactagtgaaattcacccagatctcatggccttgtgctagaaaaatgttcagcctatttgagtagacagctgcctgcctgctagttatttatacattgtaacaggtaagaaacacgtacataaacatatagtaagaaacattgaaatgctttattacagttctatttttccccagtttccttcagcaaatttgatttgtaggaagaaaaatggggtgttatttttcaaatatggtttcagtttagtttttctttttagtaaaatgcagtcatttgtttttaagtgagggaaacagaaagagaccctatttctggatatctacagagattttctcacatgaataattcaaaaggagctcatttgagaggtttcaaacatagtctgtgtctatttctaagaataatagttactgttttcaagaaaaattgaaccaaattaatgaagtgatgaaaaatgtgattaaaattctttagaagatagagcaatttggtatcataactgacctctattttttcctttcttgcttatacatttagttgtaattgcaacacgtgctaaccatgctatttgtttcttcatacttctaagtcacctggaatgtgctttggatcaatcaccttcccaaacagtcatttaccacttgaaacataaacttgccctccccaagccctattccataactgatggagtgagaagcaagccaagtcagtttgacatttttatttttttttgcaagtgacagaaaaatccacctcaaactggcttaaaacaacaaaagaaaatatcctggggtagacccagcttcaggaaaggctggaatcagggctcaggtgatatcaccacaactgagatttttgttaaaatcttggctttggttcctctggggtggcttcatgctcagtttggctcccctatcttcacagaaatgttgctaaagatgtggactgcacaacatcacatcatgctatctaacggaaaagtgaatatttcctcttgtaatatgcaaggaagatggagacagtctttcatccccaaattctcacccaaagtctaacttaagtacatgtccaattggccatattactggccaatttctatggccagtaatatgctgtgctgatgtgcataggcatagcttatgtcctctgtccttgtggctgggagtagaaccccacctagatcccatggaacatgaattggtatgccaattctgtgtggccaaaaaaaaaaaaaaaaaaaaaaaataagctgtgtaacatatgggcatctgagtcaagatgaaccaactaattttattagtgccctgtcatcaatcagatttactctgtcaagcagttgaactagactgagagacattgagactgcaattggctggtagaactgaaacagtaacatcttacagactcagggttggctgccacactggatcaggtcaaagcagaataagacacttaacaaagaagagagagaaagaggtagagacaaagagagagaagaagtaagggaggcagggactgaaggagggaggaaaagggagaggagagaaaagaaaagaaaagaaaagaaagatgctttctagagttacagaaaggaactctgacttttatcattttctaatttccacaggactagttatttctcctgtaattttgttccttaagaatttatttttctttcagtaattcccccacccactgttagttaaaagggtttttcttccttgccatctcacagcttcagtcaaatacggagagtgcttcttctccatagagcttggagatgtctttgtgctggtccagtgccagtctccttcctacatgaaggctgtcataagtcttgttcccctctctccctatctccctgcataactaacagccttgttttcatcttccatatttcagcttcaaaatttcacttccctgggttgggtcctcctgttgtatttgctaacttaccttcttggtagcatttattgaaatggattgaatgtttgtgtccttgcctaatttatatgttgaaatctaaccctcaatgttatggtatttgaagatgggccttgggaagatgattagatcatgagggccctcatgatggaactagtgcctgtataaaggaggcctcggagagctgctcatttgttcctgccagcatgtgaggacctggtaaaaagacagctgcctatgaaccagaaagtgggccctcatcagacactgaatctgatggtggcttgattttgaacttcccagcctccagaactgtgagaaacaaatttctcttgtttatgtcaactatggcattctgttatagcagcctgaatagactaagacacttgttataattataattaatcaatcaattgtggaatttgtttaatttctgtctttcctgctgggcaatgattcaggaccatatctatcttaatactcctgttgaattttctgtgtctagcataaagtttggcacataataagtattcaatacatatgaattgagtgaatagatcaatgacttgtcaaaaatgcccatattaaatatcaatgtagctaaaattcagctgtgaggaggaggtagatagatgataaattaagttctgaaagaacaccgagattctgcttttccatgtgaataaaatatgggggtctgaaatccactccgcaacgtcacagtaccagttccttctggaacttcttagtataatcacgtcctgcttttaagactgggctaagctcactgtgtggtgctttctaaacacgctgtgcatgaatgtgagggaaagagcaggatggatgcttctgaaatgagatgacaggctgatgatcttgacaagagctactaatgattcatcacaaaagaatctcaaacgttgtatttctctaaaacttcctgcacagtggccttgaaattttgtcattcttggacttgatcagggacaagtgtgaacctcagaacttggatttcttttatgaaaaaccgtcaagatgcgaggacttggctgctgggtccccatcacttggaaaacatttactgccacaaacactgtatatggtacagagttaggcactagggggatcatgttgagaggatgtaaactgtcttccttgagcttacagctactggggagaaagatctataacagaacatcaaggtaggtactgtaatggaagtataatgtgatgcaaatccttcctgagagaatcaagggtggcttcccagaggtggtgacctttgggatgagggtctgatggataaagaagagtttgccaccaggttgagttggctgagatagggccactgctcttttctccttcccatggaaaatactgtaggcaaccatgaatccaagaaggtgtatacaactttacatagccacacaatatttcctcatatttcttggaatatggcctctctggagagtgaagggaagagtgaggtaggttaactcatggtctgagagtagtccttaggccccattaaaggctgtcacggaacaaaggttacatcccaagagcctgaaactcattacactgacctgtatcttgcctcctcatactggggccaaaacctcagtgaactacatggtatttggtgtgggtgggggaacttggtaagtggggaatttctgattttaatgccagttgctggcttggtagttgccaggaggatgaagaaaatagctagcgtttgtgaagtgggttcttgctaatcaattttgagagactgtcttgtcaagtgcggttccttctatcacaacttatcttagggactcactcagtgccttttaactccacagtcctgagatttttttaggaggcccggtggttacagatgccaccatgctgactgagggttagctccaccaaattctatctagcaaaatattgggaaaatccaaagaatgatcactcctcccagaacttggacagttcctaatgacatcataaaaagaggctcataaaaactgaagtctgcaaggaaaacaaggacatttttctggtgcaaggacttaagccttgggaagaaatagcatactgtcaatccaggctgagtttcttgagtggagtttttcagtggcagacccattgcaaacacatttcaaagctgaacttgtgccaaaataaggaaaatgcagtcgtccatctccattgctactttttcaagcacaaaaatagatcagccttgacagaagaattgtttattcatattgctttatgagaaacatagcgtatgggtgggcaaagtcctccaaaaaaatctctgttggccatttatttttgttttgggctgataacattcctcagtggagacagcctcccaaggacaattcccactagggttatttatgctctgagggattttggaacatctttaaaaatagcatttgaaagttctaatgcctcccttggctgctggcttttcttttctggttttggatttttacccagagaggatgaatggggtatgtataaatgatgacaaggctgccccccttcagagtgaggttccctagaccccaaagactcaaatgacaaagttggtgggtgatcagaaggaggaatgtgacagaagggccggtgctagacactggagctcactgacagtgctgcagctatttaatccaatctctcagacacttcctgggcttctgtcatgtgtcaggttggtatggctgtcactggagatgagaaaaccagccgagaggtgatggtatggggggacatgccagaaagtgaccagttagtgacacatgaagcaacagaggcgtgcagagtacaaagagggcatcaaggaactcatccagtccatgacagtgaaacggactcgaccctgaatgctgggtctgctgcttactagctttgtaagtttggacagatttcttcacccatctgaattttggttcccacatttgaaatgaggataataaacctcacagaattattgtgaaaagtagagatcataacatgaatatgttttgatcactgacacacacagcctctctttacacacatacaccccttgcaagcactatgctcctaccaccaccactacaaacaacaatagtactaataatgatggtgcctatagtaaagataataatgttagttggcacttactgagtactaactatgtgctggacactaggtgaaaactttacatgctttattttaccttatctaatccttccaacaacccactgatgcacatgcttctatttatccctattttttggaagaaaatgaggcagaagtgttaagcaatagttactagagttaaacttgaaacctagcagagtttttgttcttagctatgataggataaggcagaactatctggctccaaatgtctatagagctgaggcaactctgggggttctctctgcatggtgcatcctgtatgcatcatctcctttcatcctggtcagcagaaggctggtgatggctgagccctccacagcaatggccattccaccattacccagacaatgtgcactctgtaggattaagcacagggagtaatgaggatggggtcagcaggttaaatgagagaaagaggtcttggtattaatttgtcaaaataggcattgcagacattaaaaggcactttgggctcaggcattatagttttctaggccagcttatttacccaattggtcttacttcctcagcttttatgaactagatggacttccttccacttgaacaagcttcagaggacccccctggcatttatatttttccgtgagctcagatttcccaggatttttagctattgacaaaggccagagtcagagaggggatccctgcacacacattttgtttaactgttcaggcaacaagttgaaagaagttcctactatgtgctggacacttatgttacttcataacacagcatgggtgccatgtccaacattagtttgaaagttgggggttagtatctttctctggtaggagaggattccatttgtatctggtttatggcaatgtgtggaacagaacttttccatcagataaatatttggatattatttcttactgatatttgcaatagggccaggatatgagctactaattgtgctctgtgtagaatacgggtctaagtggcattttcatatttaaaacgacggcttgaagaaccaatggtgttttactcccagacctctgccactgacactacaaaagctgtatgatttgtcttaaataattagctcaataattttggaattttacactaaaattcggccaaaagaactggcaaatatcacagcagcactaatgccacaatctgtctgcttaagctcaaatgtcaacttttgatcacacaatttaaataacttagacttaattcctgggtgaaatttgggaacactttaatatcaacatgagaggatttgggaaaatgtttgagcagggattaccaagtcttttctaccagattttaaaaaatgcattcatatttctttctggaacttttaaggcagcatgactgatgttcacagtgagaccatctctgtctgatgttcttgtgcagccgtctctgtctgatgattcgtgagatgctggtgcgattgaactgacagattacactgcaaggttgtgggtaaggaaaagtcagcttgcttttgcctcccttccctcctaggaagagaggacagacatgtctttcagtggaaatatgtgatgatgagaatgctgctggcaaaataaccagggtccctacaatatcttttccagattctaaaaaaatcaaaatagagaggattctgaattctaggagccaaatctgcctaatgctgctgcttcatatgggcttctggataagctgcagggaacacacagcaacttctagtggagaaaagaaagcagtttccaggagggggaaccagcagggagtgaagaattgggggagtcctgtcctggagtaacttcctgcctttcttctgagtattctaaagaaatagcatgaaacgtggaattagacaactcagttttctgcatagtagttgtgtgcacttgaacatgtgtacacttcttgatttgcctatacttgggagaattaatgtaacgccaaagattgttcatcacgggtctaaatgagattttatgtgaattgcacagccagtgtctgactgacacatttaataaaggactgattagcagagagagagttcaggatgaggcaaggtaaaagcctgagtaaagggcataatggatccttggattggtatgagggggaaagtgagggcctatatctgggaatatattttgcaatgatagtatgcatactggttaagagtgcagactcattagagaaccttggtcagattctctaatgtctctgctttagcctcctcatctgtgaaatggggataataatagcatctttctcattaggttgttggagggttagattctcagatgtaaaatgcttaaaagagtatctggcacataggaaaacactaggtaagtgatagttattactattgggtacatctggagtgcttcccaattcataatgtccactccacccacagccccacttcttcccaccctcaccctaaatgatatatccccagcatccatgtattcaacgagactttcacccctttttccattgtagattggttaactgcaccaggggttggcccttgaaccaagttgggccagtgagagttctgattcttagcattgtgaatttgcaggggataagaaagaaatgataatgaatgtgacacatggagatgggagatgcagggagagtcctgatcactctgcaggccctggttgttctttcttgggttctggctgcagtttctctgcaggttctgtgaagtagtcctccgtctccgatctcctcttttacataagcttgcttgagttggtgcctcttatttgcaatcaaaagtgctctacccatcttttaattcagagaacggagtgagttacatatgatggatgacatctatatccaggaatttctggttatgatatttacaggagctgacattcagccatatgggttgaattgcacatcctcacgaaaattcactgtgatgctggaaatagaaaaatcggggcatgctaaaaagaagataagcagaggtgatttgtcttaatatctcttcatgaactagccaatatccgagatcttgatattttatttaatatttagtggaggagatatttcacaattttcatcagtattagccaggctggtttaggcaaggggagaatttatttttcttgggatccaactaagctgagggaaaagcaggtacatggctgaagcttaagaataattacaatcggggacttaaacggatgtcctcaggattgtgggctccttgacatctcagtgtagactctgtctctgtttctatgtgttggctttattttctcatcatcttttccctatatggaagaagtgcacattgctacaggtatctttctaccactggaagacaacagccttgctgacccacagtccacaggccctacgaaggaattcattggtttagtttgcatcaagtttccatttctggaccaatcacgtgtggccagggcaggctggaaactgactgcttccacctgggtgaagaagagctcactccaggaccagttagctatatagcaagggggccactggcatgaacgaacattgcagaagacagtcaatttctgaaagaacaggagacagtagagggcactctatctcatagaaaccctcaataccctagacagggaccctccatatatactgaaatcattttccgtgctctgtaaataataatcaagatccactttaattgcctacttcattgtctaagaatgcttaggtctaagttgttaataatatctcatttagcttcagaatatttagtggtgggggttgggggagagagttctttgatttactattcagagatgagcatcttggctcatccaggttctattaaaaattaaaattagcctaacaccagtttcttaaattatcatgttaagccttaaagtaaacaaagcaagtaaattaaaggtgccatgagcttgtttttgaggtgtgtgtgatttttatttagatgggatgaatactttttagttgggaatatactcgttgtctaaaatgcagatgaatggaccaaatgacctccattttctggataatccaccagtaggaaacatttttacaggagaagtaaattctaaagctttattaatgtttactgtcacattaagtgggattttaaagcgtaaccttttataatacctttagccaaatccataagcgcatactatttttagccaccaggctgacttgattataaactttaaaggtgtccaaaaacaagatgcaaaacatttcagtaaaactgcttaagcacagggggattttgatgcttcttggaatctctctggcttctcctccagtaggattcttttccatacctccaagtctggagacacctctttccataaagtgaaaagctctaccctgtgcccaccctccctgctgtttctaataacccccaccctcatatgcccacagggcctgtgaatacagtaggaatcatcaggagcctgatgctatttacaatttttatattttattcttcatggatttttttggtattaattgtaattgaaaaatactttactaaaatagtttattttgattaacggaggcccgtttaaattttgtgcctgacataagcccggtgccagccctgatatttagacagacctgagctgagggtgtgccacaatctctttgctggtgcccagcaggttcaacctggacttccccatctctaaaccaagaatgataactgaaatatccttggagggctgttttgaggattgactgagttggtacatgtgaagcatttagcatgctagacacagaatcagcactcaactaatatgactggcatgactactattaataatatcagagatggcagggatagcaataatggtagataacacttagctgtagtcatcaacagtaagacataacctcaacccttgaggagttctatatactgggagactcagacatgtaaataaatgatcaccattcgatgagctgctataataaaggttgatatgcgatctgacgggaacacaaaggtggaaaggactaactgctaagctcttagagaaggtgttttaagtcaggtactgaaggctgagtaggtgagtttgctaagtgaggggagaaacatggttactccaggttgagacaccagtgggtataaagacaccaagcctggaaagggcctggtatatttggagggagacattctctgtagttggactcgggagttccggtgggaaagttgtgcaaggtgaggctaaaatgaaagggtagagtctgttggttaagagtcttgattatcattctaaagaggttagattttgtcctgggagcaatgagggaatctattgaaggattttgaggctctgttttgagatgtttgtatatgagttttatccgggcaactgtgtgcaggatggatagaaaatgggggaactgcagccagggatacccattgggaggctattgtaacatccaggtgctgaagatgagggcctggatcaaagcaccagtagtagggctggaaaacagtcaagagatctgacccacatttaagaggcagtcactggaggcagggtggctgactgagtgtggaacattgcagggagaaaggagaaactgacaatggctaggaggtttcatccacagtgattggatatagaacaagagaagaggagtaaatatagttatgtgtgtggggtgggaggaagacaaggagctagattttgaaggcattcaacctgaaatgccaggaaaatgtttaagtggaaatgttcagtagactgttggagctatgtgtctggaactcagaaggaatgttggaggtctgagcttgggtattcactggagcataggaaatgcatgaggtatctctgggagagcttgccttgagaaaggagggctgagggcccaatgagggtgattgtcctcatcttccctcctctctgcttctcagctttatcctttagaggctgtcaataatcaatgtgcttcctgagtgggactttggcctggaccccagcaaacaaccacaatgtttccttaccctggctatttggtctgccatttgtagacgtccatccagctctcgtctgatctgggctgcttgctcatctggattgtccagctgcacaaaagcacagacattgagacttttagtttgggtcacaagtgccaataaactcaggacattccattttatacccccttgcactgtgctccatggacatatttcagttaaaaaaaaattcttataaccgacaaatccagtctgagtgaaattccaagttaattcttctagacagagcgtgatatggtaggcagctgctaagacaggcatttgaacgaccttgcaaaagaatcatcaatctcttctgaactgttgggcagcagtgtttctaatgaggaccaatgcacacttctttttggcccagtgaccaaagtgcttacacggcagatgtacaaggaaggagacggcaatataactattagaaatgtcaggagcagacatagtgcatatccccagtgcacacatggcacgggtccagccgctctccacctctggaccatggaggattaataagtcattgcgttccttctctttgaacgctgagacctgtaccagccctccagatggctacttccaatcagctggtgttgatatctaagttgaaatctatccctgtcttccctgataaagagaactatttggatataaagatcagagcacccaggcataaataagcctggacaattccctaacttctctgttttcagttttttctatctaaagaaaaaggggtcagttatgtagtcttcatcccttttacaaatttctgtgactctttgaaaggagtagcagacatttctgtaaagggacctatattcaaaactttaggctttgagggccataagatctctgttgcaataaatccactcctcccttgcaggtgaagacagcactaaacaatatgtaagtatagataatatataagtgaatgtaagggctgtaggtgaatgagacccactatattctaatagaattttatttacaacaggtggcaggccatagttgctcatttccattttatgagttgaaactattatttccaagcaaccccagcatttcctttcaagctgtattgagtctgcttattcagaaagttatattttattcacagaaaagtttactaaggagcagtggcatttaaataaaatggtttttattcctctttttagtatatattaattcaaaacaaaaagtagcataagaaatatgtgagttttctaagtccctttcttctaaaatcaattttagaagaaagtttaaagctccctgcctccaaaaaaaaaaaaaaaaaaaagattctcacctatgctgtgaaatgatatagcaaataagttatttggattatgatataaacaataacactggaaaatatatggtcatacttttgaagcatcacaattaaccttctttggtttattttacaaaacacattgaaaatccatctggctttatgctgtacattttaatcaccctgttcaattcaggaaccagcatcactttatcttcccctttccacagtttgggagaaggacttttccttagatcatgaaaactggattgcaacatttggctaggtattctaaggcagtattttccaaagggtgttctgttacaaagtcttcgagaagctctgcagtaagaaaatttgttagattttgaccaactcaactatttattttttttcccccgagatgaggtcttgctgtcttgcccaggccggagtgcagtggtgtgatctcggctcactgcaacctccgcccctggatttaagcaattcccctgcctcagcctcctgagtagctgggattacaggcgcatgccattgtgcccagctaatttttgtatttttagtagagatggggtttcaccaggttggccagactggtctgcgaactcctgacctcgtgatacgcctgccttggcctcccaaagtactaggattacaggcgtgagccaccatgcctggccccaacacaaccatttttaaactgaagctagaatttttattttttgcataatactcatagaacatgagttggaaactctcttctaaacaaacgtaaagcacaccacccaaaagcagtcacatgactgaccagtcgtccatcccaataaccacttgttgacaggcacacacacgtgggaaatacagtgtcctcagtgctgtttttaggttccaatgagctgcttttctttttattcccttgggaagcccaaaagttcttcagctctaagtgcaaatccactgggaacactcagaaatgtcttgttcaaaatacatatgcaaatgaaacattcaactacttcactgggaagcagcaaaatgatttggttattgtctaaagttggttaagagccaaatgatttggttaggagaatttcgtcggaagatatggtgctcgtacaggttaaaacagaagtgggaaaatacagcccaacagaaccagctccattactaaattttccagaggcatttgggttctcccactggcttcatagaaggcaactggaaacagcagaaaatgctggcaatgaagatgagtaggcaaggtctacattaagcttaatttattcttttattcattacttcactaatttactcattcattcattaaatttttatggaatatcttgatatgtcaagatattggaataagaaaggaacaagtccctgactccatggagcttaaatccagcaagaacaggcatgatttgggcataaagaagaaaggattagcatttattgatgcctgtaccaaacaccaaataccctatgacctgttttacagccttttctaaagggtcccaagaaacagaggctaatgtgcattcacacaggaaaaaggattctggggtgaggaattgatgattcctcttgaaaatttgtaatatgtcaacataatcaagacttggagaaattctagagtaaataattgtttttaactgcatttaaccttgtcttttacacaattattccaccaaaaatcacagagcagtttggaaaattccacatgtgaaacaactttgtaaggttggtatcattatccccatttgacggatgtggaaactgagtcttggtaaggtagaggaacatgccccaaatcacacttctggtaaagtggtactagtcacctgaaaccaagtctgctctgcctcaaactggaactcttttgctctgcattatgttggcttcatacttaagtgccttgtttggttttctaattgatcctgacagttaactagctcagcaacctcactttgttccttgtagacacgggccagtttgatccatagagccaccactggggacagagaaatgtcaaccctctgtcacttgtcatgactgatttcttttggggaggctgtagcagtgctggattcctccctaagaaataatagcaatgggtgtgtccttatcctggttgtgccacttagtagctgtgtgaccttgggcaagttacttaacctctctgtgctccagctcttctcatctaaataatcaggttaatgagacctgaggttgtcatgagaatcaacggagacaacggatataaagggcttagtccatggcttggcatgcagcaaaccctcatgaatggtggctgctgctccttgtgttgttattttagagcagtccatgttggctgcatttctgacatgggccacagtggggcgtcaaaggttcagaagagaaggcaccagatgggacagtgtccctcactggcgtgaatgtagggtgtcggtctgacagtctgtgcagcagaaatgatgtgatcagaggctcccatctcttgacaaatttccctggcttttctgtctcccactttctctggggtcgagtccccttgctctgttagactttaattagcgggagtgaccagaaggcggccactgctgcctgacagctaatgatctgaagagaggatgaaaagggaaatgcaactgaagctccctaaaatagcttggcatgatagagaaggccatcctcgcgtgaggagcttgacagctccactctatgaaatcccaaaatataaagagaaatcaagtaattaccttttcaagggctggaaagaaaaagcaagagagtgagcttccatggaaacaaggttctgtttattgcgctggtcttttccactgaggaaaggaaagatcagctggagaaccaagccaagggcaagcctttcacgttggcagatcattagggttcaaaaatgtacatgcgcataaaggctctttacctaattagacaaataatcttcctactagaagaggtcaagcagaggctgtgtggttgttttgacttgtcagtcaagtagaggaaaataattccttgggcttttcctttaaagtgatggagaactaagcccagcactgtgtaagtgtagacaggtattgcctgagccatcagttcaagtccaccagagacaattgtctctagctcatgggtggtactctttccgtcaatgcagagatgaaaactctgtcctgttactgtagggccaatttaaacacaggcttgagatatagcagggtggagttgcacccttgcaaccttgtcaagtttcttaacctcaccatgcctcagtttctgcatctgcagagtggacatcattttatcttgcatagctatttgaaaggacaaaatgacaaaatgtgctgcattgtccaagggaagtcagaccgacttggttccaatcttgtttttttttttttttttgccatttccttactgacacagagtgaacaagcaatcgaatctttctgaacctcagtttccttatctgtaaaactgggataagatacctaccctggcatgttatgaggattaagtcagatgatatacattcaaagcacccagtgaggtaggtgttggcacatagaggtcctatagtttagcaaagtttatagagttatcccctattttagaatggggagtcaccagatgttaattctcctccctgcctttaggatatatgaaagaaatcagaccagggtggggaaccctgggaccctggaatgaatgttaggaacctgtgttctgatccttagtttgcctttagctgtgggatcttgagccaaagtcgtgacctctcggtgcacagtcccttcatctgagagaaatgacaagatttcagctattgtgtttcaggattatctgaaaagcctagactggtatttcccaaagttatattctagggaatatcagtcctgcaggttctctagatcctcgatgggaaaggattctgtgatcaaataaagtctggaaactcactctatcccatttctggagacacacaacacacatgagcaagaaatcctacaccaaggcaacctcatgcagccccacattcccaaatgtacctgatcatgtgttcccaggaacacattctgggatgtgctcacctaggcaattttcctgtgtgcttcatttttctcacgtctgcagacagaattttgggggtggggggagacagggaggaagcaatcccactatgcaaataggtctacgtatcagcaaaatgattcacacctgggaatgccctgtctgacctctagggggatgaagaaattgtcaaagggcctgggcctggagcctccttattagcttcagaggccttggagaattggccttgacagtgcgcctgggagacacccttgggtaccagctacccctgggcatgcctgaattttctggtgctcatgcactaacgatgataaggaggcaacttcaaccctagactcttccaaagtcatcagtgtcgctgccaagaggcagccttcagtcaaccaaagagaggatgtgattcaaatacacagaaaatgtaaacagaaataggcagattactttatgcattatttgaataattgttctgctttctggaaaaacctatggttctgagcttcagagtaaatgaaccaacttcagcctcaggactaaagtgatagtgatccagactggctggaaggagtttcagggataatgtagtaacctcagactaatggtgtggccccctgctgagctctgcagccttgtcgggcaccacatcctcccccagtatgctccactggatacttcactcaggcttttgggagggctagctttctcctgctgccaggtttttgcacaggctgttcctcatgcctggagcactcttccttatctctcccttgactggtaaccctttcttatccttcatccttcagctttgcagcaactctgctctgttctccagatttgtgaatttctcctgtctctccttataatgatgcacctttcctttcccttactaacatatatcaccattaatttacaggtacttatgtgatttggtgtttgcctactaggctgtaagctccataagggcagggatgtgtgttattttgcttatctctggatccctggcacctacttacgtaggtgctacttgtacattacagcggcaaatacagagtgggctctgggtaaatgcctggcagatgaataaaatgactgcctgactagctacaggactgagttaatcagctgtgacccaaaaaggaatgacctacccacagtcgcacaacgatcagtgagggctgggaccaaattcccaatcagctaacttctagtttgctctgtcttgctgcctagtggctgtgttccagcaagtgccattctctgcagaaatcggtaaagactgaactttgctggcctataatcagtctctttcctgattaaagcgttccttattctgggaattggggatggagacaggggtctctataagcagctgcagtgcaagccacctgctgacctgggtttagcttgttttctcgctactttgctttctctctacttcccagtgtgccccctgggttcccagagattagtgtctgagatggaggctgccaagagccactgcagaggagggtggaggcacctccccataaagcactcccatcagctggcagggccctcctttcctccacagccccatgtttttttatcctccttcagagacaagctgctccagcaaatgctgccttcctggtgcactgcagtctggaaagttacagctgggacagtgtcagttcccaaccaggagatgggggtgcccaagctcctgccacaagactgcactggggtttgaactgtggctgtttttgccgcattcaagacctggttactgcctccaaattccttcctctcatttcctaaagcctgtctcttgtgtgtccaccttaaatgtagagcctgtagaacacggtcagcaggtgcccccactccactgtccaagttcaaatctttgcctttccactttaaagctgagcaatcctaggaaagtgattggacctctctgagccctagcttttatttttttcaactcttttaactctaaattgggaacaataatgataatacctacctcataggatcgataagagattaaataagatggatgcatatgacaattagcaaagtgcttggcatgcagtcacgttcagtaaatcttagcagccattagtccttggcattccatagcctgcatatattctcccttacagaagttctgattctgcagcacttaaagtagtatagcagatttcctccccttttgggtaagaaaccaagctttaaaaggttaagtagtttgcctgtagtttcagagataattagctcgagatagagggaataatccttaggaaaaaaatcatggatttcggaatcagaaaaccttgagatctaatgctgcctgtgacacatattcactgtatgatcagggccagatgcttaacctctcggagcatctacagctgctgcactaaaataacctcaaaggactattgtaatgatgacaataaatattctcagacagcaggggttcaacacattgtaggtgtatataactctactattattactggaagagactctgatgaaatctgcagccttgccatccatccgagtcttcactaagggctctgtttcagggttatttgtagaaagaacatggagttcggtctcccatgcagtcaattacattctgttgttacaaaaaatcatccaaggagatgatactacctaatctgtggaagagttaaaataagatcatttgtgtctttctttatcatgccttatttcctttgcaagagaagaccttgggtaggtcaaagtttccattctgaatgatgtacttcttgattgcaaaatgcagggtttagctcccaggttttgccagccaatgagaaccctgctgtatttgagtcaccagttttatgtctttgctggcttctggcaatgcagtaaatataacccaagagctccaaatgcagcaattttctgaacaagcagccaataaatacattaaaaaaaaacccaaacagaaaaccaatccagttctttatgatcctgtagtgctcaaccagtctttccccatcttccccgcagtcctgaaatgacctcccctcttcttttcctttctaccatttcaagtctgatgtgtcattcagaatttggcttcaggcctttcttcaagaagccctccttgattactttagccaggcatcaacccacttttataggaattgctagcaagctttctatgtgccctgtgccttagctctctcttccaccccagagcagtcatagcgcatggtagtcagagacccaggagctggaaacagtcagatctggcttcacatccttgctctgccactttccagctccctgacattggacaatctactaagctgcctctgtctgtgcccttatttgcaaagtgggagtcctaacagtaacaatgccaacagcagaggcttgttatgaaaacgaaagaagatggtactcataaagcacttagcatcatgtcccaaatatgaggggttgcaaggttaaggccataatgtattactattgaggccagagactatgttttttatccagcatagaggatacagctgtgttttttttttaatggattatcttaataatctttatatctggggctgggagactgtccaattcacctgcactatcctgaagacacaaggaactgaagccattcaaagaagagagtgggtgttgtctttctgtgtaagtgtggcagccaaaaccaagggtatagaggaagcaggcggttttgtgaagaaaaatacaggggactaggcctggtctatcccttgctagctgtgcagtcacctcctaaatatctcttgaatccttctatgctgtgtatccacttccctaagccaggctcccatcatctccatcctcaaccaccgatttcatattcatcctctcttgcttccctctgatacaaagcagttctccctcctggctgcatatttgaatccccagagagagataaaaggcaatcctaatgttgaggctgcacctggaccaaataaatatgatattccgggttggggctcaggcagcagtattttctgtttgtttgttttttgagacagagtcttgctctgtcgccaggctggagtgccagtggcgtgatctcagctaactgcaacctccacctcccaagttaaagtgattatcctgcctcagcctcccaagaagctgggactacaggtgcatgccaccacgcctgactaattttttaatttattttaattttttttatttttagtagagacggggtttcaccatgttggcccggatggtctcgatctcttgacctcgtgatccacccacctcagcctctcaaagtgctgggattacaggtgtgagccaccacacccagccaatttttttaaaaccctccgagtgattccaacgtgcagccaggattgaaaacctctattaaaatccagtggttctcaaactttggtgcccataaaaatcaaccagagaacttgttaaaacacagagtccgggcctcaccctgggacagttttgattcagcaggcttgaggtgacaaccaagaattcatccttctaaacatctcctgggtggtgctgatgctgcaaaaccacacgccatgaagtacgaatttaactcaggctttgcaaggcaggctgctcatctttttggaacgtgcatttgctcatgttactctcctgcttaagacctgtcaataacgttccacttcccttggtagtaagagcctgagacccttatcaaggcgttgagagctgttgccatctggctcctgcacagctttccagcctcatctcccaccactctgtcttgttctctacgctcagaccattctgtacttctaggttcacgaacatgacatactcttgcttggcccctggtcaatgtgaattctctttcctcttctgtcatcattcttttccccctgagacagggtctttctttgttgtctaggctggaatgcaatgttgagatcatagctcactgcagccttgacctcctgggctgaagtgattcttccaccacagcctcctgactagctgggactacaggcatcatcatgcccagctgatttttgtatttttcgtagagacggggtcatgctacgttgcccaggctggtcttgaacccctagcctcaaactcccacaggggcctcctagagggctgggattacagatgtgagccactgcacctggccctctgtcatctttgtctggttaacagtaaatcattaacccaaagcctagtatcaatattgctaccttaggggccttcttggtctcagccaaggtcacctcttctaggccaccctaacatcctgaacctcctcttttatcactcccatcacatttgtgtgatttgcttcttggcatgttctgtgcaagactgtaagtgcctttggcaaagaccttgtctgtcttgttcattataaaaatagccaatgactgatgtatggtaagggagtaagaaatatttgcagagttaaatttgagatagagataataacatctatgtggcagggatgttttgaggagttaaggtgatgtttttccaggcacttagtgtggtgtctgacacttaataggtgctcaaatcatgacctaaatagaaatctgaatgcaaatggtttaaacttattaaattctgttgaatgagtaaatgaaagtgagtatttaagtgcagaaaggacagagaataactgactaaagtggtgggaataatagaggtgtgaaccaattaaactctgggagtctctgcttcctcatctggaaattagaaatattagtattcaactaaccatttaaaaatattcactaaacacttgccttgtttcaggcattatgttatgaactgtgagagcaggataaatacataacttgataactttcagaattatttcaacaaaaagaagagttatatttttcaaaactagtaaaacattgcatatatttaaataattattttcattgccattcgtttttcaatttagtttttactaatttctgaaatttagtttgggcagctgatttgatgggaaatggtcactttttcaaaacaagccagaggtgattatattctctggagattttgacataaacattatgggaaatgaaatgcctttttgtactgttaaataatcttgctctttaagcagcatcaagtcatggtaaaaagcattttataaatggcaaaataatgagctcaacaggaagtccagaaaaacatccagtgatgtttaaaatacctctaatcaaatcgaatgcttttgctaaaaaatacctgctctttattttaagaagaagtgaacctcattttcaaacactgatagcatggtataaaattattcacaaggtcaaaaggaaattgagttttccagcttctgcaattgtggcttttgtgaatgtgtacgtgcatgcatgtgagtggtgtgtatatatgtgcacgtgtgtaagaaagctcaagtagtaaaaaacattcagatctgtaaatcacagagctgcccatgtcaattaaaactgaggtgaattaattaaattaaaacctttccagggtacttgagaactgtcacatgcaccactgtttcctttgagcaacatgtcacaaatataagatgtgcttaatttccagtcccaggctgatcattaaacagtacctggtggaaactgggtctattcataagtctacctacatgtatcattatctcattttgcctgctctgaagagtttgtctaccatggggttgccattgttcaaagtcaaaaatattttaaaagggtgagtttcatcttgattaagacctgtcaaagaaacagtttgttcccagtatcaaatccataaccaagtagttttttttattagttcttttaaaagtaactgtgcctaagaagaggaggtggtattaaaaagagtaagcggccaaattctccaacagatgggagaaaaagaacgaactaaaaaacccaaaattacattattggcatttatcaagtatgtcctgcttataatatactgcattgtgtgcaaatgcacaaaggtatcaggggtatcatctactttaacacatgagacagttcttatttgttggactatatagatgcctactctcactatattcaagaagttggaagtagattttgtatgtttggtgaagctgaggtccataatcccatgtcaatcataagcaaggataatcatgtgttgtactgaaaacaaaataaatattgaaaaataaatttaaaaaggaaaattaattaggataggttaatttattccatggtaagaagttaaccttgaaatctcagttgcttaacacaataaccatttatttcttgcttactctacttacccagtgccaattatgggggactctcttccacagaattactcagggatccaagcacatggaagcaccaccattttgtgactctgctacctcaacatgtagctttcaggctcagtgtgacagggaaaatagaacatggaggactgaaagccagtttgctgaaactaatcttgtggccctaacctagctgcaaagaaagttagaaaatgaaaaaaaaaatacataaaatattttataagcattagtgtgtctgcctcaaaaaagattgtagattttggttaaagtgcttaaaatatagactctatttgaatatctagaaattgcttgattctctagtttacctggcctatgtggacacttctacaactaatttaaacttagcttgagtttaaattaactcaagtgaacatggtgtaacataatttaatttgcattgtgaaaggcaaatatgaccttggcttagaggagggaaatagaagaaagtagtaatctcctctgagagagaaacctgcaaataagcagtattttaaccagtataaattaaaacaatattggctgcaatacacaaattcagcactgggaagttcaaattaagatggccctagggtctcgtaatctaatttacttctaatgtacctacaagttcccagcctgagaaacactttaaatggtaaaccaccatgaagacagatgacttcttatctcttgaaattgtatttgtaatccagacaccaggctaatcctctgtgaaactgtttttaagattaggtagttcacctgcttatgttgccctttcatatttgcaaaagctaagaaaatgctttttagggtcttcagagaaaacattctgtagtgattatggcaaatccctcctctcctccccaattactgtaaaatcctccccaattactgtaaaatctcagaaggaacaaaaacgtatgcaggaaccttaagtaaccacttttacaaaaggaacttactttcacaaaaaagtaaatgtacaatgatggcaattgtgtttttaaaaagcaataccaaatatatatatcagatcaatactctgcccttttatgctaacattcctagacacagaattgatttgtaaaatgatgcctttcaacaagatgcttgttgtattgtaaggtaagagagtggaaaaatacatttttaagaaatggctttaagatgaagtgaaacccaaatgattttcaggttaatatctcagcaagttcctgacacaaaagaggtgttcaatatatatttgttgagtgattgtctataaatatttcatcctccatgtaacagggaactgtcaatatcctaacatggtctatgcgattttttaaaattgaaaaattatctatgcttttatcattcaacctgtaatggtcatcattatcgactcagttgattaaggatgacaggatcagctacctattcattttatttcataaaaataagtgggtgatctaaaagtacagggtttggggaaaatcagatacctaaatagttgtgaaaattcttccagaagttgaaaggactgttcagagattattattgtcggtgttgatggtgtttcacctccttttaagtcctgcaggcgttttggtgacatttcagcaaactgtgtactcctgtgaattttttattgtgaaattctgccatagagatatcaaatcatgatgccacaaggcccctgctggtttctgaccgtgcttaatagattctgtctctacagcctgacatgtgcagttgtgttggaaaatggctgattaaaaaatttagagtcaacacatgcagccagcctgcatggaacaagatagcgccctgggtgacagcctggggctttgatgcaggaaggatggaagggatcttatgctcctgataggaagtcagacatgcaccctaagaggagaaaattctgaaaaattcataagcttccttatcattaataattaatctctaaaccaacaggcactggcaatttatactggccaacacgggagaacagccaagggttggagctatacctccctctgcaaacccctctagagtgattaatttcatggcaaccttcagtttattatcagagaagcaaagctgcagaaattcaggaaatagtcttcataaactgtgacattagccatcacaatttataagacaaaagggtcaagtctcccccaaccagtctcttcaccttcctcctcaccactagcaccaaaaacaaaaaaccaaaacaacaacaacagcaaaaaaaccaaaaaaccagaaaaacccacaaaggtttagatttgacactagctcagattgggatttttctgacaaaattctatgatctctataagttctcagtagttattacttggatagggaagggggagcaattttgtccctaggaaatgtttggtaaagtctagagacatttttcgttgtcacaatggagggtgagaggtgccactgccaatagtgggtagaggcctggggtgctgttcaacaccatacaatgcacaagacagcccctgcaacaaggaattatccagcttaaaatgtcattggtgctgaggctgagaaaccctgctgtaaatgctgatctcaggaaagtaagatgtttgccctgacaacatttgattatgggggcaaagagaatattattaaactgacaatggaggcttaacttcataatgttaatcctctaactgttaaacccttcccagtattaccagctgggctaagatctaaaataatttgaggaagaaaagagataagaatgagaattttgacagttcatatgtggtgaaaaaatttgttcaagaaggcaccaggtttgcaagaacaatccagacaggtatttccggaattctgctttggagtgctttggggttttttctcactgaggtgtgtaatatcttacacaggggttaaacaactggggtcttgctgacccctgtgttgtatgcatatttatgttgcaagcctccttgttccaggagacagctgcaatagagtgactggaagcattcactatcttctaacactctgtcacaaggctgctgatcctgacacactcacaaaccacaccttcaacctgttgcttgcagggaaagggtcatgcaaacacacaatcccctctccttgatttaaaagcctgagatgctgcacagagccgaatcagaataagagatgcagaaaatctgggggtggggtagaaataggcacaatgaggaggtttctagaaggcaatcatactatctcattatttacttcactttaagataaaagtagaaaatccccattctttttccagtaaggcaaaatatattgccctcctttctcactaaattccatttttagttaagtttttaggtttgctaatgtcactatttcataaggaagaaaaaattaatgcttgattctaacatctgtgtttctcaggaattttttttttccactggaatgagaaaccacacttatcttgtacagaaggaagaaactgcaatgaattcattttacagaagaacatcttaagccagtttctcttccctgataagtgagggagaagttgagatttctgggccccagatttatagcattctttccctgctaaaaatgttttaagcctaaatgcatgcctattattacatacaagttttacatgaacaaaactgcaaaagagaaaccatgttgacctaaggaaacttctgcagcagagtgttgaatgggattcttcctggtgttcaggaattggagacataaatattggtggaacattcataccctccagggcttattaaaaggtgtccaacctagccctactatccccagtcatcattccaatgactttcctcaccagttgtatatgagaagaaaacagcgaaaggagaggcgagggactggttagaaagaaaaagaaacccctcagggttcccaaggcattagcctgagaaaagagattgctgtagcttttctttaccccacctgtggtgcttcctgctgctttccaccaagaaaataacctttagagattggaattcctgaaaaaaagtgagcatcttgttttcatggttctgttgaaagtctgctttgcagccagctggttgacctgccttgtgtctagttgagcagatctaaaacacaaagaattggagggagacagcccgctggagtggggtacttgtggctatatttctactgccactatttgatgtgtcaaagttgtgtgggtttcttacaggttaaacgcacactgaggaaggtattataggtgaactagggccatcttactggagcttcatcctagaggtggatgctggtccagagagatgctggtccagatgctggtccagatacttcctatagtcccggctataggaagctctaggatgaagtcccagagatgggagcttatgtgtggttggaagacaggaagctgatgaagatctccctaagagtagcagctcccactgatgggctcccaagtaactcatccatgtctctcatgagagcaccagcacttagctgccaccacacagtgggaccaatggagagatagtgaaataactggagaggagattgcactcaccagcccaactaagtaaaatgaactttgcctttccccgtcagcactgcccaagacttttcaactccctgcattgaccctggaaaagctagtcacagaagaggcagggaggttatgagctttaagttggatataaaattgacattgtaaatgagactgggtttttgaaagcgactggaaagctaagaagtctatacaaggagtcattagatggaagagggagttctggcacagcaatgctgaaggtaaaaactggaaaaaaataaagctgtgtcatatttgtcctccactggatgcagaatcattgataaattaattataatttatataaagatccttccataaactttccttctaaaaaaactgttacacaacttttaaaaaagaaaactacctctacaggctatggggagccactaaaggttacttaggaagggagcaccgtaatcaggtttgtgttctggattactcttggggcagtggaagacggagagtaggcaaggaaaaaaaggtggagcagctgcagaaattgtccaggtgagacataatgcacagtggctaagagccaagttgagtcagccatttggaaattctgagattgaaagagtggcttcatgtctataagcctaatttccttttctgaaaaatggggataagcacagcgtcttcctctttgggctggtatgaggaatcagtgaaaccatacagatgaagtgaacacattggcccaccctaccccaagctgtcctcaagcagaattatctattgttataaatggctttggctcttccaggcatttaggcctgaaacctcagcatctccttgactttattctctcattgtcacacacatctaatcatttgccaaatgctctcctgtcctcctctgtctggcagctctccatacgtttgtgtctttctcttcattacctatttcttccttacttcagcaccttgacatgtctcccctggactgctgtgatagtggctcaacttgtctccctccctcctctctatcttccgctgccgcagattgatctaaagcacacatctggtcctgtctcccactgtccatgaagatgattttcaatttttaaaaaatcagtgtagctcttttaaaaatgaaagtaccacccagatgctcataatacaaaactatgaaaccaagaatttctctgtgagaaatagtgacaatattggtggtgcttgtgctgggagtttagaggctcattcctacactacagccctgagaggttctgaaaccatgtggattccatgaggcaatctttagaaatgatgaggacatatcctggttcttcatggtctgggctcagtgcccacctttccagcctccactcccgccatgttccctgtgatcctgctgaattgaccatttggtgattccccgaccctgctccatgcatttcccttccctgtctttgctgacacagttttcttggctgggaacacatctgtgcatgactaggatctcctggcttcagaacccacctcagatgtgctgttgccctgtctaacagactcctcccctactcttccctaagttagcacctgccatccttctgccctagggcaggtttttcaccacagcctgtctctcaaagactcttctcaaagactttgaaaaaactatgccctctccatcacagaacccaggttagtttgtaattgtatatctgttggtgtggtcacctgactgacctctgtttctccattagggtatgagttccatggcttttgctcaacatcataaccttagagactggcacagggcctggcctgtgttaaagtttcaataaacagtattagtggaaagaaagaagaaaatggatcttccttctattgcccttccactggccctcactttgttctatcttgatgttattatttgcgtacacatctaatcctcctacaagactagaaacttctgagggcagaaactatagctggcttctctcctgatcttcataggccctgaagaatgaaataaatggtgggcaagatttttgttgtttgacacgtctacatgaacaaaaacctacactggattcccatgtaatgcagtccctcaggggccttgttacagagtgtcattttgaaaagctcaggttctccagtcactgactcgatgactataacacatctacatcatccccaagattcctccactttattctacatttcatttcagactgacttctgtaacaggtaggggaaaataaagggtgctgggtgtggatgaaaactgagggagaaaaatggcaattcaggccttttgttctccagaggacctcatttggaggaaaatcatggcagaagagacattgtgtctgtatctgttgatgcattacgaagtatttattgtcgggctgtcttattaactaagaaattcaaaggcagtaagaaaataatcagaggaaatgctagtgagcaatttttggcagcacaagggacagagacaatttggaaaggtagagccttccttcttaagtaattggaatcctacttcacagttcacagattttgtggctgtaccacaatacaagtatttctggaatcaaagaaagaactccactttttttggaaattaaggataagtgcaggagctatttttttcactgtttattctactttagcacagggaatctacacccctaggaagcagtgaatcactaaatgaccagaaaatgccagaatggactggagcttaattgggagttcttgcaaggaagcccaaaaagcactagagatgctaactactcatgactgccttgtgtacaccttctgcaaggactttcttcccactctaaatttgagtgcttcagaaatcatctgtgaaatcgctagtgttcagtgagtgacaggattttcaaactagtccatttgaatactttctctcactttgctactgaacagaattgaaagctgagaggttaggaaactagtttaacattgcaaaatccttatttaagagatctggatctctggaaaataaccagtttctaaaaaggatggtaccagaggcagtttcttctttccttccttctcctttcccttttttctccaaatgtttattaagcatagactgctccagaaaaggtacaggtcctaagaatacaatgaagagtataaagaaactgttttttcctcatggaactgataatctagggaggaatgcaaacattaatcaaataaccatgtacattaatgtaaacttaccaagagataactgctgcaaaggatgaaaacaagattatgtgaaagaactctggcctagcagctcttgaattaggaactaaagataagtagaagttaaccaggcaaagagaagtgaagagcatttcagacagaaatagcatgtctcaatggcctgtggccagaggaaatgttggaagcaggtcagtgtggctggagtaagggtgaggaggagagtaaaatggggatggtctgggaaggcaggcagggccaagttgtgtgtggggtcttgtagatcatgggaaagctaagcgtctctatgaacatgctagaagcaataagacgtcattgaaaaatttaaagctagagattagggtgagacatattgggaggagggatgagaagttcagatgagcattacataaacatcattctggctcacacagaggatggattggaagggttaagggtgaatacagctattgccaatggtggccaaaccgactaaatataccaagtgcctaccatgcataggctaggcactttatagcatacaaaggctcgtttgtgattacaattctgtaagaaaggttcttttttgtattaaatcagctgttttggaatcattttagatttacagaaaagtagcaaagatagtacagaatgttcctgtctatcccacacccagcaacccttcttgttaacatctcatgttaccatggcacatttgtcaaaacatatgaacaaacattgatacttcattattaactaaagttcttaatttatttggacctcattagattttttcccagcatcctttctctgttccagtatcccattaaggacactacattacattttgctatcaggtctcagactccttgggctgtgacattttctcagactttctttgcatttgatgaccttgacagttttgagtactggtcaggtattttgtggaatgtcccttgatttgggtttgtctagagtttttctcatggataggtttatttatgggtttgggggatgaagactacagaagcgaagagccattctcaatatgtcatatcaaaggtatatgctgtcaacatgacttctcactgatagcaaacctgatcacctggctaaggcaaaggtttccagatttctttactgtacagttactttttctctcctcccactctatactgctttctttgaagtaagttactacatggagtccaaacttacagggcaagttttgctccacgtctttggggtgtatctatttaagttatttggaattcttttggatgggaaatatgttttccatttctgtctccttcctaatttattaattcatccaattatttattacagtatggacttaggaaagtttattttatattttgagttataactcagtatattatttaatttcttgctcaaatttgggcattgaaaattctttctgttggctcccagttccccttgacatatgtccatcatttggggggattttttggagcacttttcaactttttggctctaatgatgatccaggctcagcttgtgtattgcctaccccagccgtagaatcagccatttcaaacaaggagccctggctctttttatgggagaaggatattgcaaactaagatgtggacactggatgtactcactgttactggggaaagaaagatttttatcctcaattcagatgagaacattaatggttagggagtttaagtgacttgcccgagtaaagggcatacccaagattcaactaaacatccttctcttcattttcctttgtaaaaatatcctaaatttcaatccacatccaccatttcctcagtggtctacacactttggggaaagctcaacccatcctcagttctaggtgagtgtcttccctggtttaagacattcagcagattctatgcacctggtcagagtaatggaattagggacaggatactttagtacaaagtacatgcaccaatcagatgcaagacgacatttactagacagtttctgggaaaggggctttcagactcttctgagaaagatgctggaggagaattctctcttcttgatagaagtgaaaggaactgtaagaaaaccctatggcaggttaagattatgcagctcattttgagggaaactctgtccctgaacttatagctcacaatcaaagtagactgattttactactttgatttcatagagttgaaaagtcgctatcaatgaaagatagtaagggattcacccatttgataacttttgtaattcacaacacacctactttgcttccacaaaagcaaacaaggcacagtgcaacagatctctgaattagatgaaaacggagtggtgatttcactcaaaaacttcaactaaggaaacttactgaaattgagcaaaaacaaaattttgagttcctagctggcctggtaacacccactaaggcacacaaacaggtagacattcctgacacaagtgatcaagattaaggaatctataatcaaagaaacaatgcgtagagtttatatggaagtgtttggtgaagtataaacgtgccatataaataaaaaaactggtgataataatgttaatgtttagaagagagagggaccttaaaaacagactaatcctaacgtttcagtttggagtttaataaactgaagtccagaatgtgaagtgacttatttatatagctagaaagtggtggagtcaagaaaaaaaggatacaaaattacagctagataggagaaataacttctagtgttttatagcagcggtccccaacatttttggcaccagggaccaaacttcgtggaagataattttttcatcgggggggtggggggattggttggggggatggtttcgggatgaaactcttttcacctcacatcatcaggcattagattctcataaggaacacacaacctagatccctcgcatgtgcggttcacagtagggtttgcgctcctatgagaatctaattctgccactgatctgacaggaggtggagctcaggcagtaatgcctggtacctgactgtggcctgggggttagggacccctgttttatagcactataggatggctataattaacaatatattatatagtttcaaatagctaggaggaggatattaaatgtttcccaacacaaagaaataaaatctgagatgatggacatactaattaccttgatctgaccaccatacattgcatatatcaaaacatcactatgtaacccataaatatgtacgattattatgtgtcaattaaacaaatttttaagcaagacaattacgaagaatgaggctaagaaaataagttaactatattccagtgagcaaacaaacaaacaaaaaaccctgcatgttttagcaaacagaagaacattttcgttttctctatgtattataacacttcagaggcataaaatatctatgtcttcctgcagagggaaaacaacaatttaaaaaccccatctatttaaagttctttcagaaagtcaggtaggggaggaagtcaatgggtcagctgacatcagtggacagaaaggcgtctttggcccccaaataatagaaatacatttaaatgctaaatgtgaactagaaagttattttccttgaatttctgaagtttttctcttttttgtcctgtggctagaggggagaaatggagctaatgtacactacaagtgatgatataagataaaaatattgtcaatctgcagatctgcagacaagcaaaggctaacataatccccatatttcataatagcatgtacttaagggtgtgtcattcccattctttctgattttgcctttttgaatgtcctgtttatggaatatatttcgtaatgtaccttgtctgtcttgtattggtgactcataataagtaaagcccaactcatttttatttcagtaggattttaaaatgaccttttatttaacattatgcattttgatagcatcttttgcttacagagccttcccagaatgcattgggtagttaggcagaaatgtattttaagccatcagggactagagaatttgtcattattacatgtatcctttgttcctccccacatagtaatgctcaaaaggtgctggcctcatgctagttcttactaaaatgattgcaatgatggtgacagctgtgggctgccaccaagtagcacatctgcagcagctgtagcaacagcctgggaacagccacaagcatgggtttcttcctttatggccaagggcaaaacaccgaaaggagatttgttatggaagacaagagggatcaacagtcttgtttgcttagatcagggttgagggggcccaacacgggggtggcaaatccctcccatctgttcttgtttttctggagggctgatgtcactcagcaatttaaaatggctaaaattcaccactcgaatcaaggaaagaaaactgccttcaacatcagatcataggtttgtaagttcacgatgaccacctcagggaatttgtgaaacagtcccaaatggggcaagaaatactgcaaaatgccatttgattcaagtagaaataatttctatcaacagccaggggcattttattgagtgaacgttaataagacctaagaaaaagcacttaactgctgccaatgaaaggactttgttgtttttaattaaatgactaggaagtaaataatcagaaagggaaggttgtgagaccccagggtaccagggacttagggccaggatgaattggcttgaagattttcagttttcaggggtgattatcatgagtactttttctttctgctaatattatctattgtgtatactgaaatcttatccttaaatttcaacattgtgtattgagttttcattgctacttccggggttcccttcgcattttttttttttttttttgcttctatcttaacgcttgcttctatggtaaaaagctcttattatgcagtctttttctacaactaataaagaactttcaaatatattagaccacctaaactgcgtaataatactgtgaagcaggtgcaagtgaaaaaagtcactaacccattttacagctgaggaaattgagacccagaaaggtaaagaaaaattcctaaagtaaaacaattcttcaaatccctttcatcatttattcaacaagtatttattgagcatgtgctttgctaggtgctcaatcatattatactggtcaggtggtaaggcactgtggttagaagaatatgcttccatcagttaatcgagaatcaagctttttccattgcagcactactagcattttggaatgaatagttctgcgttgcagggcctgtcctattcattgtaggatgtttagcagcctacttggccactacccaatgtaaaccagtagctttctttcccctgtcatgctaaccaaaaaaaccaaaaatattcctagacattggcaaatgtcccctaggggcaaaatattctctattgagaaccatggagctaagtgagttttgtgagcctttgttactcatctctaagatgggaatagcagtctctaatagcattgttatagctagtgaattgtctggaagtggtcaataagtaggagatgttgttactgttttgctattactacccaggtcatcagatatttttaaggtgcctactatgtgccactgcaaacaggaaggtggaggaagactcaggctttaaactcaggtcttaacttccacatagagtgttccatctgctctgccagttgccaactcttctaaggcacccagctagttaagagcctcattttattcttgctcttgccatctttaaataccttcctgtcctagtctgtcatcatctcttgttgccaaagttataaggaaatgttcaagttttgaaaaggcttttctcaggctgacctctaagaacttgccatcctcagacactcagtgtcaccttgctctcccttctcactaataaccctcacaatggatcataaagccctcagagtgtctgggtggcagaagggattcagaagactgtaacccactttccacagggcatccatggtacagcaatgggtaatgtgggaagggaggaagaggacaattcaagttgacattgacagcaattttctccagatgagtcccagaaaaaaaatctttccagcgtgtgaataggaataacagtgtgataaatgatgtttcttttcacttcctttgttactaggctgtgatttgacagctttcaagagttttagtgatatttattcgtagaaaaatttcttagttctaacagtgaacacatgttgaataaggaatggctgacatttgatttccttcaagcactaaagtgtttttctctaggcagaacagcacaattaatttttccatgctgtacctgagctgaaaaaaaaaatgcattcctccattccatttattttcctgttatgaccttaggtggcttataaacattttccttataagaggaaatgtgaatctaaagagaccatacacaatgaactttaaaattgtaatgtaaacataatcaagagataatgccaagagaataggatgccatcttgaggttatgacctccaactgctgtaaaagtgtgcaaggagaagcaaactgatgtctagaaatacaggctgggtgttagccaagactttcacttgaatgccagtgtcctggggctccccgaatgataactgaatcactgctttataaaatgtagtctttttttataccattctctggaggggggttgtagggcataaaaaattagattgtatttggatgacatgtttgtataaccctttggacgcaaatgtacctgacattatagaatttcttcctgccaagtaaccgaaatttatcagacccttgtcctaatctttcaaagccttaggttttccttctggttgttaaatcaattcacacaatgtgttaatagctccttgaggcaagtggaaaagcttctagaaagaagtagctcctgagatgggaggatgggtaagatttcaaaaggtgacaatgagagatgagggggggcggcgttctagcaggagaaaacaggaaaagcaaagtatgttcgaggagatcccatggcaagttcagcagaatgattactagtttgggttggacactgggcaaagctggaaaggagtaataagcattttagctaggagaggtactgattcttctctggactagagtcccaagcagctaccatgtcaaccatgtttggagtaaaggtgtgtttgactgtactgggcaatctacattttttttaatggaaatttttggcttctcttccctttctggaagatctgtcaacaatgctggagctggagctgattggcagctgcccctgttaagtgggatgttaactgtccagttggccatagtccccaccattcccaatatactgagagggagaacaaaagttgtgacttattgtcaagtttttcttatgacagagtatcataatctccaagatgatgcatggtcatattgttttgttcttatgctgtaggtcacggaaaatacagttgacttttcttatatcaagttcacttcactcgtttgtgtgaactttttcagcattagagatcatgagccctgctctagatagggaaaggctaagtaactttccaaggccacagggaagtcagtgcctgacttgtcaatacaatgcagcaggtccattctcatctgtgttaagttaaaaagagaacccggactgtccctgtgtccatgcggcatggtaggaagcacactcctgcccaccaaattctgcttggtacccaccaaccttgctgggtcctggatcttaagattgctgtccagaaacctaaattaatgcttaagctggattactgtatgagtctaacagaggggtgagggagagaacccacctgcctactcacagaatttcttaaaggtccatccacctgtacacaaaggaaaacacatgtcaacaatgtttccttttactccttggtatttacccaaaggagtcaaagcttatgtccacacacaaacctgtacacagatattcatagcagctttatttgtaattgctaaaacttagaagcaaacaagacattccttagtaggagaatggacaaactgtggtacatttagacaatagaatattattcagcatgaaaaagaagtgagctatcaaaccttgaaaagatgtcgaggaagcttagttacatgttgctgagtgaggaaagccaatctgaaaaggctacacactgtgtaatttcaactatatgacactctggaaagtgcacctatggagactgaaaagatcggtggttgtcagtggttgagggggagggagtgatgaaaaggcagagaacagaggattttttaggacagcgaaactgctctatatcatgtcatgatggtagagacatgtcattatgtatttgccaaaacctacagaaccctaatgtaaaccaagagcgaaccctaatgtaaaccatggactttgggggataatgatatatcagtgtaggctcatcaactgttacaaatgcatcattctgttgggggatgttggtagtaggggaggctgtgtctgtgtaggggaaggaggaatatagaagatctctactttctgctcaattttgctgtagcctaaaacttctctgaaaaataaggtttacttaaaaaaaaattctttcaacagcagtcagtaatggtgcttcctttcctggaggttcctgagttaaaatagtgaataaagagatagtaggcagccataaaaaggaactagatcatgtcatttgcagggacatggatggagttggaagccattatcctcagcaaactaaagcaggaacagaaaaccaaacattgcatgttcttactcataagcaggagctgaatgatgagaacacatggacacatagcagggcaacacacactggggcctgtcggtgtatggtcaggggaggaagagtaccagaaagaatagctaaaagatgctgggcttaataccttggtgatgggttgatgtgcagcaaattaccatggcacacatttacctgtggaacaaacctgcacatcctgcacatgtacccctgaactaaaaataaaagttgaagaaaaaaaagataggattttttgataataatatggtcttatcttatgaaataaatttataactccagatgcatgtgattttcttacagaaacattgtcacttagcatccatcatctgaaattttcaacaccactgtctttacaaaaactcttgaaatatggatgatggtattttagatcagtcctcaaactggtcaacatctgaactgccttggagtttgtttaaaaaaatatatctatatacatatatatagatatatatagctacccagaactcaccccaaagcttttgattaaaatttcaaaaggatgaagtgccagtccctgcattttaaccccacttccaaggtaattcttctgctcaacaaaggataagaatcactgaggtgaaaggaaccatttagtccagagaaagcaaatgccttgcacacttatgagtacggttttttcctgaatagcagcagacatcactaattcatctgcattctttcccatgaacctcagaattgctcaccacaactaccatttgaagacatttggcttaggaggtaaacctatttgttggcccaggagataaaacttatgcatatattattccagtcttttggaaatccataaacctacatctcactggcctatcacaaacataaatctgccgctatagccatattttagaaagatgccattcctttcaactctcactgccatcaacctagtccaagctaccatcattacctgccaagatggtaacaataccatctacctggtctctctgctttgatgcttcactcctgtaatacacagcccaaattaggtttttaaagcaatgaaatagaaactgctggtgcttttaaattaggatcagtttgaattttagattaatttagggacagctgacatctttgttatgtaaagaaggtcatgtcatgcccatacttcaaaaccatccaggtctcttctcatctgtatctagaatgatcatggcctcttagtagatgatgtgacctctacaaagctcgctaatatcacctctcatcttgaggcactctctccttcactggttgttttttcttcaatcgtttaccaatttcttggccatcaagtttttccccatcccagagccctgcttacaatttctcgtccctctctcaggaacattcggtccctcccaatttccactcaagttcctgcccctcccttcaggcctctgcttcagtccactttcttagaggggtcctccctgaccatttcatccccagaagtgctcatcacccccacctcattgctctttgtaactccctctgttcatttccttcacagtccttctgatgagccacgattattttgtgtattcactttttcacttttaaatggcctgcttctcaccctggattgtaagctacacatgacaaggacagggacagcatctgtcatgcttatcaattgtgtatacagaacccagcctcaagccagacacagagcaggttctcgatacatatttgatgaataaattgatgggaacatattttaaattttgtttttgccaggtgcagtggctcacatctgtaatcccagcagtggctcacatctgtaatttgggaggctgagacaggcggatcacttgaggtcaggagttcgagaccaacctgggcaatatggtgaaactctgtctgtaccaaaaatacaaaaaaaattagccaagcatgctggcgcatgcccgtagtcccagctactcaggaggctgaggcaggaggatcacttgaacccaggaggcagaggttgtagtgagccgagattgcatcactgcactacagcctgggtgacagaatgggactccatcttaaaaaaaaaaaaaaaattctattttccttcatgtctatcaccaggatgagctaacaataaaaactctgagtttcttcactttctgtttcatgatcctatctgctaagtttatgttcatcagttctaacccatttcatttgtgttctgcatgaaggctcaccaaaggacaaccacagtcacaaaggatatcacaagataggaggacaaagtgacatgttctgttgatgtcaataagcctctttatctggtcaccccagtgctcgctcaatgggcctaggtactcagtggccatggtggcagggatagaagctacacatgggcttaacccagacttcctctcacgaaggctggcctagctaaggccactgctgactgcctagtgacactcttagaaaatctctatggcaataatattaagataacaataacctggtgaaaataacattattttgattatcaaagtccattggatcaggtcatagataaatctatgtttaactgaattctgtgccataattggtttgatcatgctctaaggtatttatcttattggtgcatttatttaagggtgtcctaactaattctatcactgtcaatgttgtttactttaaactttttaattgtctttgtacttcagttagcacagttaggcaaacccagagaccaacactgagtccttaatatggcaccataccctggaggagtagccagttacctgggggaagatcaattacattagaccccttccatcatagaagggacagaaatcagtcctcattgtaatattctggaaatgaatttgccttcttggtgtacaatgcttctaccagcactaccttatggactcacagaatgcctgatccactgacaaagcattttgacagcattatgtctgatccaggaacttatttcacagcaaagtaagtgcagcaacaggcttctgcccatagaattaacaggtccttacccataccccagtatctgaaaggaaatggcccaacttaaaggtagaatggtttactgaagactcagttatattgctggttaggagacaccaccctaaaaaaatgggactctgtcttacagaatgaagtagatgccatcaatcagataattatatggtgctgttttctccagcaccacagaattcacgggcccagcaatcaagggtggaagtgggaaggtctgctctcactgttaagacattcacagaatattgtcttcccatcctgcaactttgagctctgctggtttccacatcttagtttttccttccactcattatattatatgagttttattggagattaaatttacagtttagtctttagataacagaaaactcagcttttaaggaattaacagaacacaaagatagatgtgatgattgctgagattttttgacctgattttgggattagggaaagaatgttttctcaattgtacaaaggatagttgcatcttacaaggagaagacagttgttttgctgttgtatggaaattcaaatatgcatatgaaggaaataaaaatattttacccccaaatatatttatttgacatattttgagatcgctgacagagagccagcaaacagaagtggccctgcaaagctgtctgttgtaggggaaatttgcatctatagagaatctgcattaatacggccaggctttatccatatctaggaaagataaactgagtctgacaccttaaagatctgaaagaaacatttacctgactatcctctctaagggttggtacctgtgaaatttcagctatgatacataacaagaatacctttgctagccaagcctcctcctttctccttcctgtaagttgtcttgtcactaaaacctaatttgccaccataactgttttggttgcttttttgttttgttttgtttttgagacagggtctcactctatcacccaggctggaatgcagtggcatgatcatggctcaccacatccttgacctcctgggctccaatgatcctgcctcaacctctccagtagctgggactataggcatgagccactgtgactataggcatgagccaccagcctggcccccaaacctgtttttggccatgctctgagcccatattatttctgcaacttcaagttagtatataagcttctgaacctcttttagggggttgggtctttattctgaacgctcccacgtatacacgttaaataaatttgtatgtcttttcttcgattaatctgccttttgtcagttatcagggaaacttcagggggccaagggccttgacccctacatataaaagtgtaggtctggatgcccagtagtcaaagaggtgacctgggccactaattaagttactctccctcagctacaaaccctgtatttggctgggtgacattggggccaggactctgcaaaccaggcttctgctctgccagctgctccttgctgggttctgccaattagtgatgctatggggaaagctgcagggtgggagagggaacaggtacttgctccttcctggtttcttcttttacattcctgcaaaccccctgccactggcagccacagtgccttccccagcagcagtgaactccagtttgccacactgtcaatacttgcagatacaccctctttgcacctcattgcatccctgcctcagaagtctgcatattagacccatagggccctgcctctgagctcagaggcaccagcatcagtgcccagcatctctcctctgagggctggtttttctttgtgtgcctctaccctcccttaaactaagtttaaataattccaacctattccctttgtttcctcaactctaggggatgggggctgctgcccgtcattgctgcctatatgatatcttaaagttatccttttacctttgtagttacccagttaactactttatatattgctaacaattcttgatgttcgatcctctgttcacataacagactggcttctgtttcttgactggcccttactgatccagtaaggcatcctcatcaattaggggacacaggattggctgaccagaataggatcatttgcacatgaggatgttctgatcaatagcatatctagagcacccctccttgatatcctggaatgtgaaaattgaccttctgtgataaaggctgacatatgtacagtaccctaatatttataacacatattcacaaattatctgaatcaatccttagaagaaccctgagagatgtagcaaggcagtcaaatatatccgctttggagacacaaagacttgagtgcaaatcttgcctcaatcaacccactcatgggatcttgggcaaattacttaaatatagtttttacatttcctatttccataggttttggggaacacgtggtgtttgtttacatgagtaagttctttagtggtgatttgtaaaattttggtgtacccttcagccgagtagtatactctgaacccaattcataatcttttatccctcaccccctccccatcctttcccctgagtccccaaaatccattgtgtaattcttatgcctttgcatcctcacagcttagctcccacttatgagtgagagcatatgatgtttggttttccattcctaagttacttcagtaacttagtctccagttccatcctggttactgagaatgccattaattcattcttttttatggctgagtagcattctatcgtatatataccacaatttatttatccacttgttgattgatggacttttgggctggttccatatttttgcagttgtggatcatgctgctataaacatacgtgtgcaagcgtcttttttgtataatggtttcttttcctctggatagatatccaggaatgggattgctggatcaaatgctaaatctacttttagttctttaaggaatctgcacactggcttccgtagtggttgcactagtttacattcctaccagtagtgtagaagtcttctcttttcaccacatccatgccaacatctatttttttaatttttaaattatggccattcttgcagcaataaggtggtatcacattgtggttttgatttgcatttctctaatcattagtgatgtcgagtattttttcatgtttgttggccatttgtatatcttcttttgagaaatgtctattcatatccttagcccactttttgatggggttgtttctttcttgctaatttgagttccttgtagattctggatattagtcctttgtcagatgtatagatggtaaagattttctccctctctgtgggctgtctgtttactctgctgactattccttttacttaaatattttgatccttactttcctcttctttaaaatggatgctgtagcatcacccaccttaggtctcttgtaatggttgagagacagaaagtatcattcagagagagatcataaagcacttagcatattgcctcatgcaataaatgctctaaaatgtttgctactgtttcatgaatgagaaaagagggaactgaagagctgaatatacttgcccaaagttactacatgaggcatccaggacttgcacttgtctctttgcactcaagttacttcccactgtttcatgtgtgacacagttcttctggaagcccctctatgaggggtgcaggaccctggcctgcccaggtacgatgttttgtgtaggcaacactttacacttagtttctgtctgcaaatacctgctcaggtgcatctttctggtaaacatcagctggtccaggcacaccaatgtgggtgtgactcagggctcgtcttttgccctgtgggacctcaatttccttaagtagagtcatcatctcccacattagtggtggttcttattcttgttcttgttcttctccttctccttcttctctttcttattcttttcctcctcctccttctccttcaccttcttctccttcttcctctcctttcctttcctccccacttccttttttttttttttttttttttttttcagacagggtcttgctttgtcacccaggctggagtgcagtagtatgatcattgctcactgcagccttggccttctgggctcaagcaatcctcctgcctcagcctcccatgtagctgggactacagtcacataccaccatgcccagctattttttttaaaatttctgactgataataattttgttttttgtcactacggctcaagcactttatttttacttcagtaggtttttggggaacaggtggtgtttggttacatgaataacaagttctttcatggggatttctgaaattttggcacacccatcacccaagcattgtacactgtaccggatgtgtagtcttttatccctcacccctctcccaccctatcccgagtccccaaagtccatcgtatcattctcatgcctttgcatcctcatagcttagcttccccagctaactttttaaaaatctgttttgtagagtcagggtctcactatgttgcccaggctgatcttgaacccctgggctcaattgatcctcctgcctcagtctcccaaagtgctgggattaccggcgtgagccactgtgcctggtgtccgtggttcttcttagctctggctgcactttagtatcactaaggaactttctttaaaacaaatattgatatttgggttctcacccccagagattctaatctaagtgaactgaggtgtgacctagacgtggtcattaagtaaaaaacccttggagtctactgtaaagtcagaattaataaacattgttcatcaatgtgcccctgggtcaaatctggctgatgacctgtttttgtaaagttgttttgttctgagacagagatttgctttgttgcccaggctggagtgcagtggtgccatcttggcttactacatcctccgccttccaggttctagtgattttcctgcctcagcttcctgagtagctgggattacaggcatctgccaccacacccggctaatttttgtatttttagtagaaatggggttttgctacgttgaccaggctgatctcaaactcctggcctcaagtgattcacccacgtcggcctcccaaagtgctgggagtacaccgtgcctggcctgtttttgtaaagttgtatcggaacacagacacacctatttgtttacatattgtctatggctgcttttgtgctataaaagcagagctgagtagttgcaacacagaccacgtggcctgcaaagcctcaaatattcactaattgctcctttacagaaaatgtttgccaacccctattctacaagtctgtatgaactctatgggtcctctatctctaccatgctatggatctaagattcctatctgataaattaaataatataaaccacccagaggagtggctttcaaactttttaggctaagacctatggtaagaaatatatcttacatctgtagtggtttaaaacacatgtctacaaagtctttgatggtcttcccttcaagaggtggagcttaattcttcttagtatgggctggacctggcgacatgcttctaaggattgtaattcttcagcagaagtgatggtttgtgacactgaaaacttggtcataaagaggcattttggttttcatcttggtagctatctcttggattactcaggttattaagttagataatgcaggtcggacatttagcattgtgtttggtaatagtaagtgttccttaagtaaaatcttagttctcattattacaatggtcttaacaaaatccctaatagtgagtcatcctactagagatgatatgtacattttatagggaggaattggggacctaatcttatgactcattggtgacattaaagtgagaactctagagctgacaccctaacctctgtttacctcttgccatacctcaagaaatgcacttgcacttcacgtgctttgtctcccttaattgtcacagcgactctatgaaggacatcccattcttatgctcagtttagggctgggaaaactgagcacaggatttttaactgaactcaaggctgcacagttagtagtagaagcagcatgggaactgtctcagtcagtttgggctgctatcacaaaataccatagcctgggtggcttataaacaacagaaatttatttctcacagttgtggaggctggaagtctcagcccaggctgccagcatggtcaggatctggtgagtgcccccttcaggcttgcagatggccaagttcttttatcttcacaagatggtggaaagagcaagagagctctctgctctctggggtctctcagaagggcaccaatcccattcatgagggctctattcttatgacctaattatctcccaaaggccccacctcataatactatcacgctgaacgttacgatttcaacatatgaatttggggggagggacacaaacattcagtctaaaacagaaacccttagttggatcccagaaactgccgttacacccacattactcttttaggacaagaaaaagagggaagcaattttggggaaccatcattactgctgatgtcagtggttgtggggattggggctgcaggactgaagatcccaatacatgggctgaaagccaccccacttaaggtacaggtatgaatggaatgtggataagagcactgcttctggactatgacagggaactctgtgaccactgaggagtctctttccaaagcccaagggcaaagtgatgcttagaaaagatgccctgtagtcccagctactcgggaggctgaggcaggagaattgtttgaacacgggaggcagaggttgcagtgagccgagattgcacaactgcactccagcctggtgacagaacaagactcagtctaaaaaaaaaaaaaaaagaaagaaagaaaggaaaagaaaagaaaagatgccctgtttgccctctgatttcaaagcacctgcaggctcacacctgtaggcactgcctcagggcacagatgtggttcagagaaagatgccttgtagaatgactatgaaccaggtagagccttctattccctggaagagcatggtttgctcatttatccatagatctgtgaaaggaaaacaaaaactcaggaccccaactcactatgtcaaaaggaaaaggttaagctgaatgttgagtcatgcaagaaactgcttttccttttattcctaagcagatagctatagattaaaagttaaatatctccacaggtagctactctatgttcagcttaccttatgtaaaatgcttatttaccgagtgccagatgtatacctaattgactatttccctacctgcttcttttatcctgcaacatgaggattcagtaatgctaccatatcctcgccttttcccctctagtctgcttttcccttttaaatactgaagccctcaaaatcatctttggagaaagtcacaaacctcttccagggcatgtccttaaccttggccaaataaacttctaaataaattcaggcctgtctcagatacttttgctttacagattcattgatgcatgcaaacatttgaatgcttattataagccaaagattgtgggagatacagatataaataaaatgtggcctctgccttcaaggagcatgaagaccaaggcttaagctgccagttccaattctaggaactgagcctgtcgggggaagaatgatagtggagttcaggcctgggagactctgcagggtgccacagaggaggagagatgtcagaagaccagttgagcagtatcatcaaggaataaatagattggtgatgatgggaacacagacaagggaacaaacgtgaaatgttaaggactcgatagtaccgggtcactgactgcatggaaacaaaggaaatgttggagttactgggatggttttaagtctgttctggcaatctctgtccagtagaactttctgcaatggtagacatgttttatctgccttcttcattatgacagctactagtcacacatgactatggaacagttgaaatgtggctagtgcaactgaggaattaaacttgcatataattttaattaatttaagtttaaatcagttctgtatgggtaggggctaccatgttggacagcagagttctatagttaagcactttacatgaattacttcatttaatcctcacaatgatcccatgcagttaggtatcaccattagccccatttcatggaagaggaagctgaggcacagagaggtgaagtctcttgcccaggatgacatagccagtaagtgggattttagctgagatatcctggtgccggagcccatgttctcgactgtttcataattatgtcagaattctgttcataagcatctttttacagatataagcaccattataaaacaaatatattattaaaaacttgtgagattttggaactagaattatttacaagctattaatgcagtttactctttaaataaattcatgtgtgtacgcccttcaactctttgagaaatctatgaacatttacttgagacaattcacatctctagctgaacgacccaatgaatgaataaattctgggaactccagatgcttttctaccagaagtcacttaatccagggagggagctcttggtaggaatggagaatggtccttagttaatttaaggaaaatcagtgggtattttttgacttctagtgtagggaattggcattagagctcacagccagggactctgttgtgtggatttgagaatgcttctgggaacgtctgtctacagtcctcaaatattgctgacatttggcctgtcctgccaggaagctaaaattgaattctaacgccagttttttcttcagtgggattagtggcaagttgaagagaaaaatcttagaagtgacatgccctgaggagggagttagaatgaatcatgagctctaaaatagatttgaaccagtggctcctagggtaatgtggcacagctacaggagaccagcaaaggtcacatgatgtgttacttcaggatgaaaagaaggcaaatcatgctgagatgaaatgcctggttgtattttcctttagttgaaaaaggtgtaattttgaaagaagagtaaagatccccaatgcagcagtcggcacataaaaaacaatgttcaatccagttgacttatcttcatagcaaagcatgttcctctgaaagttccctcatctgtaatagggtgtccacaaatgaattcctggaatgtagggaatttttagtcaagcaatgtcaactcaccatgctgcaggacttaactctgacttcattccttcctaccaccagggatattaagtactccatgtcaggcaagattttaggtactggggacatagcaatgaatgcgtcaaacaaggtctgtgcttacttggagcttacattctagtagggggaaaaaggcaataaacaagaacattagaccaagaagaaaatttcagataattacacttgtgttgcagaaaataaaatagggtttgagacagtagtttaattgcacaggggcatttctcctggcctgaatgacagaaggtaacttcattcttcattaccctcacagaatattccttccctgctctctgaatctgttccaccaatcactcctggtaaattatagctgtgagatgcttgtctgtgctataatcatgtgagtataaatttgactttgatttgattcaccctgttgctcacatacgatttaatgatatctaaggaaatttggtggtatccaatggggctctatttacttcaactaccattttatttatttactttttgtgcccccaactagaatccctaatttggtctaccttttacctggctggcttcctttcttctgcccactctgcattggactttgtcatgatgatggatttgctacactgaagttgaagttatcatcactgacaaatgctagggattatttgggatggtttattcctcttgtataaggtaaataacatcagtcagccatagcattactggaagtataaaaaggtgccatcaaattttatcaggtatggaaggatccagtatcaaacagcacctgataatttctgctttttcagaattcgtaggcattgtgtagactattttctgacaactttccaaatcaattaacgaatcacagcatggaaagatctctttccctctctttgttgtatcacacctggaaagcaccatatgggagaatgcccccaatggagtcaacaaagtggaaagatcaagtgcacaggaacacccctcatcagtgaaccaagcccaccatacctgcaccttgatgatgcttgggattccagcttagccttaaaagtaacctgggttaaaagtaacattccttcaagtaagacagaggaggggctctgggagacactaatggaactggtttcatttgctgtgccctcacttgatgatagactttgagtaactctctcaccatttgtgtcctgtgctctaattgaagaaaccaaacagtgtctggggtgaggtcatttgagattcttctctccctttcgaggcagtaagtgtccttatcctataggtagctcccacaaaagacaaactgaggaatcctcctttgcccacagatatccatctcttccagcatctttcctcagttgctcctcatttcctagcagacaggcataacaagggatatcccaggtgcgatggttaatattgagtgtcaacttgattggactgaaggatgcaaagtattgttcctgggtgtgtctgtgagggtgttgccaaaggagattaacatttgagtcagtgggctgggaaaggcagacccacatgcaatctgggtgggcacaatagaatcagctgccagtgcagccagaataaaagcaggcagaagaacatagaaaaactagactggcttaatctccaagcctacatctttctcctgtgctgaatgcttcctggcctcaaactttggaccctaagttcttcagctttgggactcagactggcttccttcttcctcagcttgcagatggcctattgtgggacctcacctttgtgattgtgtgagtcaatactccttaataaactcccttttatatatacatctatcctattagttctgtccctctagagaacactgactaatacactgggattctcctccattcctttctgctctcagcagccatggtggtcttttgaaaacatatatcacatcatgtcatttgcctcctttaaagctattctgctgcacttaataaaacccacatggttagtgatggcgtccaaggccctgctttgtggctcctggcttctcacccaccctcaagtaatgttgtcactatctgggctgccaccctcggggttacatggcttctgacagcttccagagtgtggcagctgcttttccactttagggactttggtaggcattccttttgcttgggattccccagaacattgcttcctttagataaagacttgaatggcacctctctaatgaagcctaccatgatgtcctcatcatagtaaattttctgccaccccaatattattctcagtcactacaccttattaacataatttgtgattgtatatttctttctttacacatgtattgcctttgtccctattagcttgcaattacctttactttcctcattaatttgatcacggactttgcagtagggccctttaccactcgtgaaggtggaggcctccctatcttgaaataggagagaaaagaactatatgggtttgctgaaactgctgtcacaagtaccactgaccgggtggcttaaacagcagaaatgtattgtctcccaatactgggctggaagtccaagatcaaggtgttggcagggttgcctctgaggccacaagggagagtctgttctgggcctctccctagcttctgatgctttggcagccacccttggtgttacttggcttgcagaattaacaccctcatctttgcctctgtcttcatatggtgatttctctgtgtgtctgtatccagatttcccctttttataagaatatcatcataatggattagggctgaccctactggcctcatttaacttgtttacctctgaaaagacaatatccaagagtggaataattactggggactcagaagggtggaagcggggtgagggatgagaaactacttaatgggtacaatgtacaccactcaggaaatggctacactaaaagcccagacttcctcactatgtaatatatccatgtaacaaaactgcatttctaccccttacatttatacaaaaaaaggattctatctccaagtaaagttatattctattaccggaagttaggacttcaacatatgaattttagagcagaggtccccaaccctctggccacggacccactaccggtccttggcctgttagaaaccgggctgcagcagtgactgagcattacctcctgagctccacctcccaacagatcagtggtgacattacattcttataggagcgcgaaccctattgtgaactgcacatgtgagggatctccattgtatgctccttatgagaatctaactaatgcctgatgatctggggtgaagcagtttcatcccaaagccatcccctgcaaccccgggtctgtgaaaacattgtcttccacaaaaccagtccgtgatcccaaaaaggttggggagcactgttttagggggacaaaattcataggactacatcaccattatatccataacactcaacacgatgcctaacacatagtaagtactgaataaaccctttctgaatgaatgaatcaaaagctgatagtgggacctgaagggaaaatactggattggcaagttttcataaagttgggtgatagaataaggttgtgttttccattatgtagtcaatggttcactgtagctactgagcacttgaaatatggctaatctaagttgagttgttattgcaaaatatataccagagtttagactttaaaaaacatcaacataagaaaacacaatataaaatttcttaatttttctactgaccatttgaagtaatattttagatatgttaaatatgttactaaaattaattttacctgcttatttttttctctaatggagctactaggaaatttaaaatgacatgtatggcttgcattatatttgtattgaacagtgttggtataaggagagtttggagcacagacacagtactgtttttgtttttgtttttgtttggagacagagtctctactctattgtccagactggagtgcagtggcatgatcttggctcacttcaacctctgccccctgggctcaagtaatcctcccacctcagccttctgagtatctgggaccataggcactaacaccatggccagctaatttctaaattgtctctagaggtgaagtctcacctgttacccaggctggtcttgaactcctgagctcaagtgatctgcttgcctcagcctctcaaagtgctgggatgacaggcatgagccactgtgcctggtctagcacaaggaagtgttaaagtggagagaaaaaaaagccaggaaataacaatgatgttatttgtatatgtattatatgtatttgtgtgtgtaacagtatgcacgtgtatatagtactgttgatgtatatatatgtgtggatatatattttagtacatatccaacattgtgctaagtatatgcaaacccttaatttttatgatctgatgtgttaatattattattcttatcctcatttcacagatgagaaaagtgaaacaccaagaggttgggtaacttgcccaaggttactatatgtagagatgaaaactcaggcatcctgtcccctgagccctctcctacacgccctgcttcattttcatgagagagctatctctgtggagagggtaaaacacgaagatgggctgagttggggaatgtagaaatctgtaggagaatcctatctccttcccagtctttattaggagagagccaaagcagacataacaaagaagctgagccaagtcgcttgtgaccctgctataattgcctccactgtgggatcaatgaggaagccaaatgctgagcagctgtgacatctgcagtagctgaacaggataaagaaaggggtaggggcggagtaagagcatttcgactttcagggaagccttgggactggaagtcaagcagaaagcaagtgcagacacagaacacaattagctactggagcctctctctttgcaagggctccaccctgggaggaggctctgtgcaatgtgaaaaaatgagctcccatgctggaacaccttccttttcactgcaaaggcatttgaaggtacttataagagcctaattctaacaacagcttctagattccctgtcccaacatctgacagttaatactggcttcatttagggtacctccagctctggctcaaacaaagggtgtggcaagcaataatctgacaaattgggtcactccctcttctcttcccctaacactaactttcctcagggtcaagcagaacaaaaccacgtttcttcatgcgtgatcagactttgaaaagtttatgtagactcttagaattgtagaaaatgtgtggcaaagctctggttcagggtgcagggctttacttttggagaattaaagagacatgtgcttaaatctccactccctgattttattaactgttggaccttggacaatatttttgttttgttttgtttaatgtctccaatctacagtttcctcctgtgagttttctttagtacatacccttattgggttgttgtttatcattcacttagatactgtatacaaagcacttggcccagcaactcctaccttcagtagctatttgttgctctcctactatgcgttaggcatatgcccgacctagcttatttactgttcccttaagcagattcctgaggcctcagtccagacctattgaatcagaatctctgggtggagcctggaagccataatttcaacacgctccccaagtgattctgaggatggacactgaagatggaggaccactgggttttatttttattttatttatgtatttattattttttttgagacagagtctcattctgtcacccaggctggagtgcagtggtgtaatctcggctcactgcaacctccacctcctgggttcaagcaattctcatccctcagcctcccgagtggctgggattacaggtgcctgccaccacacctggctaattttttttgtattttagtagagacagggtttcaccatgttggccagactggatcacttgaactcaagtgatctgcccacctcggcctcccaaattgctgggattacaggcatgagtcaccgtgcctggccaggttctatgttaatatctatgttaatatctaataaagtaattattactttattccgttaattaaaagtcttgagaacagagattatttttctctctgtcctcactacttagcactgaaatctccgtgaacttgttgactgagtgaatgattccatctcatgaagcgtctaggtggttctcaatcctggatgcacgctggcctcaactggggtgggggaggggcaggtgtttttaaacaaatactgattcctgggccctggcccagacaattaaattagactcttcagaggtggggccagaaaactgctatttttttaaaaagttgagatataattaaaaaaaaaatctgagataaaccttgggaaagttaccgaacctctccatgcttcacgttcctcataagctcaaatcttaaatatataggtcaatgaatttttatatatggatccacacatttaaccacaggccagatcaagatgtgtaatatgttcagccttctagaaggccccctcatgcctctctcagtcagtaatatacattatccctattccctcccactgagagagttttaaaaactccccaggtgattctgatgcacagctagggctccgagtcaccaatttagattctagaacattggacttcccacctctgccacctcccaccacatttgtgaacttgtctttgggcaatttcttcatgaggtgataaagaataggaaatagtaagattaatcttaattaaattaattatcagagcaaagaggaaattaaacactcaggctaaccggagcttattatcgctgcctcctccccgtgcttatcatttcttttaattcctgtcttatgacttcctctgtgcctattccttcaggatcccccagtgaattgctacctttgtgaggtttgtgcccctcccccagaagccagtcactgttgcttctgtaacaggaaagcaaacaataaaaagcaaagcattgggatttgtaatttctttggggccaagaattcctcagtacagtcctatttagcttatagacctcttttcagtgtaaggttttaaaatgcataaaatatatgatattataaaggcatccaattctattgatatacatatatcagaataattttaaacatcatttttaataataggtatttatttattcattaaattacaagatctagcaacaaacctaatatctatggtaatctggtatagtgataagtgtaaacagtgtttcaaggtatcagcagcaattgttaacacgatataaatgtttctgctagtattattttggtttgttgcctacattcataactgaatgaaatgttacatttcaggtaaaggttagtaaaaataaagatgcaatttgattttcagttgaattcatggacctcctaaatataattcatagactcctccaaaatacccctgaattctttgtgtaagatagtttcaagttcttgtctaattgctatttttctggattatgagccttagctagtgagagtgattagcttggccagcttggtgattttccctgcaagggagctgagataggaaggctgaagtgattgtccactggtagctgaaactggtaggtaaaactgaatcccaagtctcccctcaggtcaacactcctagcagcttggttatgatctgatcttttgggttgtagcaggtttgctcatttcatttgtttgtttattgattcattcatctatggtattgctttatattctaagagctatatgcatgactgaacaatttagtatccttctgttacctcactaatcccatcgtggctactcaacagcaacttaaaaaaccaacacaatcctgagtaaaagcttttcagtccttctaaaacatctagaaatacatatttataaaatgggatcatactgccaattttctgcaacttagtatttacactttaaaatatatattttgacatctttctatttcaggagatatatacacttctttaatgactacacaaaatttcaacggtattgtatgaaaattttaaacaacttaattgatggcattttaattgttttaaatttttttgctattaaaaataatgtatatttgtgtatatatttctttgatcacacatatgaatatttctttaaagaagactactagaagtgaaattcttgggtcaaatggtattttttaatttaattttgatagatcccatcttatttgttctccagaaagactgcctgtttctattccccccagcaaggtgtgagggtacaagtcccctgcacccttgctaacacggatattggtagtctttattttaaatccttccaataaggcgaaaaatctgatactgctgtcaaatattcatttctttgtgtactcacaatgttgaaacttttttcatatgcttgttgcatgtttgtacttattcaatgtttatgccctttgctcattttctatttaggttatagatgcgtttcttaaatgatgaattaaaaatgaagccttgttgttcacctcttaatgtcgtttctccagcttgcatccttaatttaattagctaagagttgaaacatttgctatttatataaaatatgagcagccaaaaatccttttggaatgaggcagggttataaataaaatgcacttttaaaaatatgtgaaacatggttgtgtgtaacttgcctcagttcttccctttgattccactggagatgtttggcactaaaatctgtggatttccctgagactttgacaactggtcataaattgtgctctagggcagtcctctgacttagcttggtattattaccaccttttgtgagaggaggaacaggccagaaaggttaagactgaaggccatatagttaatggatgcaaatgagccagcctcaaacctggccaattctgagaattctagagtaaccacatcaggactttctcatggtgaaggaattgctaatgattatatagccttgcagcatggctgaattgttgctcattttctcttttatactgtaataataatactgactacaatttgctgagcttttaccaaatgccagatattgtgaacattatgtattaacttctttaatcctcattaaaactctgtgagataatgtgatgggagtttgttttggtttggtttttttgttgcccagaccatttctccttctcctggtaaaggactaccatttctttcagggggatgacctcttcctcactgtatttatttgtgtcggtgaggtaggaggtggggctcagggtccagaccagattgaagactggctgaaacaaggaagagacaaaaccacctctccataagacatgcccaccaaggccttgtcaatttaccattgccatgacaacacctggcagttatcaccccttttcagggcaatgacctggaagtggccaactttttctagaaatctctgcatgatccacaccttatttggcacgtaattaaaagtaggtgtaaatatgactgcagaactgcccctgggctgctattctgggcatactgcctgtgcgttagccctgctctgctgctgctgtaccctgccgcttccattaaagttgctgtttaacaccactggcttgccattgaattcttttctgggtgaagccaagacccctcctgggctaagcctcagttttggggctcgcctgccctgcatcagtgggacctgtccattaaggagccttgtcaaggagtgatactgtaacccagccctggtcagtgtcactctccagggacttggaatctttcctgttggagctgatgtttctcaggggttgtgccctgagatcattcattcctgctacttatagccttatagccacctgaatttctgccttttctgaacctcatatgcagctttttaaaaaaatttctctatattctttatattattccaatacctcgacctttggttcaatcaacctcagtatttatatagtattattagccccattttatagatgaggccattgaggctcatccaacttataaattaaggagctgggaactacaaaacatctgttcaataccaagaaactcttaaatgcaggtaatgtaaacaaggtcacagctagttggtacaaaagaaaagcaagcaagcagacaagcaagcaaaacatgttggtagtttctattaatttctctgttacaaagcagttgaattaaaaagtcattttcataataaaggaattatatatacattacataactttgcatcatggttaattcattgctcattttcttcatttttgtgactgggtactgtacatgtttctaatgtggagagatcacattagaagaatactcttcccttccacttactgttttggaactgctgtttagctttggtaaatggaggccagaaagatcatgggaaagccaattaccacacggctgtgattccaaaggcaaagggaagacatgagggtggggagcagtgtgggtgaagggaggaaggtcatttggtgtaaagcaagacatagaaagaagcctgcctgcaaagtatcaggtggttcaaaacataaggtactcacttagaagggcagaaaaagttagctaaacaagaaacactatttggcaaaattcacagatataaacaaaatatgattgggttagactcctaaagaaaagatgcctaggagcaaaatattactgtcattttaatattattgatgatgatctcctgccacatatgacacaaattttttctggggtcagtaaaagttttatttaaaaaaaattaagtttctacctatagactaaaagaggctcgagagagatagtacccaattcactatgtatgaagctcattcagagaacaatttaaatttaaacaaagtttcaaaaaatttccagatatatacaaaaacatggaaatgtgaccatatttgatagcagatgataagaaatgtttgtaaatttgttataggcatcataacggtttcctgcctatgactatgggtggttgttcttgtaaaagtgctgtcttttcaagatacatgctgaaataaatacagatgacatgatgtttgaaatctgcttcaaaatcatctgaggatggaagaatggggggtgcaaagatgaaacaagaatgaccatgacttgttaggtgataaaagctggatgatacctacatggggcttattatactattctctttattttagcacatgtgaggtatttagccaggactagaggtgcccaccaccactcccagctaattttatatttccggtagagatgaggttttgccatgttggccagccctatctatctatctatctacctatctatctatctatctatctatctgtattatatataaatatatatttatatatatttttgctggggaattaaacattatattacatttgcttgagtcacaaaagataccatattttggtaaaaaatgttttacatgaaccttagaaaacattgccacatattaacatatgcacattaaatatcataaatactataatacttgcagataaagtccttaaataatatttaagacatttcccttagttatttaaaataccacatatgacatttggaataccatcagactatgctaattcacgtttatcccttgcttgtggacaagaaaataatagattgtaatatgtggtaccacatttcaatttataatgattataaatctttttttttttttttttttttgagatggagtcttgctgtgtcgcccaggctggagtgcagtggcgcgatctcagctcactgcaagctccgcctcccgggttcatgcctcagcctcctgagtagctggaactacaggcacccgccaccacacctggctaattttttgtatttttagaagagacggggtttcatcatgttagccaggatggtctcgatctcctgacctcatgatccacccgcctcagcctcccaaagtgctgggatcacaggagtgagccactgcatccgaccataaatctattttttaaaaaacactttttttttgagacagagttttgctctgtcgtccaggctggaatgtagtggcatgatcttggctcattgcaacctttgcctcttgggttcaagtgattctcgtgcatcagcctcccaagtagctgggactacaggcacttgccaccagctaatttctgtatttttggtagacacaaggtttcgccacgttggccaggttggtctcaaactcctggcctcaagtgatccgtccatctcggcctcccaaagtgctgagattacacgtgtgagccattgtgcctggcctatgataataaatctagatttagtagagaatggtagaaaagtttctggaaaaatctagaaagcttagggttcagacctaaatgatagttttggcttggttttgtttttaaaaatgtaaagtcagacctttatgcaaactcagaatgttccatatcatttgcttgctacatggtctgacagatcaaagcactttgcccttttctgaaggtggcattacattagatactgtcacccaaacaagatgactttactgtctatatcaaaaccaaacctttaaaaaaatgacagaattgggacagagcaatgacatgatctttgtccttacatcacatttatggggtatcagaccaattaactgaagagtatatcggtcctccatcatctgctcattgtgactaacgcctatcatgtagtttgactgattttttttggttgaattagtagatactttggagacatcacaagatcttgaaaagctagtgttcctatcccaaatggaacagtttttctactttcctggtggtacacctgcagattctccaaatgttaatggttcataagatcaacgttaggaaggcagagataattaaaagactagtgaagctcacgatgtagaccattcaagccacccttttaatttttggttatttcataacttcttggtggcagggcagttttctctgtcagcaacagccacagaaaatctacatactggaatagattgattttgtaattttcctctatatgcaaatatctccatatcattcacctctcactcactacacccactacattgaagactagacagataaaacaaccaacaaagagttggattactagctcatcaccagccaagatgaaatcacatctgctagggctcagtacagaatcacatgctgttgtattaaacacatctttgttgaatgaaagataaatgccaaatggtctggtaacaacacaaatgagtcctgtggtgtttagcatttattacacaacccaataacccaatcatatctttggtcctgagctccgtgtatatttaattgtccacttagatatctaatcaaaatatcaaagataacttgcacaaaagagaaattttgactccgccctcctccaaaccggttcctttctcatcttcgaaaataacacctacattcaacccattgcttatatttaaaaacctgggaatcatgcttatttcctttttcccctcacattccatatctagttgagcattcttattggccttgtttccatattgttctgctgaatttgacagcttctcaatatcacaagacaccatcatctctcactgcatcagattcctacctggtctccctacatccacatttcagaccagtttccttaaaatagccagggtgatcttctcaaggcataaatgaaatcctattaccattctgcctaaaattcaccaatggtgtcctgttgcatccaaactcaccatcattaactacctgattgaccccattagatcctactcacctttctgacttcatcatttaccaccatcctccctgtcgcatgtgttcccacaacacatcacactcagtttcttcttgctgttccctctacctggaaacttatttcccatctagctcacggctgcctccttctcaatgtttatttcttgggccataagtcacatcttagagtaattttttttttctcttgaccactctagctaaagaaatcactcctcccttttcttgacattctatctattgtcttcttttacttatttcatagcccttactaccatctgcaatcttatttcattagtcacatgtttattatctgtgctttcttagcagaatgaaagctccctagtgccaagaacccatttatcacctttccagcaccatgtctgactcattgtaggtgctcagtacatgatgtcttggtgaatgaatgaatgaatgaatacatttttttaaaaaaatctactcatgtaaatgtttgagagaccactatgaaccaggaactttcttctgaagctacgtaggtcaaacaatttctacctgtaaagagtttctagactgttatctttgaactcaaagagaaatgaccagagaacttgctgtttttctgtacaggtccaaagggcaaaatctaagcttcttgtcttctgtagcatagccaggtggtattcctagaatgccagttggagaatcctagatgtttcctagttgagtaactattgctcagttattctcattcatgtgtagacatgagactggggtgggctcagtaggttgagtcagtttggcagcagatctataaactccagtcctctaaggttaaggagatgacacattctaatcctacatttctgaaagacagagtgcaacccacattcccaggagggaacatattgtcagccgcatcaggagcattttgctctctgcaggcagtggcactgctgtgcgtggatatcacatttccttcccagagtccgtgggaggcctccttgaatgtgagaagtgcaaacagagagggacacatttgttgtacagaagctggctccgggctttgggtttggagacaggctgaagatatttgctttaaaatgtcacaggtaaagtatggacctgtgactatagaacatttttcgtgaggggaaggaatcagaaggccttccaaacacagggactcctttgtgcattcagaggtcctggtgatgccgtctgggtttatatatcaatcccttaaatgagctgagtccctcaaaggcttcagatcagtagagataatgactcagatcctgaagagacctaagctgggatctgcatggcctagcccctgcctgcctttctggcactgtcttttatcatagccctcctgggccctgttctagccatacagactttctttcaacccctgtgacatctagacactctcctggcccagggccttggcacatgctgttccttctgtcctaaatgtttctcctgccctccctacttcacttagtgaaaacctactcatcctttacataccatactcaagcaccaattaggagaaagtacccctgaccccacagactatatcagattccgtcacagagctctgtttctttccttcagagttttaatctcagtgtacaactataaactccctggtgtgatatttaaattaacttgtgtcttcctcaatgatctgtatggtatgcagtgcaaggactttacctgtgtttgcttaccattagattctcagtgccaagcacagtgcccacctttagcaaggatttgttacatataaataattgggtaatctgcaaataagggtaatgcatccctggaaaatatacatcctgaaaaatgtagccattgcctaaggaaaggctcatcctaccattacaccaactaaatggccgtgatggtcattcatcattcagttgttaggaaaacatttccagctctccaccttctgggagcacggtaggatttgactacttttaaccttgggatttggtggggttacacgactacttctggcctatgagttgtgaacagaagtgctctgtgtcccttttaggctgaaagctgtattttctggtgaaagaccctccagagctttcttttgctctggcacagcgggagcatcatttgaaaacggggctgcaccatcagcctgggacataggataacagagtctctgtcaactgatgatggacacaaaacacaacaaagaaataaacacttctcttttaaggtactgagagtttgaactgtaaccacagtacaatgtagcttaccctgactcatggaagagctgaatccaaacttccttaatcaaaaagtaaccatagatagcaacaacaataataacaatcataaaaacttgttgaaaagttaacatgtgtcagacataggctttataggaattatctatttcatttcaacttcacaagaatgcaggaatggtatcaggggggcatttttgcttttgtttgtttgtttgtttgtttttttttgaaacacggtatcgctctgtcactcagactgcagtgcagtggtaagatcataacattgaactcctgggacttctagcctcaagcaatcctcccactttagtctcctgagtagctaggactacagacatgcatgtaccacactcagctaatttttagaaaattattttttgtagaaatggggtcttgttatgttgtccagtctggtctcaaacacctggcctcaagtgaccctcctgcctcagcctcccaaagtgctgggattacaggcatgagccactgcacctggccctagggaaaaacatttttaatttcagtatacagatggagaaattaggctcaaggaagccaagcaaattatgcaaaatcagcttgtttgtaagagatggggcctgattctgctttacttcaaagcccacatattgttaatcaccattctttccatattgtccattatattgttagtttttttttttttttttctttttgaggcagagtctcgctctgtcacccagactggagtgccatggtgcgatcttggctcactgcaagctccgcctcccaggttcaccccattctcctgcctcagcctcctgagtagctgggactacaggtgtccaccaccacgcccggctaattttttgtatttttagtagagacggggtttcactgcattagccaggatggtatcaatctcctgacctcgtgatctgcctaccttggcctcccaaagtgctgaaattacaggtgtgagccaccgtgcccggcaggttttttttttttttttaaaaaaaaaaagaagaaaaaagaaaaagtaaaaatagacattcaggtctctgtgtgaggaaagaaggcataaagtgcttctgctcatcagagcggctgggatctcaggatagtgggaccattctcccacaagagatttttgttggtgagaaaaccgccaggacccctaactgcatgtgcctaacaatactgttcaccaggggggcattttagccaggtttactcaggagcagattttatggaggaaattactttaccgtggaggagagtttgtccttgaacccagacaacagtaggaaagttggaaaattgaagttcagtgctctaagctgtgggtaggtaagcacacagatttggagaccaccgtatcaccgccttctaagagattcagaaaacactttaattggactgctgtgacgcttcctgaaacagacaacttccagactattctgctgctttacaacattgtcagtatctagtttgacagatctttccaacttagattcaacaaaaaagccaaacaaaacattaactattttcagttaataatcatttaaataatttatatgacaataattattattactattgccaggcactatgctaaaggctttatgcacattatttaatttaatttatttaatgttcacatcaaccttgtgaagtaggtactattttaaatccgcattttgcaaatgaggaaacagaggtaggggaagtttaagtaatcgcccaagtcatgcagccactagtgtcagatcctggttgtgaatcccagtctgggttcaaaacatgatgctaatgacaaccacataagaacatcaccacagtaatagaaagcacgcaacaaatattagctgtcaggtgctagaaactccactaaggatgcatgcatctcctcattcagtgctcataaccacctgatggggttggcactgtcattatagttgaggaaatgcaggcttggaagagttaagtatcttgtgcaaaatcacagaagcagcaaggggcagcctctgaattttcacttaggttgtctggctctagaatgctcactgtggcctgtgttgagcaaagatttcacacagaattagggagaggggcttcttcctacctctctgtggaagacggccatgccgacttggtgaggcaaaggctgcagggcacctcaaggctttgcagctttggaagtcccttcagacaggatcccggaagggagccagaacctttatggaggacagtggccacagtggtgtggtgaagaccaccctcaagtggcttcataaacaaggatataagcccaagtgaacatctcatgaacatctcatgaacatctcagaagtaactaagggagactcagggactggctgagatcctgtgtcacacaggtggaggctggagccagaaagtgagttgctgcaatgctttcacaggctcatttgcctttgagtaaatcaacttctatctttgctccactgaggaaaatctaagataaacagcttcttttctggcaattgtctctccaaccatgaccaaaaaagtatgacccaatagtttccataattgaaagagcaaacctgccctgcttaggcataaccacacatgaacagattgatccagcgtatagtttctcgacctcatcactactgacatttgaggttgggtaattgttttttgtgggggtgtgtctgtgtgcgtggtgggggccgtgagggtcctgtgctctgtgagacattttgcagcatgctggcctttggcctctactagatgccagtagaaaaacccccttacccccagctgaataaaaaactcacacatgtctgggagaggaaggtggtggtgtcaaaattgcccccagttgagaaccactgatctagcagctaattttattcattagttgaggacttaatatagtactaggctttgaggatggtaaagggtgcaagctggggccatcagaaagctcccagttttaagaaaaaggagcagatgttaaccacacaattatgggaataacttcttgtagaaagtgctacaagggaaaagtacagtgcctttagctaagatgaaaaacattcttaaacccagctgcgaggaggtaattcaaatcgactagatttttgtcaagagaagatgttgtaggtctccgatgaacgccagtagatactgctgaacccgagtgtgaccaggctctaaatcatcttaaactctaaagcttttccagttcagcggaccctgatgccagccttaaggttgcagacgggtagaggaaaatggacacagtgtagacagccttcctttcacgtaagagggcatgtggggctcacctctgctgtctgaatatacatgagctagactctactatgcatttgatctatcaagtagctgtcagaggactacacaggtctgggaataatgtactcagatgtttatcaggctaaataggaaaaaaaaatccactgagactgaggcaaggggaaatatatccctctaaaaataaacctgattttaatttcaaactgggtcagtttggcttgggaattattggggagtgtgtctgagccgctcaggagatgaagtggaacccttgctaatttaatttgcatatgctgcttaaaatgcgagaagcctgctgctctgagcctggcagctccctgcacgctgacactttgctggcttcctctcctgcctctgcgggctctgtctggagaggcactgaggtagccacgttctcagagaggtcagaattcagtgggaggccttggagaggctttgtctcagggccacatgcccaaggcagggtggaggaagagcactgggtggagggtgtcacagttcaggtggccttatgtgggcacttctgtgtccaagggagctgcacttgtggcttgctggtgcagtgagatgggcgccagctgtttccctgcaagcacttaaccttgatgtatctgcactcaggaagaatgctcaggagctcctccaaaacaggtgcaaaatagaaacagggatgatgctgcagcagggctcaaggtcctcactgactgcctctgctgcactttcattcaccatgggctctttggagaccaccacctttcctgtattccctcctccctgattttttcctcatccacatgtctacgagcttttatctcagtcactctcaaacctgcctcccttttactgatgaactcatcagctctcacctgagcacaattgcaatggcatgcagctcagaagttcccaggtttggggatttcatggactaagaaacaataacagtttaaaaacaaatgaatcaaggcacagacatacatttaattttgtctggtaatgacataaaaaaattcctactatttactatcctactgtgaacattatttcataaacaaaaggaattttagtgccaaaaaaaagtagaaaagcggtagtttccaaataataaagcattctcaagaaagtacaactgggactgttggtattctcatatatgtggtgttatgcgtcacacacacacagtctttaccttcctcatttagcaatgcatcagtgaaaactctgccaagaactgtcaccagcccaagggcccacacatgagaaccagcatcctcatttccccaactcatatttctctgttgctctccacgaaaccttcaaaagatagcttccgaaaaagacaaatctgatcatacctctccactgctgaaaaccctccaatggcccctcagctattctcaggataagcttaaacacacttggggaaatagatgcaaaatgatctgcttgaatttcacggctaattcttgacagagcctgggtttgaaccccaggcatgtctgactgtagtgagagtgctctgtgccagtgagccccaggctccccaggtggcctggccagcctgtctgcctgttggaagacttccagttttctgcctttgcttctttcccatacttctggactaccagcctcggaattcccaatcttctcctcaaaacccaacctcaacttctctctcttgcttcctttatcaaaaatctaaaatctagtagaactgtctcgaatgatgggaatagtccacacctgcactgtccaagatggtagttaacagccctaagcagctagtgagcatctgaaatgtggccagtgtgatagaggaattactttctattttgagtaaattttaattaaagttggattagtgacacatgactaatgattatggtactggacagtgcaggtttagacatttctctgtacatttaaatcctaacaatagtcttcagcccggatcaattatcccataaatgttcaaaggaaaagttagtatagcagggctagaccctctgggtttgaaccctggctcttgcacgaattagctctgtgattgtgaacagtttatttaacaactcagtttcctcaaccattgaagcaagaatgataatagcacccacctcatggggtcgtatgatgataaaatgaattattatgtgcaaaatatttagacattgctggtatacaggaaacaccggtacatttgctattattattatttacttagttcatactatatgggaagctcacaagcaagtctgtactaaccgctgaagaaaaatatgttaggtcttgctcctaaatcaatgttttagaggagtcaccctaactcatggcagcagtggccaagggaaacatttatcatggcattctacaggatcacagttgacactcagtgccttactagcaggcattatcaccactctccatttcaaacacagggtaactgaggcattgagtcataagcagtttgcccaaggtcacattgctagaacctgccagagtctggctttggacactaggctcatcacatggtggcaaaccgcctgctccctgaccactgagaagggaggaggctgacggcctatggttaagaatgctactctgaccaaaggcagagcatagaaggaaaagatgaggggatcaacagggtgaaggaggaacacagtagatatttttgaagctccatccttgggtaattgaaggatggagggatgagtagcctctgggcagtcactgtctgcagctattgttggtaactctggcctggcataaatccaccttgggaaggatgacaggcacaaagatgtccactttaggtccatggaagagcttttgaattcatctggttggaagaatttccttcatttctcctcatagcataagtaatggatttgtacctccttgactttcctatattcaaatttgtaataaaactttggttccagactaaagagtcataccccttggactgaatgaaaacaaccctgagttcctcagtagatcaggccttagccacaaatatcaggtggattgagtatctacctccttctgtcaggggccatggactcagtcctcactagaggagacatggaattatctctactaggaaacctaatttgctttatctttaattacaggaatccaagattgctcagtgtctggttatgcaggggatatgcgatagctttgagtgacccattaagtgtattgatcaattgctaataataataaaggattccagccaaaggaagcaaaaacactatttaccaaaagtaattaacccttctgcttcctaccaaccaataaaccctcagacaaaaattcttctttcttaatggcacagtaagactagtaaaactttccacaacagagtcaagttcttgctctattcaagtttccatctggtattggtaggcatttgggagttacatggacttgtacaggtttttgcacgcatctctttaaaaagaagtcattgctttaagatcacacgggtaaggtgtattttggaagtgaaaacaggaagcacctagactgtcttagattgctggtagctgtgcttattagtaaaaacaccttggaaaacttcttggcactatttactaaagctgagtatctatttatagatatctagatatctatctccagaattccattcctgtgcttctacccaaaagaaagagaattgagtgctagcatacaccgaagagcatgtataggagtatttcagaacaactttattcatagtagcttcaaactagaagcttcaaactacaaaccagaatactgcacagcagtgaaggagaacaaactactgttacctgcaacaatataaataaagctcatagatgtgaagtcaatcaagagaaggcagacacaagagggtagatattttacaatttcatttatatgaagttcaaaataggcaaaactaatttgtaagaacaggtttagttggtgagaaatctgtggagcattgttgattttacaggcccaatacccaccttttctctgattttgcagttgtctccatagcaatagtcacagactctaaaatgggtagcctcttcaacaaaaaaaactgtcattctcaacagctgtctgtgaaagtgtgcaatgcccttttaaggaggcacctgcggagatgtagggcttttcctcatttagaggaattattttgcaaacaataatactaatacaacactagatgagaaaaccatgggaggcctcttataaccattgtcttgagggacagaactaccattcacttagaagctaacatttccattctgagagtttgtgattcatctgatgggaattggataaaggaaatggaaattctgatgaagcttcccctcaaatacttagctcacttatacccagagtgacactaaaatgaaaatgttctggctgatagtcttgttctttttctgtaagttcaggagcaagagtaggttttaagaaatgacacaaactcaattttggttctacttgtgtttgcttagctcttatcagattagaaatggccatatatacattgcaccctttgattatgtttataactctacaaggccaatagagcatatggtactgttatttttcaagtggggaaattgaggcttatcaacacgaagtcgctgtcccaggtcaaacagctaatatttaggctgctgcaaaagtaattgcggtttttgcaattataagggcaaaaccgcaattacttttgcaccaatctaataaatgacagagctgaaactcaaatccaaaagggtctgtttgcaaagtccatgttctttctaccatctgggctgtttctcccagcaaagattgtcctcctctcgaacatctgcagggaggtggatgttatatgttccttactacctttaacaatctgtttacaacctaattaggaaaattttttctatatctaacactcacctcactttttcctaaaataaattcatttaatttttctggaagatactgagccaaatctcagttttcctttttctgactatatcttcatttccttaactttccccttcacaaataattgttaccaaaggtcttcagcacccacctcaaatatggcattgaaaactagagctggagcttgagggagattttggattcattgttgtttcatttccaaatgtaaatgttctcttaatgataataacataagtgactgagttatctcattctggaggcttcttggcaaagcctgactgcttgtgtttaatattctcagataaccccttcaaccaaaggaagaagaaagtgaaacatatctgtgttttattctctattatctttaaaataaatattgtaagcttgacttgggggcggcggaaaactagaaagagatgagcaagtgtgtttaaaaccttaagcagcttcttgtgtccactagggtggataactgcttgcaatttggaatgaaatccggaatccctcaaaaaacctgctgggtgaccttcattagttcacttttcacaacttttctcatctataaaatggtggtattaacactatctacttaagattatgcacacttatactaatacctggcataaatgctaatcctttctatcattacatgcttttgtatttaaccccttggccttagcatctggatctacttcaagtggggtggtgacagcatccaaaaggttcacattgctgactccactacctgatttagtgtgtcagttttcttaggacccaaattgatgcggagccattgctctctctcaatgtttgcagacagattttacttgtttctctgagcatgatcaccctcataatggaatgactaagggcttcttccaaatgctccaggaatggtggaatccattaagaaaaattgtcagggagtggaaggatagaaggcatttgcaaatgcccttaactgaaaccacaaaggtgcagagcaggttagaggggagatgacttgctaattcagccccataatgagagaaggtggtttgcacaccagccaaactgatttataaagtggggtctaagagctcagtctttaatatcagagagaccttggatgaaatctcaggtctgctactcactagagtggttttaggcaagttacttaagcattttgcatctcaatttcacaatctttaaaatgaaaagaataaaagtatttaccttattgggttgttgagtgagaattaagttgtctgatacataataagcataatccaaattgtagtcactatcacctcaatgttattattgttgttgttttctgccaagtgctgggtaaccttgtatatcctgcctttaacactttctcattctacatcaacaaggaagggagaccttctttgcatctgtggtggccattagtgctgcctgccaagtatttctggttctcgtctctgctgggcatgtggtaaggctatactctcagctctccttgtattgagtgagtctagttctggccagtgggttgtgagagcaagtgataccaaacttttggcataaagcatttaatttctggtttgagacctttcagagcactctattccctctggcatggcaattcatgatattggatacattggctgctctatcagccagagtctctgaagtagactgtgaatctgtgaagtatccgtgaagtagagtccttctgtcacttcatgacggtcttctttgtagccattgagatgatggggttgttgctatggcatatctggcctatcctgactgacgtcacattcctaccccggtccagtgcttcccaactggtggtgatttagcccctcccacatctcctggggatgtgtgacaatgcctggggacattttggttgtcaccaatagaaggttatgctactggtatctagtgagtagaagttagggatgctgccaaacatcctacaatgcacagcacagcccctaaaacatcgaattatccagctgaaagatttgggtagtattctagtcaaatactgagctcctctcagcccctcatactcctcaccctatctcacttcctatgtttggataatatagctggagtggcaggtacactgcagggacatgctcatttcttactaagcttctaagcttggtgacttgggtcactgtgagctaagatggggccaataaacattctgccatgaatattctgcaggccactccttcaaagggtaccttcagggttgcaccagactgggagaccagacactgcaggagaaataaaactgctttctcctgcagaagtctctttctgttcttccattgcaaagctgttacttttgccaatgagttgcatactttcctgacgtcttctggcaaaattgcacaaagaccatattctagatcatgaaacattttagtgtgaaggcttggaatggaagaggaatttggcatatgtatgagatggccatttgggcccaggcttctgacagtccaataactgttagcagtttgagttgaaattctaatagacctctttcaaagacattgattagcacaggtttaaaaatgacatgtccaaggtgacatgattagagatataactatgaccagaaacaagacatgctcattccctcatctttagtctttgtaaatctatgttggagaggagagaggtcttggtgagtgggtgttaaatacagtgcatagaggaattagtttggccttccaattctgatggccctgaagttttgattttactttatctgtatttcagtctcctgtataaaagttgtgatgagaattgtgaaggacatgtataaaatctttagtcaatgcctggcatgtagctgtcactcactaaatggtggctattacagcattgtgaaatttagtccttacttctgcagtggagggtggagctgagagggatggcatagaggtgtaaggctgctgcctactttggaggtataaagaagtctggagaaggcaaggtaaggagatggcaaaaatctcaaattcagtatcatgtgtgtgaatggtgtctcaccttccaaactgaggtagtccacatttgtcattgtggttaataacttgtaccccaaattagtttgctttgttggcatgtatactctctaatcccagaacaagaaagagtcccctatactggtgcagctctggttctaaacttctgaaaagccatcacaagtactagctctccaactggcaataattttacaaagcaaataaattgcaatgtgaggtaggaatacaatttgccaacacatatttcttgaggtgtattatatgtaaggcactggtgaatgaggagtgaatcagacaggctagctcctgccctcatggagctgacttcctggtgaaagaaactgatcatatgcaaaaaaaaaaaaaaaaaaaaaaaaagtaaagaaggaagaaaggaaagaaaggaaagaaagggtaattcgtgctgaaaacaaaagggcgctgggctaaaagcatggctccgggatcatgaaggccccttagaggtggagccatgtaagctgaaacataacagatgagaaggatgtaggggcagtgcattcaagggggaaagaacaatctagaaagagcaaacggcagacctatcagaactttcacaaacattgtctcattttgaacttcctcatagtcttgtgaagtaggcatttgtggtaggtagcttctaacaggctcctaattttctctgccttggtattcatgcccttgtgtaacctcttcttcttgcatgaggtctggacctagtgacttgctcctaacaaatcagatacagcaaaagccgtggaatgtcacttcagtgattaggttagaaaagcctgtgactgctgtactgcaaacagactctctcttgctggtacaagctgtcaagctggaaagtgtcacatggcaaggaagtgaagacctcagtccaacagcccacaaggaactgaatccttccaacaaccactgagagagcttggctatagatccagccctagttgggaggacagtgactccagccaacaccttcgttgcagcctgtgagagaccctgaagaagtggactcagctaagctgcgcccagattcctgaccctcaaaaattgtaagataagaaacatgtgttgtttcaaaccactatgtttcaagggaaagttacacgacaagagacaatatagcattcatgcacttattcactgattcacttattcaacaaacctcttttgcaatttcctgcaggccaggcaatggcctaaggaaataaacatgcaccttgcactctcataaactcatagagggaatgctgcacctggtactaaatgacaggacatgtgtactctgtacttttcctgtggttgtaatgtcttatggtggaaacaaatataagggagataatactctgtcaggcagtcagagaaggcaggaagtgaggagactgaggttcagagagggtaagaagttgccaagggtcaccgagctcctccgacacattctgctctgttcagttgtgatggagggtgtgtgtctatttccagtgcaagactattttgacctacaatagtcgatggcttttctcttatgctccctgataatctagagactatatgctgaaatgcattatttcttgcaaatgtaaactaggcaatgggttaatcagagttctgtgacaaagattaagcatacttccaattaactttcataaaccagaaatcaggccactctaacctaactcattactctgtatgcgtttgatcacagttggggtcacccatctctacacaggcaaatatgctggtgtcggagagaaaatgattgaaatgatacctcatgatggaatcaaattagcaacagaaattagttacatagaaatgtaatgaaggcaaagatgccagaagagcgtctatggatgcttcagaatttgaagaaacttgcctgagagatgagcctaatgttttcattttgttttaataatttgccaaatctgcaaacctagaaggagtctaattaaagttaatgagaaataatctccattttaaaagtcttaataattgatacttttgtacagagctcttgtacatttttctcctgaggtcatgaaatatattacattcaaacttcaaatttaaaaggcactgaaatattttgttttattcctttccttttttatctttcttgtcttagtttccttcccattttatgaggcatatttattgtgaagcatattttgtttatgaggcatacatatgaggcaaaatttttttaatttttacattttaatttgggtagtttttgaggaaaaggtggtttttggttacgtggataagtcctttagtggtgatttctgagatgctggtgctcctgtcacccgagcagtatacgcgatacccaatatgtagtctttggtcccttaccccaactcctacccttcctccagagtccccaaagctcattatatcatttttatgcctttgcatcctcacagcttaactcccacgtaaaagtgaaaacatgtaatagttttccattcctgagttacttctttcattccgttttacggtgagtagtattccatggtgtatatgtacaacattttctttatctacttgttggttgatggacatttaggttggttccataatttttgcagttgtgaattttgctgctataaatatgcatatgcatgtgtctttttcatataatgactcctaaaagggcgagctttatgggcacagtttgacgaatttttacctatgtacccattcataaataccacccaactgcagatatagaccaatgctgcacaaaagagctttctgtgatggtggaaatgttctatgtctgtgctgtccattttagcagccgcaagtcacatgtggctcctgagtagtagatatgtggctagtgtgattgaaaaactgaatttgaaatttatttactgaggtagtcgctaccattttggacattacagacatagaacatttccatcatctcagaagctccctggtgtacttttaaatcagtacttacccagtgccccctccttttccctctgaagtagccactattctgatttctattgccatagattagtttttcctgatcttgagttttatataaatgaaataatagaatacatactccttgggtttggacatttactctcaatacaatgtctatgagatttatcttttctgttgaatgtggcagcagctgtccttctttttaaaatttattgttactgtattctattgtatggctatgccatagtttgtccattctactactgatagatatttagttttattctaactttagaaataaaactgctacaaatattcttgtgcatatcttttggtggtcaaatacgctcatttctcttgggtatttaccaagagatggaactactgagctttatcctccccatagcaatgtagaaaacatccagttgcttcattgtaataaaattttacatttgaaacatggctatttgtaaagagtaaaatagttacttatattctattcaagggaatgtacaactaattgaaacattatggataatatccaataactaagatgcaattaccttatgtcccagtaattatacttctaggtatgttccctggagaaattcttatatatgtgcacaagaagtatttataacgcatttttttgtaatagcaaaaaaatacttatttcattaagtaaatgacggtatattcatattgagatatcacccagaaaaatagagctacatgcataaatataaatcaatctctccactttaatgatgagtcaaaaaagcagtggcagaaaattgcagttcaatatgatgtatataaagatttaaaatagtcaaaacactactatagatctgttaagtgtatgtatttcagtaatgaaagtattaagaaatgtaagaaagggattaacagcaaagcaataaatgttactctgcgcttgggggagattgagggaaggagacttcaactgcaccactacatttattcattaacctgtgtaacaggtacacaggtattgatactatattaggtatcattttgcatgtcttaaatattatataataataaggaatccagaaagtggtggagactgctaagcctgtgctagtatccattttaactcccttttcaatgcttgaatccctcaacccctacaagagttcaacccagtacatagctgcccagctagaactacacttctcaggtttgttgtaaagaaatgcggtcatgtgactgagctcttgccaatgggatctgagcagaggtgagtgcagcctctgggttatatccttaaaaggaagcatcttgcctatccctaccaccttttcttttctttgggctgaatatgaatgtgttggtggtgagacagctttggttgcatgcacacagatgatactgtaggagatgatagtgtaatgaaattgaagaactactagctcaggcttttacatcacagaagaataaagctctccgggtctcttaggttatagcagtttatactatatccagctattataatacagtcagctagaccagtgggatctaactgatacaactgatctccctgattaccataagggggaatcagttttagagatgaggcatgagaagtaccacaagactgcaaagattcacatgtggaggttgacaggttgggttcaagttccaaggatacctgtgttaccttgagccagtccttcacctgtccaggtatcattttcctcatctttaaggggaaataggaagatgttctccttgctttgttgtagagctgtgaagaccaaataaaataatgccaactgcctaacttggtataaaatctaaattagcatgaagagaaagatactgcacgacctgataccatttccccaaaacattattttttaaacaaattaaaaactcagttaattccagtaggttcataaagaattaaccacatgaacatattatttaaaatatgatttataggtgagacatccacagagcaaatcttggacacttaaacaatcatctggggcagtttgcatgcaattctcctagtaggcaaatttttaaataagcattttttataatttcttgcataaacattcttgacccataaattctacaactttctatcttactccagaaagaaacaaatacttagaataaacctaaggaaagtgttgagtcattatataggaaaaattaaatttccacctttatgttggttgtttctttaaaagaagttagactgaattagatagaaagactgaggaaacaatgctagaatatgaaaagaagtccttatttctttctagtggatttcttactatatcctgcatacatgtacaacttgcagaaatccagataccatggcgaacaattctatttccgaactacagatttattaaacttaaaaaatctaagtagctgggcacagtggctcacgcctgtaatcccagtgctttgggaggctgaggcaggttaattgcgaggttaggagatcaagagcagcgtggccaacatgatgaaaccccatctctattaaaatacaaaaaaaattagctgggcatggtggcacgtgctgtagtcccagctactcgggaggctgaggcaaaagaatcacttgaaccctggaggcagaggttgcagtgagccaagatcacgccactgcactccagcctgggcaacagagagagactccatctaaaaaaataaacaaaacaaacaaacacacacacaaaaataacccccacaatctaagtaaatcagtcatacaggaagccaaggtgggaagatcacttgaggccaggagttcgagaccagcctgggtaacatagtgccatccactgtctacaaaaattaaaaacaaaaacaaaaacaaaaacatagtagccaggtgtggtggcacatgcctgtagtcccagctactcaggaggctgaggcaggaggattgctgagcccaggaggtagaggctgcagtgagctgagattgcaccactgtaatctagcctgggcaacagagtgagaccctgtctcttacagcaaaaaaaaaaagcaaaaaaaagaaaacgtaaacagaagagtcatatcaagattctatagattctcatctttccttccactgggcaaatcagatctgtcagtctctcactcgtaaacacctaagagcttcttataatccttggagtaaatccaagctctgaggtatggcctaagatagcccagccttctgaatgtacttcctttccgtttctgtttggtctctgtgctccatccacactgatcttatgtcttggtatcctttgaaccaagcttattgctttgtttcatcaaaagcacttccttttccaggtatgatcttccccaggctgttccttcatttccatcaggcctctgctgaagggtcacaaaccctacagagacttctctgtctacataatctcaaataccaccattatcctctgtctcctcattctgatttgtttttctttatagcccatatctctgtttatatgacataatatactttttttttcttgttttgcccattaaacatcagttttttgagagcagaaatctcatctgttacatttgctgctatatcctcagttcctggaacagtgtctggtgtatgatagacactcaattcacattgaataagtgcacaattgaatgttgttttatcattaatggtgcatccagtcttacacacctattttcactctcaactcacgtttctatgaggttttgctgattttatggtaatcaaaacaacattttaagatggaaaagcagtgcctgcccatttcagagtgacataatgaagtagctagtacttcttgatgacaaaaggatcagagagaaaatatgttctttcctctgaaagatatgtgaaataacaaactagtgactctcaaaactgccaattaaaagcatgattggacttatgtttctacttttgctaacaatctctgaacaacaaaaatacttacacattaaaaaaaaattgatgcattgtgtggtgtctcatgcctgtaatcccagcactttgggaggccgaggcaggtggatcatctgaggtcaggagatcaagatcagcctggccaacatggtgaaaccccgtctctactaaaagtacaaaaaaattaactgagcgtggtggcagggacctgtaatcctagctacttgggagcctgaggcaggagaattgcttgaaactgggaggcggaggttgcagtgagccaagattgtagcattgcactctagcctgggcaacaagagtgaaactccgtctcaaaaaataaaataaaataaaattttaaaaaatgattgctttttcattaggagaggtcaattaccttcaggtcttaattccatgttatatgtagtggttttatttactgtagcaatagaaaacattattttataataaaacattgactgtttactaaaataaattggtaaaataagttgggcatatattggctttaaacaattttatgccagggcatgtcagcaataatcatagtttgagaaattatggtagattcaaaagtggccataaccttccactctgattataacgacaccttttgcaatatgaatttatagctcctcccatcaagagatggagtctgtttctcctcgcttgaattttagctggccttgtgacttcctttgccaatagaatacagtggaagcaacagtatgacagttctgaactaagacttccagagtccttgtactttcacacttttacttaaaaccctgtccaatggccatgtgaaaaagtccagggtgtggaatcattccaactgaagttatcctagatcaatccatagtcatctggccttctaatagaacaaagcttcctaccaaacccacagctgacaacaaacacaacaaactcaataagtgagcccagccaagaccataagaactacccagctcatgtataggcttgttagcaataacacatgtttcttgttttaagcaattgagtttaaggattgtttgttatgcagcaacagctaacccatacaggtattctcacaatagtaaaataaacacatcccttataaaggtaagggctttgccgctttctaatgatccttgttaaatctttttggcctccctatacataaggatttcacacttcttatctcttgtccagctccaaaatctactcagattccacccttactcttgaataatgaggaactctacttagcttgagttcctttacctcagccaacttatcatctcctcacttccaatttcaaagaagcagtcttttaaagctagcatatcagcattgatgccagaaagcaaacacaccagtatagtttagaaaagtggacaatttaggttgaaaacagtgaatgaaagagacaaaggaagagatttccgattaggacagttgccacagtaaagagaggttggtagttaatactagaaccccactgtagttatgcctgtatcttactagtcatctactactcataatgcttacttattttaaatgctgtttgtgttcataagctattttacacaataatgctggatagccaacaacccttgaaatcagtgacttacactaatatatgttgattgccatgttcatgggtctgtgaactgattggggttctgttgacctagactgagcatggctgtaggttttagactatgggttgcttcggagttggcttagctgggcttggctccaggttgtgagttcagttagatttgtttcatttgtatcacgcagaggcccaggctacaggagtaacaactgcatagggcatggtcttctcttggaagatccccaaagtgcaatggcagcaaaaccatgtgcacaagcacatctcaagacctctgctcatttagtctgctgacggcccactcacaaagcaagcatgatggctggtaccaaagttaaggggttgagaagctcacttaatgccccatgagccatggtagggtgtttaattttaatacacagtagcaaagaattgaggcaattatttcattcaaccacattacacttatgatacaaatttgtctctactttggtctataattgggtaaaagaagataccagacatctcagatcatctctctttactcagcctaaacaatttcttcatcattcaaacccagctcacctaataccttctctgtgaagcagcagctgaccaatcaaaccccattgttatctgatagctctaaagtgctccagctgttgaaacttataccactctgccatgccccctactacccctatcaccatgccactaactaccatcaccaacccaggctatcatttactgagttcctatcatgtgatgggctccttacataccttatttctatctgatagttattaatatctgttttatagaaaagttaattaacttgctaaaggttacatcgataataaatagctaagcctggattcacactgccactatatattacaattgtctactattttacatattgactttttaacagttagaatttattgtggatggattttattccttcaaattgcattgtatacttattgaaggcacttcttcagattgttccctggcacaatttgatgaattgttgcaataactgattccagagaaccagcccaccctatacttcattattcattagaaaggaactttcttaagatgtgagaatttgattaattaatggtagctaataataactagcaccaaccaccttattaaatgggtactatcccagctgtacaaggaagagctggtaccatttctactgaaactattccaaaaaattgaggaggagggactcctgcctaactgattttataaggccagcatcatcttgacaccaaaacctagcagagatgtagcaaaaaaagaaaacttcaggccaattttcttgatgaacgttgatgtaaaatcctcagcaaaatactggcaaactgagtccagcagcacatcaaaaagctaatccattatgatcaagtaggacttcaacctgggatgcaagtttggttcaacatatacaaatcgataaatgtgattcatcacataagcagaattaaaggcaaaaaccacatgactatctcaatagatgcagaaaaggcttttaataaaatccaacatccattcatgttaaaaactctcaataaactaggtattgaaggaacatacctcaaaataataagagctgtctatgacaaacccacagccaacatcatactgaacaggcaaaagctggaggcattccccttgaaaaccagtacaagacaaggatgccctctctcgccacttctatccaacactgtatcggaagtcttggccagggcaatgaagcaagagaaagaaaaaaagagcatccaaataggaagagaggaagtcaaactatccctgtttgcagatgacatgatcctatatctataaatcccacacagtctcagcccagaagtttcttaagctggtaaacaacttcagcaaagtctcaggatacaaaaatcaatgtgcaaaaatcactagcatttcttacaacaacaacagtgaaggtgacagccaaatcaggaaagaattcccattcacaattgccacaaaaaagaataaaatacccaggaatatagctaactagggggtgaaagatctctacaaggagaaccacaaatcactgctcaaagaaatcagagatgacacaaacaaatggaaaaacatccaatgctcatggatagaaagaatcaatattgttaaaatggtcatactgcccaaagcaatttatagattcaatgctattcctattaaactatcattgagatttttcacagaactagaaaaaaatattaaaaaattcatacggaatcaaaaaagagcctggatagccaaggaaatcctaccaaaaaaagaacaaagctgaaggcatcattctacctgacttcaaactatactacagggctacagtaaccaaaacagcattgtacttgtagaaaaacagacacaaagatgaatggaacagaatagagaacccaaaaataagactttacacctacaaatatctgatcttccacaaacccgacaaaaagaagcaatggcaaaggattccctattcaacaaatggtgctgggataactggctagccatatgcagaagattgaaactggacaccttccttacaccatacacaaaaattaactcaagatagattaaagacttaaatataaaactcaaaactataaaaaccctggaagacaacctaggcaataccattcaggacataggcacggcaaagatttcatgatgaagacaccaaaagcaattgcaacaaaagcaaaaattgacaaatgggatctaattaaactaaaaagcttctgcatagcaaaacaaactatcaacagagaaaagagaaaacagaaaaccgacagaatggggagaatttttgcaaactatgcatctgacaaggtctaatatcatgcatctataaggaacttaaacaaatttataagaaacaaacaacccaattaaaaagtaggcaaaggacatgaacacttctcaaaagaagacatacatgcagccaacaatcatatgaagaaaagctcaacatcaccgatcattacagaaatggaaatcaaaaccacaatgagataccatctcacacgagtcataacggctattattaaaaagtcaaaaaataacagatgttggaaaggctgttaagaaaaaggaatgcttttgggtggaaaaggtaacatcttacatccatggaataattttttgaaagtaaataattattgctgttatgatgtgataattatttaatttaggggttaacaaactgcagcccttgagtcaaatacgccagctgcctgcttttgtaaataaagtttaacaagaacacagccatgcccatataccttatgtattatatgtggctgctttcgctacaatgacagaattaagcagttgttacaaagaccacagggttcacaaagcctaaaatatttaccaactcctagtttatttattaactgaaaagctttgcaatttggaattttatgtatgatgttgtatgttcttcctccaaagaacaactttttaaaaattttgcccagctaggaaacaacatgaaatagctacacttttcaggtcatccaattggccagatcacacaaaagcatgacaagataagaaaaacaagcattccctatccttcaaccatcctctgaagactgcagggctttgttaactatgtttttaaaaattaaatcaggaaacacttggattgctacaatagaacgtaaatgagcgaagcaaacaaacctaagtagtctccattgaatagatgcgtccattaaaataattcttagccaatatacagaattgagtcttcaactaagctttcttttcctccaacaaattttaggggaaaaaagagcagaccaaataaaagagattcataaaagacttagcaaaatacatacatatctaccaccttcctagagtctagacaggatcaataaactttctacttaatctccaaaatcttctctatggaaaagatgactacttaggagcttgctttgaagtcttgaaatgttgagttcaaatccaagctttgttgctgactggctgtatgaccttggaaaaaaattgtacaaccccccttttagcttctttactaaaatgtaggtacaaatgtctgctttaaaggcttgttatgaggattaaatttgatgatgcatataaagtattaggcttactgtctggcacatagtaagtatttaatacttggtaggtataattgatgtccaaactggaggtcaggacgtaaattatgaagcctccactaacagttcactctaaaagaatgatgtagaatcattcactagccatcaaggaaagggaattaatgtattttattcatattttcaaaaaaaaaaaggattgaaacacaaagggctaacaacaaaatttaatcaatacactatactccactacccaagcttctgctaattttaggtctgaatcactgaggaaacaaaaaggctgcatgttggaagaagaaaaattcaaattattagcatggggaatctggactggtgaaacgtgttcaaaggttagtaaaatatctctatttgcaaggctgtgctagatggcttatcatagattttgttgtttggcaaaaggtagaaaaaagcagaaaatattatttttgtatgtatctttctgaaagtatacctctttaacatctctgattacaattttgtggctcaatgcatatgaaaagactttgaataaatgagcatacttatgaatccattttggcaacaaaggaaagagattgctgaaatgtctatagcagttttgaaggctgcatagaaaatgcccaattccctgctccttagatgcaggatacccactgtctctcaatttctactttccattgctgttagcatcttggtaacagcaggtgcagtcagatagaaatatctggccatgtgttctagaaacaagtgatagagaagtaagaaaaaccacgatggggtcttcagaaaattatggctctgggaaattaaatattgccctctggccctgtaccaaccacatctttaatgcctctaaatttgtccctagtaactgagtatatgcatctttttgctttctttttttttgagacagggtcttgctctgtcacccaggctggagtgcagtggcacaattacagctcactgcagccttggcttcccaggctcaagtaatcctcccatcccagcctcccaagtgtgagctaccacgcccagctaaattattttgtattattttttgtagagacggcatttcaccatgttgcccagcctggtcttgaactcctcgtctcaagtgatccacactcctcaggctcccaaagtgctggcattacagacgtgagccactacatctggccagtatatatgtattgatgtattttcacattggaagattgctgaaattaaggtacatctggcaagcaaagtcacttaaaactggcagtcccttgaatatctaatgacttctaggggcagtgtatgactttgaaaagacatggttaatttctgtccctctttgatcaaccttgtcttggaacagacagattgagtgtggtcagaaggaaagtttatgcctggaagattactgtgaccctcaggtaacatccacattataaaacaggagtaccagcagatgaattcaggctgaatactgaagacctgtgacactgctgcactttgttgaaccagaaaaaaatgaccaaacatgcaccttgtgtaatgtgggcatttaagctccttgaggccataactgccttggactctgcatttactgatttagtcaatatttaattgtgcatctattttgtgctgagcattgtgctaagtgttggctgtatagtggtgaacgcaatagacatcactctttgctcaatgaaatctagaagaagagatagacaataatagaaaataagtgtgcaaagcaatttcagactgcattaagtgctgtataaacagggtattgtttcaggaaggaaaacagcaaacactgaggagcccattttaggcagaatggtaagggagaacttctctacaaaggttacatttaaaatgatacctgaaggagccagccttatgaaagcctgtgggcaaacaatgtttggatgcctcccacagtgagttatgccctactttggtcccacccttgagtgtgggaggaacctaatcaatagtgtataacttctatcaagagtatacacttctaatcaatagtatatgacaagaatgaggagattttacagatgtaaaattcttaatcagttgactctaaattaatctaaagggagactaacttcatgggccagacttaatcaggcaatccattgattgattgattgagacagagtctcgctctctcagccaggctggagtgcagtggtgggtgttttcatggctcacttcagccttcacctcctggtctcaagcgattctcccaccttggcccctcaagtaagctgggaccacaggtacatgccaccatgcctggctaattttttaaatgttttgtagagatagagtctccctatgtttctcaggctgttctcgaacttctggcctcaagcaatcctccctccacagtttcccaaagtgttgggatttcagatgtgagccactgtgcccaaccaggtgatccttttaacagtgcatctataaataaaaaatttgatgcaccagagactctctctctccctgttgctggatctggagattctacagctgcaaggaaaggagttttgccaacaacatgaaggagcttagaagtggatccttccctgttgagcctccagatgtgagcacagcctcgccagcaccttaattccagctttgtgagacccttaacagacgacctggctaagtcatgcctggacttctgacctagaaaaattgagataataagtgggcattcttttaagctgctaaatttgtggcaatctgttacacggccaagacaacaaaaacaataatctaagcaggacaactataaagtcattgagaggtgtgtagtgaacaaagaggacaattagtcaggagccacatcatgggccattgtatgacaaagtaagaaagtttaggctgtatcctcagcatacaacacatgatgcctagtgcaaagtagatgctaaaatctgttgaatgaatgatgaaagtatgcttctaaataaaagggtttaatattagccttccgtcactacttcccatctccagattttaaaacatttcttctgtagatattcagtgaaagatcactcatgcgaagaactatattgttgttacaggatcaagaaaagagatgaagaaatagagtctggcccccaaagcaaatgttcagtcaacagacctaccggaaacttctggacaaggaaaaagctatgtagttatatggagattaagggctctgtaatgaggtatggatacaacccagcaatctgggtcacagctgaaggcctgataatttgaggtttctcttcagagtctaataaactatctgaaaagctgccatgtgttcatcaagttcaaggaagatagtgctgtaataagataaccacatcatcaaaggccatgctgatgatggtttggaggaaaggaaattgaatgttaagaaaattagcagttcaataatgatagagaatccaatattgaaaatgcaaaggtgtttataaattgagaaatcaagtttcctgatttctttcttcttccttccagacttatctgaaaaacctctagaaattcagagagaataaatgaacagattatcgtcttatcctattagttggagtgtggatgttatccctgctgccagttgggcacatgtaatggccaaggagaagtttagagtcatgctgcacttagtttagaagggaagagtgtgatcagtaagagaaaaaccagaaatggcattttcaaagagcagaatggaaacatcgagatacaactgacatccttagctcatattcaccacatcttcaaaattagctggattgcttcactaagaagagtctatttgcctttaaaaatacatgaagatggccgggcgtggcggcttacacctgtaatcccagtactttgggaggctgaggcgggcggatcacaaggtcaggagattgagaccatccatcctggctaactcggtgaaaccccgtctctactaaaattacaaaaaaaaaaaaaaaaaaaaaaaaaaaattagccgggcatggtggcaggcacctgtagtcccagctactcaggaggctgaggcaggagaatggcgtgaacccgggaggcggagcttgcagtgagccgagattgcgccactgcactccagcctgggcgagaagcgagactccgtctcaaaaaaaaaaaaaaaaaaaaaaaaaaaaattaagatgtagaccttactccttctaaaatgcacatttgaggtatttttcaagggaaaatatccgcacagttttgaatgagatagttaaggataacttataaagttaagcagaggagtagaaagtagcagacagctggtacaactgagaatcaaatttacgccaaatttgaaggttactaaagggaaaggggagagatggtgcatcttgaaaatgtttttaaatatcatatcgtcatcatcatcatcgctgtcagctttgcatttcatgaagatggaaagcaggtctgtcttagcctcatttctcagataataaaacctattctcaaattatctcacttaaaaattttttttgagacagagtctcactctgtcacccaggctagggtgcagtggtgagatcatggctcactgtagccctgacttcccaggctcaagtgatcctcccacctcagcctcctgagtagctgggactatgggtgcatgccaccacacccagctagtttttaaatttcttgtagagatggagcctaggctggtctaaaacccttggactcacatgaccttcccatcttggtgtcccaaagtgctggaatggagctgtgtgctcagcctaccttactttttttgagttacctttagaattcaactcaaatagctacataattgactgcatcttcccaagggtctatgaaaaataaaaccaacactgattcataataaaatttgccattttactttggatattatgttgagtatgaatttcttctatgagatttatccactaattctcaaacaaacagaatagatgttaagaaactccgtgggcaaattcagagacatttgttaaactctcttgcttttctcttatcttttgatagacatggttcatgttacaacagataactgatatgtaactgacataatcgctctttgataaatgtcatttctcatttgagataaaaatggcagttactggcagaacctcataaagagagagcatgggaactttcacaaagcagcagcagaaatcagattacagcttcccctaggatacgatatgcgtaagaggaaaacattaagcacattttgggtttgggaagcacctagaaattgctttgtttggtaaggagaagaaggtccagaaaatacaaaattaaacaggaaacaatttcagcagagtgaggatgaaagtgatacaatatcatttctgtattcttgctactgtgagttgataagagttgtgcagagctgagtgtagtctgccagaaagtgagtaaatgtataatttcagacacctgatggtaaggcatgacaggtatactatctttgctgcctgtctacatacagcctgccagcaaggaaagaggagggaggtaaattaaatctctgctttgctacctgcctatgcagacttcatatgaaagctgctgtggtcagtctgaggctattttcagggatggagtcagagagctctgtcccaccagcctcagtgcgtcagggcactgtctactgccaccgtgtcttctgcatcactgtggtgtgagatgatctaagagggccagccaatgaagagtttctattttaatagttgggtttcactttaatgcatattatttttttgtaaaaagaatatatcaaagctgtgattttatgtacattacctaagataaagacaggtttaaaaagtgaacttggggccaggcacggtggctcatgcctataatcccagcactttgggaggccgaggtgggtgggtcacctgaggtccagagtttgaaaccagcctggccaacatggaaaaacccacctctactaaaaatacaaaaattagccaggcatggtggcacgtgcctgtaatcccagctactcaggaggctgaggcatgagaattgcttgaacctgggaggtggaggttgcagtgagctaagcttgtgccactgcactctaccctgagtgacagagtgagactcttaagctccaaaaaaaaaaaaaaaaaaaaaaaaaggtgaatttgagagttagtttaataagaaacattaaataatcatccaggtagtactcggaaatggcaaagattatgaaggtggtatgttaacgcctgaagtctagaaaacaattcagaagataactttcttcatatcccattgttttgatggtttctttgttgagacttttggtatttgttttcatttacagaataactgtgtttaaggtagaaatttggagacataaaaaagcacaaatgaaaatcataaaaatcaaccataatcctatcctttagagataagcacagttaacattttgttctttgcctgtccagtacctttttccatcctttgttcccatagaaatgggactgtgcctgcatattgtgcttcatagccagattctccacttagcaatatctaaggaacattttcccacatggcaagccttcttctttaacaactcttttattgctgttctattggataaagaaaattcccttgtatggttaaatcaaaatctaattaattaatcctatactgctgggaattaagcatgcttccattttttcactatcatataaaaggctgcagtgaacatctttggacttaacactcttgcacacacttctgcgtatctacttgtaatgaattcctaaaggtagagctcctaggtcaaaaggttttcccattatgaaggttttctgctgcaaactaacagattgcagaaaggctacactaagaatttattgccacagtaagtttagagaatagccatctctatattgtcatagaaatgggtattatatgttgtgaaatattatcatgaccaatattttctttcttttaaaatacttttgtttgccaatacactcctgaaacttagattactaaagacatagaaatcaaaaaaccatatatttagaattcatgtgtatttttgtatgtataaattactttcatatgttcttttgccctaatttctattgatatgaaaccctgaaacaataatcagatttagatatgaatagagagtaaaatactaaatgtcttaagtatccctgtcccaagaagaagtactttatcttgtaatttttttttgttggagatggagtctcgttctgttgcccagggtggaatgcagtggtgtgatctcaggttcaagcaattctcctgcctcagcctccctagtagctgggattacaggcatcctccatcatgcctggctaatttttgtatttttagtagagacagtttcaccatgttggccaggctggtcttgaactcctgacctcaggtaatccacccgtcttagcctcccaaagtgctgagattacaggcatgagccaccgtgcctggcctatcttgtaattcttttttggctaagagtacaatctttattctggagagagaagatattctttaatattactgtacttttttctatttcgcaaaaaagattttgagggtaaaatgagtcggattaattcattttttaggagaaaacagtaaaatatgatcctgccactcaattcaacaagtgcaaaaacactgagataagacaagaaatggcataacaatggattcactccaatgaagctgagtttgagcaagcacagaaaatatgcataagctgttgcaataagaagaaaaattaatccctagaataattttgtacctagaaggtttaggaacacttgactctctctgtaattctgaatcttgcttataactcaggtggatgatttttcaatattgaagctatgacaccttcttgtggtggaaatgctggtggaggtgatagtggtggtggaggctaacgccacctgcttatcccattctaaaactgctacatggtgggatgtagtaatattttaaataaaataatgattaaatttaattttatattgatatgtgaaatttcaaaatactttttgacccatcacaaaaaacctttcatctccagatttgtaatcaatgttttcaattaaagttggatgagatgaaagtagataccagcaatatctttgaatgtgatgcatgtgttgtattatgaaatgctaaacagactcttactaaaacatccagaaaattcaaggtgatatatcatagttgataagaccctacctactagttaaaataattttccattatccatttattaattcgataaacatttactgagcattcactctgtgccaagattttatatactgggaatattagcaaacaaggcaaagatgaatctctctgatagttctttgaaggtgaagggcaacataattaccaggaaggaaggtccttgtttaaaatgcagattcctgggccatgctctgaggctgcagaatgagaatctctagggctagcagctgggaatgtgcatttttaaattgctcctaagagacatccagtaagaatttcagactgcaaaataggcacgtaataaatatttgttgaataaatgaatataatgctaagcttaggcaggatatcaagatatgagatacctcgcttccctaatcctccatctagaggaaatacaagcccattttggggtggacccaagcagagcctcagctctcgccatcagaaccactcagaaattcatgatgtgactaatatacaggtatcgggccttttgcaagctttccattttaaaaaattattcttgacaggcaggtgctaagttcagtagtcttcccagctgaggaagcacaagcccttcaactggcaaacaccaaaggcagaaccatattttttaaaaaattgatttttagcacttttgacacgtggaaaacaagccttactcatagggccaacttacccattagacacaatgagctcaatgcctagggcccctgagacttttaagggctcataaaaatgttttatttatttattttttaaatcagaagaaaagcatgaatatactccagcctaaactgtattcaactttttaccagtagagtaataaaatataagttttaatcctttttttaaaaaaatcaagaagtatctcatagaagttggaatgcagctctgcttacccacagctctaggcccaggcgagaaacaccttacctggcaggcattgtaaaggagctgatgttcgaacttcttgatcccaagaatgttctggaacatctcatagagttgctccttgctcagaatcagctcggaggctgcgctggctgtcatccgggcctgctgcttccgcgggtcctcttctccacggtagatggcatcaaatttggccatccaggagctcagcacagtctccttgctgaggccgtcaatctcaggcaggctgcgcactctcttctcaatgtgcttcttgaagacctcccgggagtcgttggcggaacagcctccactctgaaccatgcgggccacacggtcgctcttcaggaacacctgagcaagaacaaggccaggaaagacagtaggagagtttaccacagaggtaccagttccctggggctggacactgggccagtccacctcacgtgcatcccaggaggaaccactgtgggtctcaccctgccccaccacctcctggctgtgcaaactcagagtagtctcttacacattctgcttctgtgtccacatctgtaagatgagaataacaattgtacttaccaggttggtgcaaggattaaatgagatgatactatcatgagaggcagcacatggtatacagacctgtgcccgggctgcataggttctctgccccttagtggctgtgggactttgggcaagttaacctctttgtacctcagtgtttccatttataaaatggggataatagtatttatttaatgtttaatttctttttgagatagtcttgctctgtcacctaggctggactatagtgacaatcacagctcactgtaacctccacctcccaggctcaagcgacctccagcttcagcctcctgagtagctgggactaagtgcatgccaccacacctggctatttatttatttatttatttattttgtatttttggtacatacagggtttcaccatgttgcccaggctggtctcaaactcttgggctcaagcaacccatccacctcggcctccaaaagtgctgggattacaggcatgagtcaatgcacccagaatttaattttttattttaaatagaggcaggactttgctctgttatgtaagccagacttcagtagtgatcacgatgcactgcagcctcaaactcctgggctcaagccatcctcctgcctcagcccctcaagtaactgggactataggtgtgtgccaatatgcctcgataattttttaaactttttgtagagacagggtcttgctgtgttgcctaggccagtatgtattttaaaatgaggattaaatgtgttaatgtgtaaaacacacataaaatagtgcctggcccatgttacacttgttgctgttattattattatatgtaaagtgcctggcatgatatcaggcacatagcattaaacattaaccactatttgtacctccttttatcccttcaatgatacttttaattgaaagtatacaagtatcaggtaaacatatatttaattttctctcttccttcctgaaatgtaaactctacttgggcaaggaacgtgtccttcttgttcctcacaatgtcttcaggtcctagaatgtcttcagcacctgacactttaaaagtgaattaacaatgaatataggtgttaggttaagtttattttgtagatgaaaaactgagacttcagagaggggaagggacttccttttggtagctcaaattgtctgactaccaatgggtagtctttttacttcacccgggttccttccttccctgcagggttctcctgcttgatgaaaacctctcccccctggtggaaaatccctggttggtctgctggtgctacctggttgagtcctgggaccaagacttcttctattaagaaagtcttatttttgctccactgcccaccattcggaagcttacatgagctacatggttctggggtgtaatacaaggcagtgaagccgccgcttcatattcacggagaggaagcatctgacacgtttgagctgcgtcctggtcacacttcagaaggtgcataaatatccttcaagaggcagagcaaatgttcattcccctgtcagatttcaggaaatgcacttgttggccatgagacagcactgcctgggggcatctcattgcctcatgcttcatcacaaagcgtttctggggtggagagatgtttttttttaaaaaggctccggtttattgttgactttaatgaactaatttagaaaggatggctgagggtttgcctcacagggtagaggccatggcctgcttccttatgagtgggaactggtactcagatgagaccttagagttaatttgaaaattaattatagacaaaatagtttcaaatgaatcctcaggccttatgagccttaatgagctaaataattcatctgcaaacctgtaacacttaatggggatggtttctccatctaaccaacacattatagatctcaaataccagtgttttgaggctagtggaggaagtctctggaaaggcaatggagcattgtggcaggagctgtaactcatgatctcaggccaggtctgcctctaacttgctgtgtgaccttgagtaaatcatctcccctctctgattctctaatttctttttctttttcttttttttttttttgagacagaatctcactttgttgcccaggctgaagtacagtggtgcgatcttggctcactcaacctctgcctcctgggttcaagcgattctcctgcctcagactcccaagtagatgggattacaggcatctgccaccatccccagctaatttttgtatcattattatgtttttagtagtagtgacggggtttctccatgtaggccaggctggtctccaattcctgacctcaagtgatacacccgcctgggcttcccaaagagttgggattacaggcgtgagccaccatgcctggcctgattctccaatttcttatccatacaccaaaggaattgaacaataaggtttggggctatccttttaactgtaatgattataaacttttccatgaacccattcatcctttctttggttactctctaggtggaagacactgtaccaggtgtcaggaatacaacggtgaggaagacacagatttagctctcatggagtccaactgacataatcctaataatgccatgcaaatatgattacgatctggaacaagtgctatcaagacaagggtccacaagaacctatagctaggaatctattctaatatgtggtcaagaaagccttcctgaaagaaaacacctttgagatgatgcatgaaagatggataggtgaatggagagctgtaatttattttagagagaaggaacaatacgtgtgaagaccccaagtgcctgaagaaataaggaggagtcagtgtggctgtggcaatgagggctgggggtgacagatgtaagatgggcagggaggggccagagagtccagggaggcattgagaaggaggaggtattcaggaggaggaggggattagggttgttggtcttcattttaagggcattggaaagccattgaaagttttaagctgggacacggcacaaaccagttcacattctttggctttaatgtggaaaagagactgatgaagggagccaagaaaataggcagggaggccagttgagaggtgcttgtacgagaccgggtgagtgtgatggcagtggggacactaaggggttaagcctttgttgtcagtgctaataaacataaggggtgacttgaaaacattcaatcaacaatgaagctatattctcctctacatctatgcacattagtatcccacaaacccgaaatgggcctcagttataagctctcagccccagattcttttttcctaaagcccttccacagctgccatctgccactgtttttgtgactgtttggtaaatatctgatctccagctagactataagttccagggaggcagggtagtcgttgtttgtttctattactgcttcttagtgcctgagacagtgcctggcatgtagctggtgctcagtaaatatttgtggaatgagtgaatgaactataagagcaaagcagactcctctagcaggaaaaatatggagcgagactatgtctggattggggcgagaaggtcaacgggaaaccagcacacggtatattggtctcttaaaacaagagacttaggctagattttccatggggcctgataacaaggggtaagaaataaagatgttggcacttgggtcccagctggtgtaactggttgagtgatgtattagtctgttctcacgcagctaataaagacatacccaagactgggtaatttgtgaaggaaagagatttaatggattcacagttccacatggctggggaggcctcacaatcatggtggaagtcaagggaggagcaaaggcacgtcttatgtggcatggcagcaggcaagagagcatgtgcatgggaactcgcctttataaaaccatcagatatcttgagacttattcactatcaagagaacagcatgggaaagacctgctcccatgattcaattacctctcactgggtacccccatgacacgtgggaattatgggagctacaattcaagatgagatttgagtggggacaaagccaaaccatatcaggtgaaccctgaatcctgggcatagcatctgcttcactagccccttcctttgtacatagtagctactcaataaatacttctgaattaccagtggaagacaagtcacctaacctccatcagtctcactctccttcatggtaaacaatgaaggaatccagcctttcttctttgctgaggatcaaactgagaagactttgaaaagtggagggatctatctgtcctgtgttaagatacaactgccagatcccagaaagaggagagatgagtggaatgataagaacatggaggaaagaggccaaagactggggagacagtaaagatgaattgcccaatggagacaagacagccatgaggagagaaggtggcagcaggaaactatttctacaggcacatcatctgtcttggcttctcagtctgacaaagaggaagtggggcctgggccagcctcaccctataatgaatacaaacactaagtactgatgtgcctgtgtgtctctaaaacaactattcaaactcaattgtgctgggagctctgtctgtattttgtatccgtgtttgtttctgtttttgctttttagtggctgccacaagagactttaaccccaagcccagttctatctgggcacatccataaatcctccctgcttttctgccaacttccagacaggtcataatgagagatggaagataaacaaataaatatggaattgtgaaggacagtcaattcagcaactcgacctcatccatcagtccttccctccatcaccagagccaagcaacctcaaggtcattttagaaacatacaaacacatcagtacttagtgactgttcacattacagatgaggttggcctagctcccatttgctagctgataagctgagaagccacagcagattcattcctgttctgaaaaagcatatcctttcaatataaataagaaaaacatctagatgttggagtaagtaaggtttgcaagaaacacacacctcgttgctattaataaatgggcacataaataatgaaaggggtagacatcatggttaggaggatgggccctggtattagaacacctgggttcaaatcctggctctgttgcttgctagctttgccacctgagcaagttacttaatcttcctgggctttaatttcctcacctttaagatgggagttataacaaccttcctttgtaggattttggtgatccctgaatcctgattcagtgatattatgcctgcaagttggttagcctgttgcctactattcggctaagaatgtaatacaagttagctgttatttttaaatagaatatcatgcagccatgaaaaaagatatatattttttcattaccatccaaagatgtccatgatatatggttataatggaccagagccttccaatggcaggggtgaggtgggattggaggataggaacatggctctggatttagaataccataggaaataagacagtttactgatgagagtatgccatttgtgtgacctttggaaaggtaggaaggagactgaaaacaactgtgttaaataaaagaagtgggtccttaatagtttgtggtaatttcccaccttaatatgcaagccaaatagttatcttgacatgcatagatacattgaaagtacctggaaagatagaaaccaaagtttaattttggttatctaggatgatgggattgcaagtattttttaaccatgtaaatgcagagatttttctacattgtctgttttatttttatagtgggcatgttttactttcacggtcatttgaaacacatcttttctacctggaaaaatacaaattttaccttctttgaggcaaggtgcattttcatttctaaaataaaatgtattttcaaatcttaaaaatcttcttcaccaaaaagtaaaggattctgggcaaagtttcagaagcagatcttgggccatgaccttgtggtaggtggtgctagattaggagcaaaagtactttcccttttcttttctatgcccttttcccctgctccatcttgcacctcccttcctccatgcccagggagtgaattgattctatcaactttcaactctcttcttctatttctatgcagcatatggacaccataccaccatgctcatttctaaccttaatatattaatatattctaaccttaatatattaataatggaactgtccaggtatatatattctcatttagtcttgagagcaattaggcaaggaaggtcctattaaagatgaagcaactaaggctcagacatagctgaggtcccagagtcagtgtgtaacaggactagaactcaacccacctctgtcggacacaatttttatttttaatttatttagagacagggtctcattctgtcacccaggctggagtgcagtggtgcagctcactgcagccttgaacctctggccccaagaggctgaggttcctcagcctcataaagtactgggattacagatgtgaactgcacctggccttggacactaaactcatcctcttaatcactctgcctgccacctcctgcctcctccttgctgggctttccctgcaagaatcaatgctttagagtgggtagttattcttcccctatggatgtacctgtttatcatggtatctcaggtaccatggaatagttgtagccattctacttattagaaaatatattgcttcattttagaaaaatagccagtgtgacctgatttatactcctcttaaataaaaaaagttcaaccataataactaaacgtcttcttgcatagatgaaacctgcagttttagcctgccaactgttcttcctcttctgataatagtacctcagtctttcttccaagaacccctttctcattacatagttgcagtgggattgtcaattgtaggactttgtccttctttagccaagtggtgggttgggatctgagcttggtcagtaagactgccacttcttgagttcacattccgagtgggttggcatgagaatggactgggctagagtaggtttatcccaattattaagtgtctgttatatcttactatctggcttcctgaagttaaactggtctggtttccttcttttctgaagcttagctgtttcttctgataacaacaacaatactggcaacaacagcaaactattgttgttgttgttgcttctgctgttgttatgatgatgatgatgattagggcttaatttaatcacagtcggtttctgttgctagcaactaaagaagtctgtctgttgcaacattcaaagctagtgtgacaaaaatgaactaggcatttattaaaaaacaaaaccaaaacaatacaaacaaacaaaaaaataacaacaacaacaaaaaaacaacactcacacaccccaaacaaagctcaattataggagcttcactggctgaagttcagacatcagatgcagtgttctgaaatgaatttttatgtcttctgccacatatgacactcccattttcttgcaaatacccccatgttcacttccaggaagaatttgagttttgtaaaacttttttatccacctattttctctgatgccaggaccagcatgtgaagaaactaaaatcaagcagggaggtgaggaggtgagcatgaggaggtgagtgtgaggagggagggagagagcaagggagggcttatattttggacatttttcttaaaaatagttagaaaaggtgtgaggaacacagagaaatggctctctgatgccatatctcaggaccaggggtgtgagaaccagacagaattgctgggccagatctcagagcacccatcccagcccccagcccttggccctgaaagccagaattgaagagattaatggattaatctgttgccctgcttgatccgctctgacaatcagggccatcaggaaaggacaaaaataaacctgtgtgctcttgagaaccatggggaccttggtctcctttctcccatccccactcatggcccaggcctcaccaacttgttgttaatggtgactagcttggttcagactgggctggatgggcacagatggaaaaggaatagcacctcctctctcctttcatttattaaaagatgatctttactactctagcatgctgagagatcaattcagcagttggccctctgtatccacaggttccacattcatgcattcagccaactacagatacaaaatataaaaaataagaaataacaataaaaagtaatataaataaaaccaatatagtatgacaacaattaacataacatttacattgtattagtttttatgagtaatctagagatgatttaatgtatatgggagaaggccaggtgtggtggctcatgctggtaatcccagcattttggggggccaatgcgggtggatcacttgagcccaggagttcaagagcagcctgggcaacatagcaaaaccctctctctacaaaaaatacaaaaattagtctggcatggtggcatgcacctgcagtccaactatatgggaggctgaggagggaggatcactttagccagggaggttgaggctgcagtgagctgtgattatatgactgcactccagcctgggtaacagaaaggaaacccggactcaaaaaaaaaaaaaaaaaaaaggtatatgggaggatgtgcataggttatatgcaaacactatgctattttatatcagggacttgagcgtctgaggattttgtatttgaggaagccctggaactaatgctctgcggatactgagtaatgaatatatgcattagcaaaacaagaccgatatctaaaactgactttttaaagtacagaaatcccagaacattttgagattattgctgttacactattttttaacgttattgctgttggtaaactggagtgtgaagttgtggcatggtagggtggagtgtgtgtgaatgtgaaagagagggaatttggaaggaggatatctgttggttttgtctgctgagcatatattccccgttttggtaaaaagcagcctaacggtttattaagaaaccattacattcttcctgaaaatggttccagtgcagctgagcctgtactcaggtgccagagatggtggctgtcctaagccttaaccccccagtctatttcacccccatccactgtgactgactcaagaagggacatatgatccatgtcagtccaacaaagtcaccccatgtctttgctagggagctcagcaggggtgttctctttgctcctggaggtgctaaactggtaggatgtgccctggggctgtcaaggtcttccacatggagagaagctgaccaagaaggaagtcaacacagggatgagtacagtcgagaggtggggggaagatacccatcccgctggtaactttggagcctctggatccagccatggctgaagccaggcctactcctggacttttaagttaattgaggaaataaatctcttttttagggttatccagtatgacctaggtatcggtcacttataatccatagagtcctgactaagacaggggccaacagagaagcaattggaacccagagttgggtacaggaagagacatcagcttctccatagcccaaggatgaaggggaaaggagaaaggaaggtgtaatcaacttggagagctcccaagtaaagtgttaaccctgatctcctgatacagaaacttcactttagaggattagacttccctggaaaagtgaatctaagactctccaaagtatttactaatgaagacagcagttagatcattaataccccacatcctttcttatgttactcaaatgctaacattaaatattcagtaatttctcaatgcctgtattcttaccagacaaaaaatgaaactgtttccaataaactagccactacagaggaaaacattgggatcactgtagatgtaatggtaatttccagagactcattagcaccttgatgactattaattttcacatttaattaatagatagaaatgacactttcttttaatttatgccattagtcaaatgagctttctaattaagatttgcaacctataaatttataaactctggtgaatgactctaaatatggagaactatggataggggtctgcttggcctgacaagggttctgccattactctcccattggcttccagaacttgaacaaagagggaaaattaatttcattcccaggcagtttctaaacaaaaccttagttaaatatattcaagttattcactatcatatatcactgtgattccaaatctcatttctactccccatgaaattcagccaaaaaactgtaccacataagataaagcagcaagtttgacactcattggcgataatgaatgatacttgtaaaattttaaaagatttaaatttggacaactataaaaacaaatttgacttctaaaatagatccaaataaaaatttcttgaagaaaatggtgtaaaaggagtctgtggttggtcccagcgaacatcacaaagattgtttactattaaatgctaattagcaaaccaatcaataatattttcacaagatctaattgcagtcttactctctccatgaaggaaggagtcaagtgctttagcaagtgggaagaagagttttgccatatcaggattttgcctctaccgaggcttcaatcaattaacatattgaaagcatctgttgtgggctgaatcagatgggcagactaagtacgtgcttagagcaccagcaaagcaggcacaccaacatttttgttttgaaataattttctatctaataaataaaggaaacaaggaaggaaggaaatcaatgaaacaatcccaggggaaaatcagattttgttacatttttcttatacctatcttcaagtttaccattattactgtgaattgtatatagcagcatatcataagctttcagtgcctaggagctggtctctaatggttgtcatctaaccttgacaatgcataagacatttggggcataggattccaaacacagagagtatttacctggttcacattaaaatagattaatataaagtaaaatgtcactcagtgaccaaataatcatatttgaaaatgtgcatatgaggaaagcattgccaataggaaggtatggcatgtccacttcataatcatgtagaaataatagccaatatgcacactgagatagaacacttaacaaaatttaaaaatatttgcagaaatacaaatccactttactgataagcttctgaggtctggtggtgaaaatttacctgtaatacatactcagaacatattctctcttttgtagattttctctagagaacagcactgcattttggacagtggttccagctccagaaaagaaagcagcatttttaaaaaaagaataaggaagttcatgaagccaccatccttgggaggtgctaacatccttttaaaatggtgtaagtggtgagaaaaatgctcctgactcaaagtcacaggttgtgatttttcatagctgtgtgaccttgagtaattaatttaacctatctgagcctcagcctcttcatcagtaaaatggaaatacaatcagacctaattcataagactgttatatgttgtatgaaaaacactcagtatattgcctggtataaaattccgttgttaaatagtagcttacatttagttttccctaaaacaaaatactgttatttcttaacattgtaacgaatcaccaacccatttgccttaggaaggatgatactgtagtaaaccaaaacgactgtccccattgccctgcagctcagactccccaggcatagggcttgagtggtcttggcattcttctgaacagtgattctcacctcatagtaactctgcacagcgttcatgaaggcttcgtcagccatgatctgggtttccccattgaggaaagcctgaaaccggtccttgactgtctgcagctgctgtttgctgatctgtaagaaacagaaaaagagggaaatgtgagaacttgtcctagacaaggatcatggatactttatgctgaagatgccagacccattggtgtattggagctggcttgtataggtgtgtgacagctgattagtgaatctgtggaaacttctgtgagccagtgttaaacacagccattattttaaaataatatataaataaattatattaaaaacaaagttaatacacttttaatacttaaaattcattgcctcctagttattttaccacatttcactttcatcagtgcttttgaggttacttacacctatggtatttgcatgagggaaattctatataagggagtgctaccacccatctcttcccagctccacattcagtgttgtctcagtggcagcttcatgtcagccaaggtgggaatatttagaccatggaaattggcaaatgctacaaaacagtttttttttcccctcctgagaaatggttgttaaacatgtaacagcaaacacagcactgcacatgcccctctggtggtctgaaataccttgatgaatgcagtatgaccatatgcaggggttttcaaactttattgttgttggtacatccatgatcacatgacagatgatgtttgggtacaggatatacttctgggatgtggcatagagaatttgggtactaggttatgtacaattccttgcctatcaatcccacctttctttcttaggaaaactttcctaaaagattcctactcattcttcctcctcaccccttatctggctctatcatgccatccatcaggtatcaatgcaggcagcactaatttatgaagtccttcccagcccctaggttaggggcaggtcttcctgctatgtgattccacagcacagtgtttgtttaactgcttgatgatgattaaatttgttacatgcggtgtcttttcttgctatcttattcatcgaagttttcccagggcatagctaactgccttatatgtgccagacactcagggctgattacatgaatgaatgaatggagtgtatgcaagacatgttattttcaggtatcttttcattggttctaatttatataaaatatgtatattaacaagtcagccaaaactttgctgttttaaaagttaaaaacttttaacttaaaaaagttaaatttttgtgaaaagttaaactttttgtaaaaagttatgctttataatagatcatgagaaactacctctgtgaaccactgttctagtggaaaaagtaagaccagtccagtagcagttctgttggccactgtgtcatctggaaaaagcgacttatattctgcattgacctgagagtgaagagccagcctttctggatcagggctgggtttaaataaattttatctcgtccttagttttctcacttggaaaatggtggtaattctaattacccattgtcctgggatagttatagctattcaataacataacgagttcttttaaaaaattaaaagtttttatataaatccaagtgattttactgttagagtcaatataattagaaaataaagtttaaagctttaggagacacaaagccagcatgagttttgactcagtcaagaaacaaaaacaaaacagaattttgtttgtgacacagatggaagctgggtgctttcattaatttttgtatctttggaagaagttggggaatagtgaagtcaagggtagattaaaaggggttagaaatttatcagactcatatttgttacattctagggcaccactattcaatgttagccacatgtataattttaagttttatagtagccacattaaaaaaatagaaacaagtgaaatgaattttgatatactttacttaacccaatatagccaaaataacgtttcaacatgtaatcagtatttaaattattaatgagacagtttacgtttaaaaaatgctatgcctttggaatctggtgtagtttacccgtacaacatatctcaattcagagtaaccaaactgcaggagttcaacagccacatgtggctagtggctattgcactggaccagttcagacctaaagcatggaataaactcacttctaagttgcttaagctttcctgctctgacccatggagcagagcacatattgatatgtgaaattgaagagaaaatcacagttattttttatgtgcttgaaaccatttgaactgaaatattaggtagcagttgatttgctcataaaaatgatacccgtaacatacatttattttaagcaggccagctttaatctagttcacaaatcctaacagtataggaccaaccaaggcatctcacaggatttcttgctcagaattccttctaaaacagtgtgaataccagctttgcgtgattttgggagtggggtgggatgatggggcaggagaggaatggaggcctatagacctcgcttttgtcttaaatgattaattgaaataaaattatgcacataccatatgaatgatcaagattgattgttgacccaggccaaatctattatctgtctaacctttccttaaataagcatggtgctcatttagttaagaaatatttatagatcacccacactctgcccagccctgcaccagacactacgggttcagtggtcaacacactcaacccctgatctcacctgttacttcttagggctgggcactaaggaatcaaaagaaataagggcttttcttcagggatcttatagtctaggtggagaggaaaaggcaaacaaaaaagcacattaaattatgattcaggatttcagagaagagaaattacagaatataaaactctcaaaggagaaaggagctaaggaacttcaggaacattaattttaatcaagttcagagaacacacaccgcaaagccacacaaagcatcccttgctttcctagtcacattaagctctcagaaggagagttgggggcatggacttcagcggcagaactttgcttatgtctgggttttgccacctactggtttacaattcactacttttctcaccgctaattcaacaagcctagtgtttatttactcaactcactagccatgtctccctgggcaaatgactaacctctctaaagctcagttttctcatttgtaaaatggggccaatactgacctcatagggttgttgtgaggattaagataagcaaaatactcactgcagaacttagcacaggatgaatgctcaatacatcttagctactgtgatgattaattctcatctttttttttttttaaaacaaacaaaaaaacagagtctcactgttgcccaggctggagtgcagtggtgtgatctcggctcactgcaacctccacctcctgggttcaagtgattctcgtgcctcagcttcccaagtagctgggactatgggtgtgtgcctctacagctggctaatttttgtatttttagtagagatgaggtttcaccatgttggccaggctggtctcgaactcctgacttcaggtgatccacctgcctcggcctcccaaagtgctggaattacaggcgtgaaccactgtggccaccctaattctcatctttgagtgtttgcacatactattcccttgagaatgcctgcctctggggacatttcacatgtacacatctttaaatttagtgcatgtgctcccttccagactccccaggtggaggtcgctgttttctcagcattttgttcacagtcctatgggtgcatgttttatgtggcgaagtagttatttatttaaactcaagtgctcaggggcagaatcatgagtcaggagttgagcgcacaggcttggggtccaagagacacaggttcaagtcctggtgataccactcacttccaggctgcatgaccttaggcaacctactttccctaagccttggttcctcattaaaaaatttggatgataaaactgacttcccaaagttgctaaaaagatgaaaaggaaatggggtaacatacctcaagatcttagcacatggcctggcataaaagagccaaatgataaactcaatgggctccaaggctctgcatgacgtaccctgactttgacttgctccactttgctctttacttactctggtctccagcacactggtgtcttttttacttctcagctgtgccccgacttttcttgcctgagagcctttgctcttgctgttccctttaccagggatgctcttctggttttccccatggttggccccttaggattcagccaagccagcatctcctgggaagctcttccctgaccattccatctacagtaaagttctcccagataatctctgtcacagtgccctgcaacctgagcatttcctgcacagtcattatcacagttagcccttatcttctctaaggtaaaattatttaattataacatgtacccagaaaaatatactttatcagcacagaatatgaggaattccttttttgtttgtttgtttgttttttgagacagagtcttgctctgttgcccaggctggagtgcagtggtgccatgtcagcccactgcaaactccgcctcctaggttcaagtgattctcctgtctcagcctcctgagtagctgggattacaggcaagcaccagcacgcccagctaatttttgtatttttagtaaagatggggttttgccatgttgatcaggctggtcttgaactcctggcctcaagtgatccacctgccttggcctcccaaagtgctgggattataagcgtgagccgtcatgcccaatcggtataagagattctcacaaactaaacttttccagataacaaactttcgtatcaagataaacaacattacccagaccccagaagctcctggatattcccaaagtcattgctccctccaaaagtgaccaccagcctgacttctattatcacagatgagtgttgcctgtttttgaacttggtgtcaatacgatcatacatgatgagattcatccctgtggttaggagtagcaatagctggtcccttctcactgctgggtagtatcccattttacaggtataccacaatttatccattttcctatgatgcatattagggccttctttattttaaaattatacctacttttcattatctatctctctacaagaatatatgtttcacaagtacaaggaccatatctgtcttgtttactgttgtacttcttgtttatagctatacacatatgtctcatttgctgctgtgcacacagtgagctctcaacgaatgtttgctgagtgaatacatgagcctattaagggcttaatgtataccaggcacagtgttaggctctggcgatataacagtatcaaggcacaatcttagctctcgaatttctcacaattgagtcagaaatcgcatactcatctttgacttcttaacaccctttgccaactgcatgagtgaatgaaaatcttacttagaagcttgcaaaagccagtctaagaatcaactgtgggacagagtttgtatctggttaaaagttaactgacttatataggattgaacccaaaaggtgaccttgcacgaataaactgaaataattggcccagagtagctgacagtacaactctaaacaaacaaatgggctttgatgagccgcttagagagagaatcctcctaaaatagaagtccatctaaaagcatttaatatgcatagaaaccacttgtacatcaaggtcagaattcagaattgcagtaatgaattccaagcagaaaacctgaaaagatggaaggtgattattgtagaagacagtgctgcagcagcgtttgctagaactattcaagcattcttggttccgtctacctcattaaccaaggcctgaaaattcccactgcatttcaggcagtttgtaatttactgaagcattctggagaagtgtgaaatgtgatctgcagtgaggagaaaacggcatgttctaagtgtcggtctcaggagaggcaatgctgaagtcagagcaagctcaagtcacatgctagctttgctatgagaccttggtcaagtaactggttttgggtttttcctctgtaaataggggaaagcaatatctactttacagagtctttgtgaaaactaggtgggataatatacgtataatatatatatttataatacatgtaataatatatagcatagtatctggcatagagtaaggactcaataataaaaacaatacaggaagtattatttttttccctatcatttatcttttatcttctttcaatgctttttttatttactcagccttttgaaggtatcactgatgtggtattccttacctcattctttcttggcccttctagtttagaggctggaaagccaattactcccttcccagtttcgcttgctattatgggtggccatgtaacagatgcagaaaactactgggggcatcttctggagaaatattcgaaatcctcatgaaaatgaacatacttggtggtataatccttttctttcctgctgccccttcttctgctgagaatacaaatctattgtctatagccatggtatctatctcatgaccatccaggaaaggctaagagcatcgcagaaatgtggtccttacattttttgggtggctgaacaaatgtttgtaaacacccatctctggttttttcattatgtgagaaaaaataaatatatttctacttgttcaagtcactgtatgttttctcttactggcagccagatgcattcctaatggatacacttggtttacaatagtcatggaagaaggcatacttactaagatgcttattggttaatatgtgtcctattgcaacagcaactgtatcagaaagaagggagaagcaatgcttattgtaaaagaaggaacctcaaatagcagcattctaagcataggcagcagtgagtagaaaaatatctttgggtgtatagagatgttccagttatacacataaattaggtccttttctacttaaagtataatgtcagcattgtatattgcaatttttaatataagccatgctttttctttttaaaaaagaaatcattatctgggaaaaaagggacaggtttttaaagcttttctttattatagataactggaaaaaaagtcaactcaacaagtgtttaaaaatcatcagctaatctagagagattagggcaatgtttatttaatttcttttttttgaagacttcaaaaatttatattgggccatgaattttattaataaataaaatatgccctttctacaaccagactaaatattttctactctaaaggaagtcctgcttttagaaaatttagaaatcacatcatcttaaccaaatatttacttatttacataaagttcttctcaccttttatattatatatgtatatttatgtaacatactctgaaaaaggcattttaagtgacttttatttagcttgaagaaaaaatctgacagactttatcacggcaaaatataaatgagtaattctgaaatgcaagttgaagggggaaaaacatattgaaggtggggagaattacgatgaggctgttatcctagacttccctttggaacatggtttcccaaaattcaactactcaaataataattcaattatttaagtaatactcccatgagtatgtcctccccatgtactaactgtactatttactttttgtttttgcattaaacttacatcaaatcactttcttctaagcaataatatccaaaaccataagctttatgtagttttatgtagtagctattgttaaattagatatgttctatcctcttgcatacctctaccacattttacaaagtgtttctttagaaaaaatgtaaaattcttctatatataacaattcttgctcatttttaaaaaatttagggtagcagctgaatataagttaattactacttttaaaaaatgaggtcaattttaaaattatttaataatagaccaatcagcatgctattcctaaagatctatttttgggcagaagagaaagaataaagacctataaattggccacatgatactctaacaaagagttctatgacctacagggaaatgaacatggagacataatttgaacattgattaagatgggattgtcccaaccaacaattatctagcagaagaggaaaaaaataggaaaaatgcatctagaaggtgagttggggctaaagattggattgaagatcaaaagagaagaggaaaaggatcaaaggggacgaaaagaagagaaggagaaggaggtctacttttcacccttccggccacaaagctcttaaaaggtgttctttagtaggacaaatgttccacccttgaacccgataacattaaaaaaaaagaacatttttccaacttggaggcactcagttaaaaaaaaaaacgtacttttccaacttggaggtactcaggcagtactcacatggattcttctggcatgtggtcaaataaggacttctagagccaaagatctcattaagagttagttggctagttgccatcattctcatactttttaatgtcaagtctctttcccctcttaaaaatcactgaggactgcaaggaggttttgtttatgtaagttgttttacagctattaacaaatactatagtgatactaaaactgaggagtttaaaatattaactcattaaaaataacaaacccatcatatgttaaactgaaataatacccttttatgaaaataatattttccaaaacaaaataatagtgaagaaatatcttttagagatgagtagaggacagttagatcctcatttctttttctgcattcaatctgttgtgaaatgccgttttggttgaagtatatgaagagaatctggcctcctacagataggttgttggaaaactgagagatattgtaatagccttttcagacaaatgggatagtcttcctgatactataccaaagcccaagtggtggtattttcttgaaagttagatgcactgtaaaatcagacaccatgtcagtgagctttttatactcaattacattaaaacccattgatctgtcttgctatttgaatgaatcttttacccataagtgttttttttttaatttttgttttgttttgtttttgagacagagtctctcactctgtcactcaggctggagtgcataggtgtgatcttggctcactgcaacctctgcctcccaggttcaagcgattctcatactttagcctcccaagtagctgggattacaggcatgcaccaccaagcccagccaatttttgtatttttgtattttttttttttagtagagatgggttttcaccatgttggccaggctggtttcaaactcctggcctcaaacaatctgcctgcctcggcctctgagagtgctgggattacaggcattagccactgcgcctggcccgtaagtggttttattttttaaaaatcatacattggtcatatcaaaaatgaattcagtgagttatgttaattttccaaatgttcacacatttcatcacacaatacataaaaaatcatatgacttaatattgccactgatatcaaaaaaatctttaggtattaagaaactgtccagattatggtggtgattgaaatctcaaattttattattagcaaaaaatattgtcagttgtttttcttgaagtaacaggctccctccatttactttctagaaaacatctatgaaatacctacatttgtctgttgattgtttttccaagtaaaaatgatattccattttttaaaaagccttgttaagttggcaactcaatcagacaagtcccttcccatgagacaactgttgtccttcctcgtgctgcctgagtgctttatgcatagttaccatttcactgtatagaatattaaaaaggtgtgtgcccaaggatcaacatttaataaaattaacactttctatggtttcatcaaggaaagtattccgtgaagttggccgtttttaagcaggaagtacatggccatgacagatataatgattactagtacagtttggcaccactgccttggtttgtgcgaaagtaccagcagtcttcctcatcattgcttttgcatcattattgataatgttaacatagtgagaaaaaagcatataatgtcttggcattactaggaaaatcaccttgcagacttccagggtcatgtggactatgcttccagaaccactgctgtagtgaatcaatgaatctgctagtagtgaatctactaccagcaaggtagtagtcaggaggagagtgctagggtatagtcttggagaatatagcatgagaatataataggcagagaacagaacacagtacaggggcttgcatgccaaactgaagagttgggctttaattcaaagaatggtgggaaagcattgaaatgttttgcataggagagtgacatggtttaagaacatgcagaattggccgggcacggtggctcatgcctgtaatcccagcacttcggcgggccgaagcaggcggatcacgaggtcaggagatcaagaccatcctggctaacacggtgaaaccccgtctctactaaaaatacaaaaaattagccgggcatggtggcgggcgcctgtagtctcagctacttgggaggctgaggcaggagaatggcgtgaacccgggaggcggagcttgcagtgagtggagattgcgccactgcactccagcatggacaacagagagagactccatctcaaaacaacaacaacaacaacaacaaaagcatgcagaatcagggaataggaatgagttctgggggttagcatagaatcaggagaatgtttcaggcttgctgtgatatttgaagagaggagggccctgaatagtatctagaatctcagtttgcagaggcagggatagctgggaaaagaggaaggccgtagggagaaaaggcgagagagagatgaggagggcattccaggttgagggtacaaaatgggtgaggaaagacaagatgagaaactgtgggaccttcttggaggacacagcaagaatctcttttgtcagttacaatctagaccctgccgactcaaaaaacaaggattaggggcggctgtgtgagtatgcacaacagaggagtccaaaaacaaagtcacaactattaaaaatgaaacgacagattgttccatttggctggagctcagattaaaatactagcacagcaacatatgaaatcactaaatcaccacacaccatcttgggtcttataaggtttaatagtgaactcatcagtagcaattatttccagagaaaaagctgaaaatatctgaatgcagtctatgtacaggttatatgtgacgctaatgtaacattcacaaactgtgaccatgagcttcactgaaattgatttagataagaacattatcctgtcagcatgaatagagagagaaggtacaagtgattggcagtcgcttttcaggctgctgggggatgtggaggaatgtggagaccttggctggttgttctaacaatcgccattcaggatccagaatagcagagagaaaaaacaggacaaagagtgaaggtgatctgaaattaggaaatatgaaaaacacaagtgcacaccctaatgcaaactaggaactttagttaataataatgtatctgtattggctcatcaactgtaacaaatagagcatgctaatgcaagatgtgaatgatgggggaaactgttggaggtagggggatacggagtatacgggaactcttctgtattttctgctcaatttttttataaacctaaaactcctctaaaaaataaagtgtattagttaaagagacacacacatgtgcacatggagaccttctacaaagggatccgaatacagcagcacacatgatgcaggcctaagcatgcccagggaagaacagaaaattctatcactcaagcctgtcctgatattcagaagcaggaaagagtaaaaagccatcagtatttctgagtttcatcatctcatgtcttacggcaatatgagccggctgaattgtactgaggtttcagagacttttctccactcacaaatgagttctggcttattacaatgctatttatcattggctcgattctccctctgtgactttatattattgataatttaaaggcatcagtgatttaatgactcttgctccatctgacagagaaatagctttggttccttttggaagcagtggagaggttgaactttcctcaggttgagtgacgccacttgtcttatcaatggacaaactatatatttcacgtattggtaaacacatggggatactccatggaatactactgcaatcactttggagatagctcctttttccccttataatattttgttgcaagaaatgtcgagatcattgtccctgtggttagttaacaattgttcaaatttcattttttagtaagtctattttttagtaactccgctgatgcatttttaagctattaatgctatttaaaagcctttctgcattttcccttcactttcttcacttggcaaaatcttatttgtctattaaaatgctacttcagatcacttctctctgatggctccttccagcctctgaatgatacctctttagtctgaactccctcatccctgactcttggtatttattatatgattgatatacagcatgaactttaatgtctgtcttgcatcagcattacccatgaagcttacagaaaatattgatgcctatacacccaccacagacccactcactcagaatggctgggaatagaaacccaggtatgtacaagtttagaaacttcacgagcatttctgacataagccaaagttaagagccattgcaagaaacacttgctgaacgaactcaactatggtatatttttataaaggatgaaaggtatttcctattctctttagtatgagttaaatattctgtaactgcatgtgaaatggaaactagatttttcttttccagaaagaacatttactttttttttttttaagatggagtcttgctctgtcacccagtggcacgatctcagctcactgcaacctccacctgccgggttcaagcaattctgtctcagcctcttgagtagctgggattacaagcacatgccaccatgcctggctaatgtttatatttttagtagagatggggtttcgccatgttggccagcctcgtctcaaacttctgacctcaggtgatccgcctacctcggcccccaaagtgctgggattataataacctcttatgctttcttgctagatgcctttggagctggtgctttttgggctggagtgttttgacccttctgagcttccaaaggaggtactgccttctggccttttgctttctgggcaggaaacttctgggttgcagccttctttcccgcagtggtcatctttttttctggaactttagcagcagcactcttaatagcaggtgcttttttgggagacactttcaggagagctgccttttgaagcttcttaatttcattcttgattattctgttcctcattttgccttcatgactttaaaatgatcaaaatctgccatcttggctttcccttctctggcttcaatcttcttggcccatcatgtggctgcccattttgtattgtctgccctctgccaggcttatgggacataattctgctgggcactgtgtggaaacttgaggatgaaatcagtgagctgcatgcattttaaaggcataggctgtctccttacctgagtgcaaggtccaccgaccaaagccccattctgatcaataacatctacagttgtgaccagttttccagcctaaggtccaaggaagatgtaggttacctggccaacctccacgaagctcctcaacacaatgtcagtggcattcagtgagaaggaaactagatttttcaatgcagttttagaagactaaactgggagacagtagatggtacagtgaagcagatttagggataacataaggataaagttctgttatttggaactctttaaaaatgaattaggttgtcatttgatgcagtttctcatcattgagagtatttgcttgtttagaagggattcatcattgaactgagggctagtggctaccacagccccttgtacatagagtttatggtactttatttcatagggtttttttttcttccaggctggtctcaaactcctgggctcaggcaatgtttccaccttggcctcccaaaatgctgggattacaggcgtgagccactgtgcctggcctcaggggtattttccaaatagaaaaatgatctaaaacttgaaaatacagcctgggcaacatagcaagatcccatacctcaaaactttttcaaaaaattagccaggcatagtggtgcatgactgtggtcccagctacttcggaggctgagatgggagaattgtttgagcccagaagcttgaggctgcagtgacctatgacagcaccactgaactccagcctgggtgacagagacacatttcaaaaaaataaataaaattataaattaaacttgaaaataaaaataaaagataaatgtgtcacctagtttgtgatgaagagcattgtgtaacaagcttggagaatgaggtcctctcattctccagaaaaactcttaagtttgtttgaattacttttttctactgattaggtccagactctatgaagctagacattcattaacttgtagaatactgataagttgcaaatgatttctgtctagtggaaaaaagatgatcccccaaattatagcattattgatctaatgaacattaaccaattttgaatataactcagcaaacttatttttccattcctttgctggctgcctataaaaatctctcatcatttattgctctttgaaccagcttttccatcttgctagttccttcattaatcagttaaataaatctttgataacagctcattagatatttatatgagtcatgtttttaactttgtgaaaaatatactttgacaatatataagggacttatcatagggcttggcagtaaagtgctatccaataaatgttagtcgttatctatatcttaggactcgtacatttattttttaaaaagatactattagggctgatactattagggtacaatttgcttcattatctgtgattctgtctgctaatatgaatgagatatactcagataagcaaccaaacttgtgttgcaggaggtgtgtttttctggggtaagaggacacgtactgctatattcacataaaacataaccaggagacttgtcctagggcagactccacaatctctctcaggaatgtttgctaccctgaaggcatacagcagacaaagccaccagccctttagcagctgagttggctgctgccaaatataagagcagtgaatctactagcaggaagaacttgaggccatgtcagaatgcatactccatggatacactcccatttagaaatacaaaagtcactcctcctttcaaacctctcctttcaaagagtaagtggatttgaagttgggtgtgaagcccagagaagagtagatacgctgaatcagcctcctgggcctctgacacatcagcagagaagggacaatgacacacgtgactcccagcatgggcagccaagactccagaagcagaaatggacaggggagcaatgtgggacaagtattctgaaaagagcaagttacgttctgttgggaggggccaaagggctagagagaaaactaatcctgggagcgagaacacacccacgattgtgtgtgggggcacatggcagctgaggtgatctgagacgccccatggaagccagtactcaaagccaagcagacggcaagatggtaggggagatacaaaagctgcacattccaagtctttgcacctcaaagaccacctttggaagcttgtctctttgattatgaaaaaataaaaataaaaataaaggaccacagcaggccttacagccttcgcttcactgaaattcttcatttgtatttggtccccagagccctcacaatttgactgagacttttgagttctaagaagcttctatgaaaagctaaatatcaatttctagtcactcatttcctaatgtctccctttaccacactcagttgacatctgctctcctgagagatctggatttttggtgaaggtttggaaggacagacgcatcattctggaatgttggttaaaaacatatgtggaaaggagaagatattcaaaggtgggagacagaaaagaaataccaggggggaaaaaagacatttcccccttctggtaatttttgtacaaggtgggcattaatgaagcctctctaaagtttaacatcaggacttactgttcaaatttcagaaggcctaattcatccatccagccagccagccagcgagccactcatgcacacatccacccacctgttcaactatttattaagcatcactatgtgccaagcactgttctaggcattgaaaagtcagtaataatttaaaaagcaaacgatcttgcccttttggagctaccattctagttgacgatcatgaggcccaatggatgacatgagttcacgcccaacactttacttaatgtgtcattaaaagaggtaaatttggactcacattttttcatgaagacaccaaagggcaaaatggcttcatgagtcagatttggccatgaatgatggtcacatttctttctctaaaaagatgtacagcattgaaagagcagaaatattagattacatgggggctaaaccctggatcagagaaaagtggcctcgaaaattatctttggtgcataagcatgggattttaggagttttgcatatagtgtagcatttctttcttttttttttttttttgagacggagtcttgctctgttgcccaggctggagtgcagtgacccgatctcatctcactgcaacctctgcctcctgggttcaaacgattctcctaccttagcctctcaagtagctgggattacaggtgcccgccaccatgcctggctaatttttgtatttttagtagagatggggttttgccatgttggccaggctggtctcaaactcctgacctcaggttatccacctgcctcagcttccgaaagtgctgggattacaggcgtgagccattgcacctggcctagtctagcattttttaatatagcatcttacattcctccagaaaattgttatggttccaaaaagaaaacaaacgctaaaaatgtgtggctttactcgcacaaaggtgacctaagtcatcagtctgagacctgggcaagcaatgtcagtgatgtgtgttctctctgtttcctagtaaacggcaaactctagtttcaagcacaggtgggaatggtgcacctcaacttttttttttttttgaaccactaagaactgctattgtttccttctacagacccaagttctgaaagacaacttcctaaaactctgtatttatcaagtaatggtaaaccaagactatttcttatttttattaatctgagcctcaggttagcagtacctctacactgaactaattccaggtctgatgtgttagcggtcctgggaaaattgaaagacagcaaatatatattggggttcctggggtctggagctagacaactatgtgggacttgaattccggctcagcatttattagttgtgagaccttaagcaattttcttaacctgttagacacaattataaagttaggggaggcaagttaaaaaagatatatatgtaagactgtttgttaaagtattacttataatagcaaatgtctgttactggggactggttaaataacaattttgtctccacacgctcaagtactgtacaagtataaaaggagttgagaatagctttagatactgttatagaatgaactccattggatattgttaatttaaaaatatgaggtggagaaacacatgtatagcatggtattatttatctgagagaaggagagaaatacacacaaatgcatacacgtgtgaatgcacacatgcacacttacattacaaaaatggaaaacaaagcaaagcttaaaatgaaatgatgtctagagtgtgacctctgaataccatttcctatgaaacttaaccagggttccttggagcaatggctgatttcctgtcttaagcatgaaatgtacatgatgacgcttatcttaccggaaattaaggaagctatcaaagactgctgggattctatttaaaaaggacacagaaaccaattaaaggaggctctcactggccatagatggtttaagaatgtgtaaaaataatggctacacagtatgtgatgtcaaattatttaaatcgtaacattactcataaaaccaaatatataaatgatcaccttccaaggatgttaaggtaccaatacattattttgataacataagtatcaagctttttgtgtgtgtttgtgcataccatatgaattgcatctcagactaaataaataattcatgagaaaaattttctctttataggctttttccagctaatacatgaaaaatagaatgatactcttcaccctgttgcaactcccaataaaataacagatgtaggcaattgtcactgatggatattaacagtccccaaagagagagaactatttattatgtgtctactgatggaagtacaaatactgcctctgaagtattcttgtagaagaatcaaatattaatgtgataatcactggatcctattaccaatttatggggaatggagagaactatgttaaataataccaacgggtgtaaccagcaaaatccacattgtgggaaactctccaagaaaaatgatctagtatcttcaagtaaagaatgcaagcaaaaacaaaaaaaaaaaatagggagagagaaattctatagattaaaagatacacaagggccatatcaatccattgcaatgtatgcagctcatttggaacctgatttgaatgagtgaactagaaaatatttgtgagatctttaaggaagttgtaaactgactgaatatttgaggatattaaagagttactgttagggtttcaggtgtaataatggtacggtgggttatgtttgaaaaacagatctttatattttggagattcatattataatatctataaatataatgttatgcctggaacatgctttaaaataattcatttcaggagcatagggagcacacatgaaagagattaaccatgaagtgatcattaacaagttggatgatgggtacaagagggttagttaaactaacctctctacctgtttatatgtatatatgtttgatattttcataatttagagtgtttttaaaagttagtgagtgatataactctggtgggagtggtggcggggtcaaaggcagggaatgccagtgaccaggtctatttatagcaatgtaactttcccaccatgatcatgtttcatctcaacctcctagcactgtgagagtttcatttgtttgtgccacactgcaaacattttgaaaagctgctttttgaatgtcatacaccttgagccttgctttgccatccatcgtttttgttgttgttgttgataccaaagtaaccttcttatagaactgcattactcacccagtacataatggtgagatctctggtcattcccaagactgaaagaatgtaatgtgatactgttaaagacccatcagcttccctgctcccatacctgctcaaggtgagtaagctgatgataagaaagtaagcacagtgagtagcaaaatggcagaatcaacactgcttatttctcactggccatattaggaggttacaacagatgagttcttcaaatctctcaagatcagcctttcccagtgcaaataggaaaaatatttgatatatggatctttatcaacactgaaccatgacctgtgcatactgtgtcttgagatgttagctaatgatagcttgaaaccatcataattagtaagacataaaaaaccaagcatctaggacacaaagaaaaactcttttcaaaaagaaaaaaaaaaaaaaagggccaggaatggtgactcaagcctgtaattccagcattttgggaggctgagacaggcggatcatttgaggccaggagttcaaaaccagactggccatcgtggtgaaaccccgtctctactaaaaatacaaaaattagctgggcatggtggtgcatgcctgtattcccagctactcaggaggctgaggcacaagaatcgcttgaacgtgggaggcagaggttgcagtgagccgagattgtgccactgcattccagcctgggggacagagcaagactctgctcaaaataaaataaaaataaataaaaataaagttattttcttgttaatcagtgaaaaaaaggatgttatgcagaaagcaatttaaaagtagaaactctttttggaaatgactcttctagtgtgtgatgtgaggatgtacccatatatttgacatgcttataaaaatctctaatggtaattccagcattttgggaggctgaggcagggagattgcttaaggtcaggagttcaagagcagccagggcaacatagcaagaccctatctctaaaaaaataaatacattagctaggtatggtgtcacatgcctgtagtcccagctactgaagtaggaggctaaagtaggataagagcttgaactcaggagttcgaggttaaagtgagctatgatcatgccactgcacttcagcctgggtgacagagtgagaacctgtccctaccaaacacacacacatgcacatgtgcacacacacacacaaacatcttcctaaagtattgtaaatcatcttataaacttaattaatctgctctcagaggttttgaactaagaattttagtaagttttaaagaaattttcaaaaaaatgtaaagatgaaacatttattgaataataacaagagatcgacactagaaaagacagcaatttgctagcagatttttaaaaaatcctggagtagttggtgggtagaattgaaacacagatatcttggtgcagccaagcaatgcctgtctttcatttgaatctaaggatatttctgaggcatctttttcagttatgatcaagtatttttttaaaaaacctcaagccgggcatagtggctcatgtctgtaatctcaacactttgggaggctgaggcaggaggatcgcttgatctccggagttagagactagtctgagcaatatggcgaaaacctgtctctaccaaaaatataaaaaattagccgggcatggttgcatgcacctgtggtcccacctacgtgggaggctgaggcaggaggatcacttgagtccaggaggcggaggttgtagtgagccaagatcgcaccactgcactccagcctgggtgacagagcaagatcctgtctcacacacacatgcaaaaaaccaaaagccccagaacttttcctttaagttactaattcagaaagcgtgaaacaaaaattttcaaaaatactgaagcatattcaagcatatttttgattaaaatattattttactttattttcatgagtgaaaacataaataaatcaatgtatttatcataccattgataaatacaaccaaaacattattttatctatgactcgcccttttaaatgtacacttttatctatattttccatagtatattagcataatactaattattaataaatgagtacaaagaagagggtatcctcaaaatgttttactgataggatgtgtgttcaaaatagcttggaaaccatggatatagtgattaagggtcttcattttggaatcagactgcttaagtttgaattttgaatctattgtgaactttggacaatagcttggcttgtctaagcctcagtttgtctgtaagacaagtatactaatagtaactgcatgactattataaagattaaatgagataatatgtgatgttgtagctctgtctttggcacatggtaagtatgccaaaatgttaggtactattacgataatcattatcattgccctcatccttgtcatcatcatcctcatcatgaaatcaagctgtctagtcacagtcattcatgttctaaatataataataaaatataagtaatcttcaatgtgtctttaatgtgtttctcacagttgtataaaaaatgtcatacttattttggcagttttattaaaggtacagctgctcaactaggtcagatgtccctcaaggcccgcttgaatgatgtgatatgaacacaccacacagttaaatctgaaataactgaaggacaggcagtgaatgcaataccttttctcattagatacctcccttaattatttacaaagtgcatgaatgaaaaataagagggtcttggaagaaatcgggcaggacatacgccaagtacttataaccatacgtattgttacttcaatttcctctagagttctgcttgtgtggctgaatccctaggttttctcagataaaaaccaactgagttaagaagaggttgagaaaagcacgcacttcaccacgaagtcggtgacccatggaaagctacacacttctcaatgtctagatcttaaacaagatcgtaaataaggtcttaaatgatcttaaacaagatccacgccttcaatccatgtgttttgaagacgtatcagaatgatcttgggacccgacacagctgtatttgtaaaatttgcaaagctattgtatgtgtactttagtcctgttttagcttttgatgtgatgatattccttgttggtagggatttcctgcagacagggtctttcttaaataatggaattattagtgtattttcaatcagttgacttctgtttgaataaactgctgtcttgcccctctttttgtactctaccagagagctaacaaatatgggcaaaataaatctctccttatgaaggaaagcaggattttgcccatatatttttccaagaggattttaaaaataaactccactgaactttaaatttgaagtactaagggcttagggtacctgtgactcgtcttaagtaggactgcaaataggaaacagagttgaggctccaatattaatctggctccatattcaatgctggtgatttcgaagacattcattcaatgatcacaaaaatatgttctccctgacttttgctgagagcagatattagtttctgaatgattgattttattggccagattgtggtggttcaaagcactgagcagaactgtggcaacataaaactgacacatattcattctcaatcactggtgtttatgaagttctagtatcaatggccactatctgagctagagttggtgccaagagctttatatgtactatcctgggggttcttcttgacaatactgagaaataagcactgctattacaagtgaggaaaccaagacttaaggagactgaggaacatatccaaagtcacacagccagaatggagtaagactccaagttccaacctaaagccaatgttcttaataaacccattatatagtcaccccaaaaggggagtaggagtatgtgagtctaatcagcacacttaaagcattttattgaaaatggcaggcctgttagcattttccttgtttttcataaatttaacagtattttgctcaggctactttgccccagtatgttgttctttgagactcagtaactatcaattgacagcaaggaagaagttttaccaataggctggcaaagaagctgggaggggtgcagaagccagcttcacactgaacacgttccagagatattcaacaacagaagtaatccatatgagaaaacaaagggagtagctggagtctttcagaagttttatgtttattcttagacacagtttcaaataaacctatcaaaatattgcagtgcagtgagaatgtgaataataactccaaagaaagtaataattataattaacgtgtatcaagccttattatgtgctaggctctcagccaagcccttaacatagtttttcctgctctcactcccttcaacaaacttttattgagggcccactatgtgtttggtcctattctaaactctgtgaaatagagccttgaaaaaaatagccatagtccatgctctcagggagtttacttttatatattgtcttttaggtacatgaatacaagctttttggaggaaaatttgcaaattttcatcagaaggcttaaaattctttaaaatatgtgatttttgatattatcatataatgaaataatacttcagacactagaaatgatttagaattttatgaaatgatgcaggaaaatgttcataaagagtatgcaacatatatttttataaattatggacacagaaaaaataagaaggctacataatcaccaactttatagtagtatctctgaataactggattgtgggtgatttacattttatgcatttttatttgttttttctaaattcctatgatgaataagtactactgatacaagagaaattactttataaatattgtagccctattcatttctattccagaccatttgttctgaatcttatgtctccatgtatatttgtttctgaatctaatgtctccatatatattttgaaagagtataagaaatggaagtaaacagtgctatatttcagtgattactgtcatttagaggcaaatagtacagtggggagtcacagaactagattcatactagttcagcaaatatcattttgcacctaggaccagttctaactaccaagaacttcagattacatctcctgtttgagccttcctttacccatctataaaatgaaaggattggaaaaagtgatttttaaggatattgtcaatgatcaaaagttattttccttgctctattgacaacgactatggcttctagacctttgggcattcatggaagtccagctcttaacaaagctacacatggagaaaagtcacattgtgattcaaagggaccagagagtgtctatttgcagatacaccctcatatattttctgagtctaattagaatattttcaataaagttctgatgcttttgttaccgtcatgataattctgtgttattttaaaaatggtgacttttttttttatcctcaagcacatgtgttggctcctaagtaaaaaaaaaaatacgtatttatcagtattctttgtgcaatatttctgtttcccatcaaatgttcaagtgacttacatatgactaggacaaaacaagaggggagacaaaattccaggtccattaaatgagatatgaatgtaactgggaatcttaaagcagattcttttcctatacacactgaatattctatagcagtatagtgcaatgggactttttggaatggtagaagtgctctatatctgcactgtacaatatggtagacaatagctacatgtggttagttagtgcttgcaatatgactagtgtgaatgaagaactgaatttaatttcaattaattgaaatagctacctgtggctagtgactaccatattgtgcagctcaggttacagccttgctatatagaatatgtctcatggaccagcagcatcagcattatctgggaattactagaaatgcagaattgttagaaatgcagaatctcattccctattgtaacctactgaatcagaatctgcattttaacaagatctccaggttgattcatatgaaaactcatgtatgagaagcattgctctagagaaaattgctcaactttccatttcattgcatcagtcaatcaagcaaccaaatgatctctcaataagtcagcaggtaccagtatctgctcatggcaccaggcaccggataagtcacggcaggaaaacggaaaagatataggaatgtgcactatgcagtacagcatggcagataattacctttcaaactgttctggcaatgccctttcctaaatgtgtcacgttaagcaagatagtttacctctctgtttccccatcctttaaacagaaacagtttgtgaagattaaattagataatgtactttaagtgcttagcacatgcctggcatatagcatgtacccaataaattgtcattttgctgttgttttacttatcaaggctcttataatgaagctgcaggagattcacatccttaaaccacctggacctttgtggaacatgtgggtattaactacagcccatgctgaaaagatgctgaatcttatgtggcttcattctccaagaatgcaccactctaatcaatatcagcatgtaggaagataaaacacttcagtacggacatattgttcattatataaaatgtcaaaagagagtcaattcatgtgactaatgaaggtgtttaactttttttttttttttgagatagggtcttgctctgttgcccaggctggagtgcaatggtgtgatcacagctcactgcaaccttgaccttgacctctcaggctcaagtgatcctctcaccttagcctcctgagcagcttggactacaggcatgcacccccatgcctggctaatttttaaattattttgtagagacagggtcttactaagttgccaggctagtctcaaactcctgggctcaggtaatgctcccgcctcagcctcccacagtgttgggattacagatatgagccattgtgcccagccttgtttaacttttaaatgtcatgtcctctgccacaggatcttggtatattttctgaatgaaagctcgcattataattaatttacttaaaaaacttattttttattttttagagacaaagtcacactctgtcacctaggctggagtgcagtggcaaaatcatagctcactacaaccttgaactcctaggctcaaacaatccccctgcattagcttcccaagtagctagcactacaaatgcatgccatcatgcttggcaatttgttttttattttttgtagggacagggtctcactatgtttctcaggctggcctcaaactcctggcctcaggtgatcctcctaccttaacttcccaaagtactgggattacaggcataagtcactgcacacagctaacaaatatttattgataacttagttttgggagaaggtttaaggatggattctgcagtcagactacttggatcagaagcccagttctgccacctagcagcacattttaaatcttttctgtaccttaatatcttcatctgtaaaatgggaaaactacagtaatgaatgaccgtttaaaaaactgcctaaaacttgtcagcataagaagtgtttggaagtacttttcttcacaaattagtactacccctactttgctcagctttcagaccaaatgctgcaagaacttatgaatgccaagtgacaacaagtatttataatgcttgtgaaacattaacaaacaaaatttaatatggtgtagaatgtggcatcactatttatttaaaatatggtccttttggtattctttgtaactgggtcttcttcaaaggaatccaaaacagacctgaattatacacaatcagtttcagcggtgctgttgaccaaatttatccatgaattgaattaaaaattatagaagagtttggaggaagacgttcagcatttgagctaatatgtgcagcagatcactccattaagcatcatttctcattttgccgcatcacagttaaaccagaatgtggaccttttgatataaaccactgctggaaaatgactgtaccaagtaactgggttctttcctctgactcatcctgaccccagctacagaaaaccagttatctcatattgattagggatgggcttacttttggagggtaattaatctgttttttaagagagctaatagttagattcatggactttcacatacaatttttttaaaaattgaaaccatcctgagcatatggtatgaatgtgtgtgtgcgcacgtgcgtgtgtgtacgtgcgtgcacatgtgtgcgtgcatgcatatttgtttgatgattttgttcctcaaaatcattgttataaattacagataacactgtggaaaatccctagaagagaaagagttccaattaacatccaatttgttgttggggtctgtggaactccctggggtgtcctagagccaagaagtccaggcaaaactaaagatccttgggcttccaactcaattatccctcaccctctcaaatgaacaagcaaataaaatatacactcaaaatctgccaagatacacatgtgaataaatggactagtggaatccagcgataactctaatttaaataaaaaatatgatggaatgatgagtaacagcttgggctctaaaatcagtctgggttcagttcccagctctgccagtgactactaaccatgaaaccttggcacatgatataaagcctctgaagtttccctgtgtgtagaatgcggataacaactgtgtcaactagatacatttgttataataattaagtaagtagtgatggaagcttgtatttacatcagcatgtatgaactgctcctttaagcactttttgtatattccctagttactcctcacagtggtccacaggatgtgcagttatctgctccctgtctccactatacagatgaggatataaatacacatatatttagtaacttgcagaaaaacaacagagctggtaagtggagcaggtagtgttcgaactcaggaggccagactccagagcccacatgtaaaccattctgcataagatgtttgatatagttacaggtatttagtaaataatcataatcagtaaatattagctattcttgttattgtatttatggtagatggtaatgaaaactataacaaaaactattgctaatgtccctcattccatcatcttttttccctaaggatgggagggccccgcggatacgtttctgtgggctagagaatctgttgttcatgtttacaagacagacgcaaggtggtaaaaaaaaaaaaaaaaaaaaaaaaatgcaagagctcttcctgatgaatattctggtctcagtagtctaggtaaagaatttttaaaaatctaatttctcccttgtcttgcacatcagtttggagaatgtggatgccagtaattatcctgtggcgggctctcattcagatcactgtctctttgccagagcgctatgggttctcagggggcctttctctgcaggctgctgagtgcttttggtctcagagctacccacaagccactcatgtttactgacatcttcctaagaactcagactctccatctctcttgacggaaaatggccatataattaaagatctctatatacgaatagacttcctcttcctcaaaatcttgatctcttgtctcactgcagggcctttgcacacactagaatactctcccaccagctcttggcaaaacctcacccttctggtatcatttttgaaatcaccatctctaagaggcttgctcttcctaatctaaatctcttccactacaaccctttcatcaccctcacattttctatttccccagagtacttaccattaaaaaaatactcttgttagcatatgccctagatgtaagctccatgaggtagggcccttgtttttcttgttcgtcactgcacattctatcttagcatgtgacactcaataaacattaaatcaacaaatacataaatttgcttctccttacattagctggattcttcagaccgttcttgtttactaaggcttgtatttttaaggtccatctcgctttaccaactttctgtttcaggttcttcttcataggccctcattcattcattcactcaataaatattcattgagtgcccacaaagtgccagacattggaggtcaaagaggaataaaacacattctggcccttgaagaactttgagtctcttgggcaagccacatgtggacagatgatttccacagaaccttctgtctactactggtattatggaccacagaagggctcctaaccagacttggatagtaggggaaggcctcctgcaagacatgaaaaaggagctgattgctgaaggatcaatgggaggtaacagagtagagaagactgggaccatattccaggtggagggaacaacatcaacaggggtacagaaatcatgatggtggggacactctacatgattaaatgttagatgtttaagtgtgaggaagggatggcatgggccaggtcatggaaagtcttgaatcatgtgctaaaaagcttgaatttgatcctgtaagaaccaggagctatgaaggttttattcaggaaaatgaaggtattatgtcattggattttttcgtaagagacagggtctcactacattgcccaggctggagtgcagtggctattcacaggtgcagttccattatgaacagcataagagtttgacctgttctgtttctgatctgggtcaattcatccctccttaggcaacctggtggtccctgctagcaggagataaccacattgatgctggattcagcacagacaccaactggcatagtgcactacagcccagagatcttgggctcaagtgatactcctgccttagcctctggagtagtttggaccacagtcacaagctaccatgctgtggcttatttgaatttttaagaagcatgcttacaacttccttttcttgagctcatgaatggcagcaatttgcacctggtcaagttaagaaaaaggatgatgaaatccgtgaaggagttacataagaagacaaatgatgtcttaaaaagacattaaaaatttttctggagaaggcctatagcagagagagtctaggcatgggcataattgcaactcttatttatatgggcatcatttgcttaaactaagagatgatttcactctgattggaaaccatttctgattcaacttaaatgacctgcataaatattttataaccattcaggatcagcatatttgcagataagccagactacttaataaaatgtgtgttttagcgctgcagagaggaaaaaaattgaataattgtaggaaatgttggaatcaaaaaatgtgtgacagaaattctttgggtaaacaaatcattgctatgaaaacactgcttcccataatttagtatttagtaatcacctactaattaaataaatgctagaatattgcgaagcttaagtccttatttttcttaaaactgtaagcatgcttatatttacaattttaccaactgcatattttttcctttattctaagagaaaaagagaagtgagatgcattgagacagtctggagaaattaatgcacagagttaacctgtattatccaacccaaaagttttctcctggaaaatcagtttgagttactgtatggtttttgttttttgttttttttcctcagggagtgtccatgaaatagccctttaaccccattcttttcttgaggaatggcagttacatttctttgttttgttctttcttatatagggggcccataaattgtgtcctgtgacggtgtttggtttcctcatgggtagagatcaagtcttgccttctgtgtgactgctcccctcccagcactttgcatgcagtagacgcccataaaatatttaatgaataatgaacgaattatccaatcaactctcactccacttcatctcctgtttgatagagaagatagatatttccagaaaggcaaatttaaaaggtttcctgatcatgtcctttgcagagacatggatggagctggaggccattagccttagcaaacgaatgcaggagcagaaaaccaaacaccacatgttctcacttataagtgggagctaaatgatgagaacacatggacacatagagaagaacaacacacaatggggcctgttggagggtgaaaggtgggaggagagagaggatcaggaaaaataactaacgggtactaggcttcatacctaggagataaaataatctgtgtaactgacccccaggacacaagcttacctatgtaacaaacctgcacttgcacccctgaactgaaaagttaaaaaaagaaaaaaagaaaaataaaaggtttcctgaaagtaatctataacaaaaaaatcttttgagactgaaaaatgtaacatatatattttttagaaacgaccatgaaaactaataaatgcaaaacttaatgtttgacattcattcattcattcgttcaacaaatactgagcatctgctgtgttctaggcactacatttggagctgtggatacaaaagtgagtatgaaagacatggcagacagacaatatacaagtaagcattaaataaacattccagactgagataaacgcaatgaagcagataaacaatgtgatggctaatactgagtgtcaacttgattggattgctcctgggtgtgtctgtgagggtggtgccaaaggagattaacactggagtcagtcgactgggagagacagacccatccttaatctgggtgggcaccatctaatcagctgccagtgtggctaagataaagcaggcagaagaacgtggaaggacttgatttgctgaatcttccagccttcatcctccttccagcaggaagctgtatgcttcctgctcttgaacatcagactctaaattattcagcttttggactcttgggcttacaccagtgaagcctgcactgttggcttatctacttttgaggtttttgggacttggactggcttcctttctcctcagcttgcagatggcctattgtaggacttcaccttgtgattgtgtgagtcaataatccttaataaactccccttcagattcacatctatcctattagttctgtccctctagagaatactaatacaaacagggagatgaattttctactcatcttttaaagttcagcccaaatgttacccctgtgaagcttccctcaatatccctaggatgtgttaggtactttttcctgcttcctctcattaatctttccacatagcttctttacacaatgtttcactttgtatcccagtaacaggcttgtcagtattcataccagattatgaacaaggatctcacatataggagacattcattaagaaattgttgagtaaagaatgaatgacctgtattggctcttaaagcaacagaagctcccaagtactgatggagaacccactgccatgagtctctctagacatcagcagatattttggcatgaacttcagcagccattcctagtattaccctatagagctgcttgtccaagctttacctgatggtcatcctctagcaccctgttgtggtgaccctcctctagacagcatatgtgtgtcatgtgtgcctaacttgcccatgttctccaggagaagagtaatgcttcacagactgtgcttcacagattgtccaccactgttgacagcactttacttgggtgctctgaggaactgtgcatttcttaaacaaaagggttaagacccaaatgagggggttactggttcagagctaactctagattctggcttttgtagccgagggtgcctctgtccagtgttagccatgtagcctgttggtgtgctctaactctggaggcagactacctagattcaaatcggctctgtcacctacttgctcaacaagttcacctatgaaacactcttccttgatatcttggtgagaaaaattataccttcacagactgatcctaaatttatctctatttttaaataacttgtttcctctatggaatacattcaggtctaaatacattttgtcaagcagcaagataatgttaggattacaggcacaaattctagagtcaaatcaacctgcactcaagtgttggctcttccagtttctgtgtatgtgaccctggggcagttgcttaacctctctgagcctcagctatttttaatgtataagtgtagacaaactgtataatttggggtttataatggggttgaatgagattatgtatgcaaagggcttgattatgcctgggaaatgggagctcaataaatgttagccactgttaccaccaccaccaccatcacagttggaaagtgattatccatgatatttctacatttctttgaccactttcattcttggctgtcctttcaaggatatttacatgtcaaacagtcttggaaagtagagatagagcttctctgcagggcagagggaagatttgtttcctgactaggataataaggataatgtttctctcctgagcaggtttgctagcagtaccttataagattgggctttcctaagctcagggttccttagctgtcacatagacccacactgtttgtgggatctgcctgggctcctccaaattaccccccaggacttggggaacaggggaaatgggtgccaacagaaagcacatgccctctgctgtgctgtgagtaggacagtcctttgtcactttcacaggagtttcgtgtcatctgccagcatttaggaagctcagtggagtaaaattgtacacccttctcagttctttaaaatgatagtcatcatcattatcaccatcatcatcatcatcatcattcttttgggtgaaaaaaatgttgaaagcaaatattaaggtcatcatcctaagtgaaactccttttatgattcaggggtaccactccctttgaaggtactaatcatttgacttttatatacagactatgactaatttattatatgcttttccagaatcatgtagaaaaaatgaaaactaaatttactgggaagatattttaaatgtgagtttactgtgtgtttactgaatgtgagttaacatgacttattaaatatagaaatatgtttaaattacagattacagatttgcgttatccttgttaatataaacatgttcatttatttctgctgggttttgaaggcacagaattcaaaatcagagccacccatgcaatttggtatgtatattgtagtgccatgattttgttaaatgtgtttcttaatatgctttttatctatgtcattttagttaaatggtttggaataaaccaaaacaacaacaaaaagattaaaacatctttcccagaaaacgcgtttacaaaacattcgttctcgatgtcttagtaataaaacaattttacacctagagcccccagtttaattttccttctttctatttttatacaaaacccttattttcccatcaggggaaaacagagcttagctacatttgttaaggtggtaggctggggtagatggtaagagtagagtcaagtcagtcaaatggatcttgatttaagtcctggtttccccacttgctagtgtggtgactaaccttggactgtgaacctgtttcttcatctgtagagtgggcattataccacaaaccttgaagaattactgagaggcttaactaacagatagtgcttcaagaacactagtgaaatatgtgcttataatataagaaaagaaagaacagatgatctactccataaatgccattgatgcaagaattttttggcagatttaaagttgaattagaaataatctctgccccacaactgttctttggttttatgactttggcttactctgaaagattaaaaaaagaaataagcacatagaatttatatttatttgccatagggatgatgttaaagatatcatctcctatgtttctcagtgagacctcaatgaaaacccaggaaaaacattatttcatgcataaggtcccagataatcttgtctttccttaaggaatttttatgcttttattcaggaaaaatatgtgactttcctgttgtgctgtggctatcaggaagctgtaaatgaaatctgtggttccatgttttaaatccagcaaattagatattaatgtttgattttaatttgatattaataaccataatagtagctaccacttatttaacgccaatatgtgccaggtgttgttcacaaatcatctctactcctaaattgacctgtgaagcaggtgtcattaccccgttttacggattaaaaaaaaaggcccagctgagtgaagctactttgttcagggtcacacatgagggaggtgaaggtgagatttacacccaggtggttctgacctcaaaatgtatgttctttctactgttgtaatcattgagcctgtctagattttcctgaatcttaatttttttctttatagttattttgttggacacaattgtgcagacatcactctttgttttagcacactttgcttgttttaaacattgctttgtggtttctatccagtgaagtctttgtgaggagaaagattcagattggcagctttgcctcccaaagctgacctacacagcaaaagtctgttctgtgtaagcaaataatatatatcagtggaacatgattaagccacaggacacataaggccaagccaaattttgactataacctagtattatggagtgtggacagtgcataatgatgccaaattaagacacacatgcacacatgtgcacacacacaaacctacatacctgtaaaacacactctcatgagtttcttgaaatattgtccaaaaattctgcacctacaaaaccagcttgtctgctggctctttgtaaatgttgtactctttgcccggaatgttttccttcttaccactttctttacctaattcacttctactcattcttcaaatctctaaacagccttcatattcactgagccacctcccactcacccctcttcaagattaggtcaacctctcctaatctctctaacaggtgcccagcatcttcaaagtgataggcacctaaaacattttaattgaatgaatcagtgaatctctggctgatggatttcgatgagggtcgatttagagaccctggatgaaggtggtggtttcaaagtgaaaagagctcaaaatctacctttaaaatcccaggtattgaatgaattgaatgaataaacaaacactgatagattacttatccagtggacattcataatgcttgacaccttcatagtttttcaaatcaggaaactgaagttagttcattatggtgtacaatctttcccaagggtcaactaagcaattcccagccatcctgctctttcctactattctctggtctggttcagaatgttgatccagagaaaagaggcatttttctgtgtccccaaataggtcatttccagcaatacgtccacactgttaagaggcactagttttcagacttagaaggcagtcacctagtagtgctgagtaggcttctgagatgagcaagaagaacacttaggaaaggacagggctgaggcacagaacactggcctcttctatgctttgcctcctcttagcaacctccactattctgccttcaagatgtgttttaatgcataggagagctgaaccatgcaactccacattgctacacctgctgggtgatttactgagtgggtagatccacaagatcaagtatccactagctggggaaggagagaagccttgatctgagacgaatgatccttgaaaacacagagaaagcttattaaagagcctgtaagacattaaggtaggggcattactgaataatggcatttgagatgcttccttttttttttttttttttctatatagcagggattctcaaccagagaggattttgctcacctcttcctcagggctatttggaaaagtctggacatattttttagctgtcacaactggaggtgagggggagactgctactggcatctagtgggtagaaggctgtgttgctgcctaacatctcaaaatgaacgtgatggcccttgccccacgtgtcaacagtggggagatgagaaaccctgatatataactatatgatcctgggttccttaccctccttgtgcctccacttttcatctgtaaaagtgggtataacaatcattcttatctcacaaggtgaatgtgagtgttagcattgtcatctgtaaagtgtttttggcccatagaaaaagcactctaaatgttaacagatagtaagtcaccgtgtagcttaaaaatcctctcgttttcccaggatacgagaggataattttcagggtaacttcaagttcttctcctgctgatcttgtcctacatcctctcaccagtgaagcctcatttgccaatttctagtccctcaacagatcccacttttccctccgtggggcctttgcacaggctggtccttcttcctaggtaccctttcccacatttcttttggaaggccttctaatgtcactggaaacgtcattacctcaaaaggacctttcctgaccacactgcctcagtaggactctgattttattttctctggtgcctccctgctccttgaacagccctggtcacaatcaggacgtattaatttgcttgcttacttgatgaatgtctccatcccccagttgattacatgctacatgtggacagggaccattatgtctgtactgcttaattcaaggaccacaataaatacttgacggatgaatgaatggacagataaatgaagaaactggggagctgggaaaaccactccccctttgaggctggaggagatgaaacacatagtgaggactcagagccatcttgaggccaagggtattctattttaatagctttctcaagaggaaaggccactgttgccaggggcgattctgggtagaatagggctgagttgggtgagaggggtgagtgactgagagagagaggaaatacattcccattatgttgaaggacagcccttatttatattaatgtttaattccactgacctagtttagactcactagctttatgaatttatttttggcttgttttttttcttttgggaagaggttcatcagagatgagagctgcagtaacaacatgtttcaatatgttgctccctggcgatttgaaacaccccgagaaatagctctgtattgtgtattgttgttgccttgcaaatctatagcacgtatttgacataagtgctttaatattgggaggctgtagttcagattacaacgtatcacagtgatttatattttatctttatttatttatatatttgtttatttacttcaaatggtgaaaagacaaaatcacatagtgttgaagtgccatagacacagtatgtcctgaccttataatgggaagaggaggacaaaaatctcaaatttactgagagtgaacaaagtataaataatcaaggattttaagaaccaatatcaagaaatatagaggcccaaggatggaatcacagagatgaaatcagtacagggaaggatttctcacctcggagctattgacatttaggaccagataattctttgttgtgggtggcagtcctaggcatggtgggatatttaagtaggattcatggcttctactaactacatgcctatagcactccccagttgttacaaccaaaaatacctcctgacactgcagaatgttccctggaatggggttaggggtcaaaattgcccccagttgagaaccgctcactgttattgagaattcatttgctaacatttctcaagcgctgctttctgtgcccagtgtactgtatccatcctctcagttacgcctcaaaggcaacctatgaagtaggtattaaccttatctccctttgtctgaggaagaaactgaagctaagtcatttagtaactgcctttgatcactccattaggaagcactaagggattggtctgatttcacactggggttggtctgacttcaaatcttacctcgaaactactatgctattacgtagtgtttttctcaatcttcatttaaagatgagtcatctatagtttatgaactgccttcaatcaattttcctttcccttccttccacaaacatgtatcagcactaactatatgtaaagcagctgtgctaactgaaggctggagaggctctgctgcctaatctcattttacttccctagatccattctcttcccttttcccctctgctctgtgttcagggatgctgatttctatagactgctgtaaccagcttccttgcctgatgcttttctgttgagctcagctaatgagaggcaccagcaggagatcagggtgggaagagagagaggttggagtatttaatatactggctccttcctcccagagagcattttggcacttctctatctaaaaccacagttcttgttcagtggcctgtcttttgtgccccaagctgtcaccagtaacctcctcccctgcctctgcaaactatgggctccctgctgttgctagccctagggtgtttctccatcccttatggcttttccttgctctgtccaaccttctttaaataatcccttcataatgtacccctcaattacccagtctgggcgaggcagctgtgttctgccagctgtgttctgctatgactgatacagaggaatgaaagacactaataaaggatgagagcctaacccttccctgggaaaattttcaaactatttgggagacaaattgttcagaccaaatagctaaagtaattacgttgtgtacatagaaaatgtacagtatactaacaatagtagcaatagtaaagactttcattgaacatctactttaaaccagggcattcagcctgggcaacatagcaagacctcgtctttagttaaaaaaaaaaaaaaaaaaaaattagccgggtgtggtggcatgcaactgtattcctagttactcagaaggctgaggcaggaagattgcttgagtatgggagatcaaggctgcagagagctgtgatctccactgcactccagtctggacaacagagcaaaaccctgtctccaaataaataaaaagaaacagggcattaaagtctttctctcacttagtcctgacaataaccctgtggggtgtgtgttactggtcccctttatggttgaggaaacaggattagagaaattaggtaacgtatttaaggacatacagctagtaattggcagagtatgttactgaatttaatgatcaaagtagagtttaactaatattaacctcaattgcaaaccaatgtgatttttttaaaaaaggaaacaagcataagaacaagcaagtatttttgaaagaactgtctgcagttgaaaaggcactaattcaaatgacactaatttagaaattgtccttgctcaggcaaggaatctgcaactcttcctgaataagattctggaataattatttcctctctaacatttatagtcttgggacagtgaaggctacagtccaaaagagatcgctttttaaaatcaagggctttgaaattaaagatgacttcaatgagtctttaattcctgtattttaaagatagtttgttttcatgatatattattgcacaaaacgggtctatcagggaataagacattttgacccaagggtttgaccctgccatttcaatgccacaaatgtctaaatgtcttgattacaaacattaatcagacttaaatcaacactggggaatcttcatcaaggcagttgtttcttggacaaatatcagtaagccaatttaattctttcatcaaatttcctttttttttttttttgagacgtagttttgctcttgtcgcccaggctggagggcactggcgtgatctcagctcactgcaacctccgcctcctgggtacaagtgattctcctgcctcagattcccaagtagctgggattacaggtgcccaccattacacccagctaatttttgcatttttagtagagatgaggtttcatcatgttggccaagctggtctcacactcaggagttcaagtacttcacctgcctcggcctcccaaagtgctgggattacaggtatgagccaccgagcctggccatgattcttcaatcaagtttctatccaacacgataaactcatttccaatttttcaatatttttattttatcaattattttcataggggtgagctcatttcttttgaaaatctttaatacatatttacttcatctgccagtttttattcacaatgatttcaaatatatattgccacagtgatttttttcattggccattatttctactgaggttcattttcctgggtcaactgttatatatctagattttgtcaagagggtgctatttcccatcaatttttaggtactaccaacttggtatttcttttttctttctttctttcttttttttgagacagagtcttgcactgttgcccaggttggagtgcaatggtgtaatctcagctaactgcaaactccacctcccgggttcacgcgattctcctgcctcagcctcccgagtagctgggactacgggcgcacatcaccacacccagctaattttttgtatttttagtagagatggggtttcactatgttggccagactggtcttgaactcctgacctcatgatccgccagcctcagcctcccaaagtgctgggattacaggtatgagccactgcacccagcctcaatttgatatttctaaacgctgaatgtttctaaatggaatgaaatgctgaatatatctaaatggaataaaaataataaaagattgctagccttatgagaaaactgaggtacaagattttgagtctgactctccagaaaaatgagacttagagaggtcaagaggcagagaatgggagaaaaaaagtaaaagtggacaaagagagagagcctgaagctctcctggtggtctggttacctattcttaaagtcttcagggtcaaagggtgcggtcaaaaagtcctgcttcaggcccaggttgattgctatttgtcatcatcattctttattttccttagtggcacccagctgtatcttatttgtataatttctcttaggttgcaaggtaccattctcctggttttccttctgactccctgaccttccttcccagaatccatggtttattcctcctcctctgtttgatgtcaaatgttggggagtgccagggccctgtcctgggtgtcctttcctcagtgtcctttctctttcgatgttatcatctaaaaggtggccttcagtgccaccttctatgcaaataccactcaaaactgtatctctagccttgaccttccactaagcactagactcttagatccaatgcttaacggatgcctctacctggatggtggagtacaatatgcatttcaaacctaacacaacccaaacagaattctggacttttccatcctaaacctcttcctcctccaactcttcctcctccaactcaataaacaataccaccatgtactcaactgcacaaaccaaaaattgtagacattattcttgatttagctttttctttctttttccttcacttaatccatcgtcaagttctgttgagtctattgccagatatagctcagatcctactacctctgtacatctgcactgctgccacttgaatccttgccacagtcctttgctgatcaattgtcatgtttcctcattgaaatcccagctcccactgttgcttttcatactttctagatgttagtgatctttaaaaaaaaatatattgaatcacgttgctcctcctgcctgaaacttccaatggctttccattgcacttagaatagcattcaaactgtttcctctggctcaaaaatacccacaagagcaaacccctgggcacctctgtgatgtcactacctttgccctcttttactggatgccagtgccacaggccttctttctcttcctcaagcaagccaatctcagggtttgtcctttctcagagcttttccacagcaatcatccttacatttgccaggaatactcattcctcttatctcatgtgactgtttccttttgttgttcaggtttcagcctaattgtcatctccccagactgcccagtctaaagtagctcccaggaagtctctgttgcatcacccagctttaacattatacaaagcacttatcactctctggtggttttcttattaattacttgaacagtcttctgtcttattccactagaacgtcaggtccacaagaggagggatgaggtttgtcttgcctattgctgtattttcatcctctggcacagtgcctgtcatacagtagatgatgcataatatccatgaaatgaatatgtgtatggtaataccatacacatcagaatataaagacactgtaggtgtttatttaatagactctcacccccatcattctgaacacatacaattacgtcttaacataaaacattgccttttaattttgctgcaattgccacaatatagccatatcactcacaaataatctttgaataccaggattattttcaagtggtccacactggcctgcatattttctgaatctaattagaaccacaggccaggatgcaattctaactctgctgctaaggacctatgtgatgctggtcaagccactaccattacgggcccctaatctgggaaatgaccttccctaagatccctttcagctctaaacaagcaatggagagtagtcctcaaaagcatggttttggtaccagatggacttgaactaaaaactattttctgtgtaggagaacatgggcctcagtttttcctctaaaaggtaaagacgataatgttatctatggccaaataaatgagcaattttattcacataatcacccaatataactaccagtttataatgagcactcaaagcatattagtagtagtggtcatatattattattattaatataatcatcatcatcattcatgagtatcaatttctgagaagcagcttttcaagtacatgcccactaaatattaaaatcattggggaaattctcatgaaagtatctgattaatttctttattactcggatttgtttttacaaatggtctgttgtctgttcttttccagagcatgaatttctgataatcattgagagaacaaaatgacttccattatccagttaacatacagttctgtagcagaattaatccatgtctttgcatgctaagtcatagaaaactgaatagctgtatcctaaaaccatagcttcactcttgagtgtctttgttccctgtgagcctcctctgctgaatatcccactgtcatttctttgcttttccactcccggtccacaagtagaaatgctgcccattagggcgattgtgagggcgcagggctcttacgtgtgtttggtgcctagcacagagctgtgcacaaagcacaaaggaggctatcagttaagctgagctttcttttccccttccaattcaaatgaacctgatacaaaatccaaaggaactggtactggtggtggggaaacaaacccagaatagaggaatagtagtttatggaaccagactctgtttataaaccagcccttcttaaactgggacccgtggttcttagctttcatcaagctttcttagaggttgatgccccaacaaaagctgaatcagtgatgtaaattgcaaaaggagttggagggaaagcacatttgaataaatcaagtcaaatgctccacaagattgttaatatttaactaagagagtagcctaacatttttacttaattgctctctcctcttttttccacatattccacccactcctcctaccagccaatcttataaaaaaaaaaatctgtaagccaacattctcctgcactccttcagagctgctcattgcataatcacctctagagttatctgcttgtcatttccatctctcagaagcacacaccatccacaccagaagcctcaagaaaatgcatgcattgggcactatggatttatatttgttgtttagaaataattgcaaacctaccatttgtagattaaggaatatggcatatgactgttaaaagccgtgcattataaagtcttatctcaatcctatcccatcattcaaagcccagcttaaggcttcctaagaccttctccagcagttacttctcttccttctctgacaggtgtgccacctaatgttttgctcaggcagctgaacaatggcatcaatgctgtaattggtaattcacaattctttcatacagggcaagggctggtgcgtattaaatcctcatcagctgatttttgttagaaagtatcttctcaaaatgaggacatccattgtctctaaatgtcgtaatttaagcaaattaatttataaacttaaaacaacaaaaaggacattatgtgggagtatgaattaaactttacagatactagtatttatttggctttaatatggtaagactgcttttatctacctcagtgttttttaatggcttaaatgtcttttatctatgtatatttcctcctaagactaaataatatgtttatcttatgtaatggtatatataaaatcaaattacattaaaaagattttcattatgaggcaaagtatttacacagtaatgccaagtaaaagaggcaaaatacataattatatacggtatggcttccactattaaaaatattcaaaaacaactggaaggagatacacaaaaatattaacatatgatatttatttttggtggtggaaagacaggtgattgttaagttacttttatatactttcctgcatgtgtacattttatacaatgtgcataattttactatataatcaagaaaatgccactttttaaaaagtccttttgccttaatacataaggtggccttcaagtgaggtgacactggtcaagctgtctagctaatatgtccaagtttcatcagttagtgagtactagagctgaaatctgaaaacagaaactgtcattccttagaaatgatcccttcctgctagaaaatgagttaataaaaaagccatcttttctatttagaatcggggtaaaggtacaatcacacatcaagagtcattcagcttcagatgtgcatgcaatttcattttaaaggcagcaaagaaaacaactggcatgtgctgcttcaggcaacatgtgctgtctagatagttctacaggcattatgcaagtcactcataggagcaattaaatggttcaaaatgcatcctctctatcttctgaaagaaagctcttttaggaaattgatgttggacccctttctgaattacaagtgagtggattatgcatctctccataagagagagcatcagaccaagggcatgcctctccaggcaaatgatttatttatatatgtgtaagacccttttagttagtgaccctcctgattctctgactttctggtggaaattaaatgagctgttttctgaggctgtggatggcggttgatggataaagcacaggagtagaagggcactggacaaaaacgtttaaacacaaatggaaaaatattccatactcacggattagaagaatatcattaaaatggtcatattgcccacaacaatctacagactcaatgctatttctatcaaattaccaaagccattttttacagaattaaaaaaaaactattttaaaatctatttggaatcaaaaaagggcccaaatagccaaagcaatactaagcaaaaagagtaaatttggatgaatcacattacctgacctcacactatactacaagcccacagtaacctaaacagcatggtactgctacaaacacagacacataatccagtagaacagaatagaggacccagaaataaagccacacacctacaagcatctgatcttcaacaaagttgacaaaaataagcaatggggaaaggactccttgtacaataagtggtgctgagatagctggctaaccatatgcagaagaaccaaactggacccctacattttacatatataaaaataaactcgagatgtattaaagacttaactgtaagtcctaaaattattaaaatcatagaagaaaacctaggaaataccattctgaacatcagccttgggaaataatttatgactaagtcctcaaaagcacttgctacaagaaaaaaaaattggtaatgggacctaattaaactaaagagcttctgcatagcaaagaaaactatcaacaaacaacctacagaataagataaggtatttgtgaactactcatttgacaaaggtctaacgtccagaatctataaggaacttaagcaattgagcaagcaaaaaacaaataacccccttgaaaagtgggcaaaggacatgaacagacacttctcaaaagaaaacatacaagtggccaacaaacagcagaggctgtgctttatttactaccaaatctcacatgtttgccttgtttccaacacagagtagaagctcaataaatttttattgaacgaacaaatgaatgaatgaaatatgtggaacttttcaacgacagacagtggccatatatctctcttatctctgcacacagcacttactaaatgtatattaatgataccatagaaacttcgaaataataaggtaaaagatagttgcaactgcactaaatctacataggccctgaaatctattggtagatgctgaaagtaagcacttgtaatatatcacctgagaaactcatttccccaatcctgtcaaactcattgttttctgggccaaaccaccagtctttgaaaggtgatgtgaagatctaaaaacacagtaaaaatgtaacagaagccacacatgtaactttaaatttttatagctcccttaataaaataaaaacaggtgaaattttcataatatgtttaactcaatatagccacaacattatcatttaaaaacataatcagtacacatgctcgctcacttgggcagcacatatactaaaattggaaagattacaaagaagattaacatagcccctaggcaaggatgacataaattcgtgaagcggttcatataaaaatttcttttacctattcatgcgatattttacttttttaatatataatctcttctaaatctgtgtgtttcacatgtacggtgcatcttggtatgggtttataaatttccacacctctaattcaatcctgggaagaagttactctatgagagaacctggattatagtggttctcaaacttacaattccttaaaaactgtcaagccatattctgaaaatataacacaaatttgttgctgcaagaccatgtttcaaatgaagctagggtatgctttatgctccgccatccttacgaattacctccatgaaacttaattgttaagcacagggagtacccactcttttcctctttcagctgtttttattacgttaaagatcaaagcaattagtcaatgaaatgaatcactaaacaaactataacattttaaaagttaactccattttgacacaaacttcacaggacaggttttgcgggacttccgtcttctttttggtccctctcttaacagagctagtcaattcttttgaaattgttctgtcctttttacatgtatatagttttgtaaaacaaattaaatgtcaacttcttagtattctgagagactgctgttcttaaaataaatgaagataaaatatgtaggtaaatattcactaacaaggtaagttcaagattaatcatggcaatacagattataatagccctgtactggaaacaaccaaaatgcccatcagcagtagaatgggtgaaatattgtgtgatagtcaatggaattctacacataatgaacatcatctactgctacataaaaaaaaaaactcacaaattagtgagtgaagaggccagtcccctagacatcacacaatgatttcatttatataaagttcaaaactaggaaaaattaatctatggtccgagaaatcaggataatggtgaccaggggtgggggagaagtgactggcagggggcaggatgggtctcctgggggacagataacattctgttccttgatctgggtgcagattacatgggtgtgtgcatgtaggatttatagaattctctgacattcattatgcttcaataccacttccataaaaataatcagacacatgagaaaggcagaagcttgctatcatacactcctgccccatgtgtttctgttaaaaattggtcatattgtgctgcttcctgcttctacctttttgagtttctaactaaatcaaggcaaaacaactgatagggcttttaagtaaaaggcatgtttttctctgtgtgtgtgtctttccttctctctcactctcccttctctttcccatgccttcctgcactccctaggtccaggtctttctcttcttcaagcaaatttacttaaaagaaggaaagatgagtaataactatacttttctgattggattagaacagcttggggatatatctgaaatcttcaaattgttctttttatgatgatatgaagaacttgaatggttaaaatatttattgttgatttctcatttcattctccaatttgtgctgtaagagagatcaaattcctgtagagtatggctgtgggggatgcatatattttagtaaagctttaaattaacagtttcatgatactctgacctgctcttgctatgaatacttagcatatttataagaaatattgttatggccaaaaggaagacagaatgtgttatgcataccaaagcctatatgtaatgggaaaaaatcctttcccattttaactgtttctgaactggtgtctctttaggaaaaggtttagctaactgaaggctttggaggcagtccccaaggaattgactacttgtgggcttagaggttgtctctcactcaccacccccactgatcctcaaataaatttgtttacaaaggtgggtatgttattattctcccccacccaggaaagtaacttgtgttaaaacaacttcatttgcaaatatcatagagaaattacaggagatgacttaacaacaacaaaaaaatcaatgtgcagcttaggacagccatttagagaaaacacattactccatggtgagaaaaaggaagaaaatttccccttgatggtaactttaaatatctatgtatatatttaaagcagccatggctaaatgaagccttcccagcactactagataaacatgacctcactacctttgcaggaacctaccttagtgcagaactgtaagaagttgtgtattcagaaagcctcacatttttcacaggagagctttaaaaatgcaatttctcttagagcaaaccaaacagagctgacatgtagtcatcactcttttcacatttcagtatcttgtgctaatccccctagttttcaaatctctttagtccacagtgacaaagatctactagtgatccagaagctacgctgaagcccaggttttcctcctcctcctcatcaaaatgttctaaccagagttgtgaatgaagtgaaggatctagttaaaattttttttggcctttctccacctcaacctaggaggaatcagataaaatagtccaaggccaggaagtaagagcaaaggcatatgaagtccctagagcagaggttacctggagtctctaaggatttgaacaccttacatcactaggatttaaaatatctcctctctattacatgaagaatcaaaagttgactgaagagcctttgtaaacatcacgataacagaatatttgatagacactgcaccatttgtttgagtttactctctggctaacttcagaacctcatatcttgaaaggtcagatacacagtattgagaaaggtatatttttgctgaatgatggtgagcatcgcaaatcaatttcagcacactttcctgaggaagagggaagggtctctgcatgatttttcaggttgtcacaccattcaacactgtcatatgagatacaatctacatgccatctttgtattgccttaattaaggcagcagggctccctggaaaaggaaaaaatctactgcacagtttggatgtttaagtttgtagaaactttttgattctttaattctctgattttttattcctttaatcccttagaaccatgagctatgagtcaaaacaacttccaaatctggagtttcctttaaagagaaaacgtccatggtttactcagtaattggataaaattatttgtttaatctcttctgtctttaagcaggtagcttattcggtgtactgtgtaaatcagtatgaaaattcaagaaattacctagtagaaagaagccaacattttgggtcagggaggttgtctgctagataaattggtacaatgtgaacattaacacaaggttcaagtagtttccaaatcaattttatttagaaaagaatgcagattgcatgtggccttccaagttcaaatgtctatattaccacatttccctttgagggaagaaaaacaggatgtggtttaggatgctgctacaaatcaactcaagggccctttaataattatagtaatacctgtgtggagcccacatttggtttaagtgactttctccaattctaggaattttctagctttaggttgatgttaaaattcagcgccaagtccagagtgagacagaaaccacctactgagaattgtttttttaatgcttccttaacaatttataataatcaccaagcaagtctttggatggggaaatttcaagttatggctgccagatacagttgaagtcttagcaaactgacatcagacccattaatccattagtccttaaacttatctgtatgtcagagtccttcagggacccacactacatctactgtatcaaaatctcaggggaggcaaaatcagggacagcgttcctacaactcaatagcaaaaagtccaatcaccgaatttgtaaaatagacaaaagacttgaccagacacctcagaaaggcaggtgcacgagtggctaataagcacatgaaaaagtgctccacatcaataggtatcaggaaaatgcaaatgaaactaccataagataccactccacacctgtttgaacagctaaaattaaaaagacagaccagtgttggaaaggatgtgaagcaaccgtaactctcatgcattgctgggagatgtgtaaatagcacaaccactttactttgcataacggtttggcagatgagataaacatatacctacaagatggcaacttctctgctagctatttacctgagacatggaaacatatgtgcacagaaaaacgtatatgagaatgagcatagcaattttattcctaatagctaaaaactggagacagccaaaatgtccatcaaaaggagaatagatacgtaaattgtgttatagccaaacaatgtaaaagtacccagcagttaaaacggacaatctactgatacacacaacatagttgaacttcagtagtattattctgagtgggaaaaaaacccaaacacaaaagatcatacattgtatgtttccacttttatgataataggcaaaactaatgtttagtaagagataagaacagttactggctccaggggatggtggtggaggtgggtgggcagggattgactgtagggggcatgagggaactttctagagtgatgaaaatggtcaatattttaaaagaagtgtgggttatgtgtgtatttgtcaaaactcagtgaactgtacacttaagatctgtttgtttgaatggatgtaaattattcttcaataaagtaaaattaaatgaaaaaatgtccccaagcatagttacatatttacaatgtgaatctatgtttgtaaaccactacatcaaggaatattaaaaaaacactgcaaaatgatttttattttttgctacaatcccaaggttttagtgatgatgctcacaacatgttggaagaccaaattttggggtaaggtttaaagcaatgacaatctgtgtgcgtgtgtgtgtgtgtgtgtgtgtgtgtgtgtgtgtgtgtattacagtaaagggtggattcagcaggtctatgatgtccaaattctacacattccaaagaaaggcatggcccccccttcatccgcttatgagagataacttctaaactcttggaatatcctgcctgataacagtgtctttgtatacctggggcattgggccatggcagatggtttatgctaatgatgtgattaacgatggggttcttgggttggagactatgtaactaaggtcagtcatatgggcactccatccctacgtaaccaattcctaattttaaaaatcctggacatcaagtcttgagtgagcttccctggttggcagcattctgtacacgttgtcatacattgttcctgggaacaataagtactgtcctgtgatctcacttggagaggaaaactggaagcttgtgcctggtctcccatgaactctgccctgtgcactttttcctttgctgattttaatctgtatctcttctgaaataaactgtaaccatgagtataacagcttttctgatatctttgagtctttctagtgcatcattgaactgaggatagttggggacctcacacatatgcatgtgtgcacacacacacacacatgcacacacgatacaaataaattgaaattaaagaagccataaaaagatgcaatgcaaatgggagcagtgagttttcataaaagcccaatgatcctgaacaagccataatttcaaccccaggggtataatcctgtgttgggttaggggaatggtctagaatttggtacactgggctcaatctgaaaatgtacaggtgtataccatacaaggtgccgagatgatcacagcaggatagctactgtgaattttcagtaagggagatagcacttttctgaaatattccacaaatagagaaacagacattcacaacaccctccttgatctggaattgcctacccctccagattcatggtacatgactctccctctcattttcaatattatatccaatactctggggttttctccctcagtcctatattttatccttcagagcctactgtatgaagtggaattattatttcttaggctggttatgtgtttttaacctctcttactgaaatatgagctcggtaaggacaaggaagaagttgcaggtccttattttgtctctagcacctagtttaggcctggcattaataacaatactatctgaagggtgaaagcctgaacagttgagttccttgaatgcagctggcacttttcagcttcaaggcatttgcatataccattccctttgtttggaccaatcttccctttctcctctttactagacaattcctacttactctttcttcctcttttttttggttttttttttttttctgtcttttcgagtcagagtcttgctctgtcaccaggctggagtgcagtggtgcgatcttggctcactgtgacctctgcctcccaggttcaagccattctcctgcctcagcctcctgagtagctgggactacaggcacgtgccaccatgcccagctaatttttgtatttttagtacagatggggtttcaccatgttggccaggctaatctcaatctcttgaccttctgatctacccaccttggccgcccaaagtgctgggattacaggcgtaagccactatgcctggccttcttcctcatcttaaacatccctcttggaaaaccaccctcagattaggtagattagacactcttttcatactagtctgtatttgtttgctattgttacataacaaatagcttcaaatttaggggcttaaaacaccacttattatactcatagttctgtaggtcaaaagtctgggcaggctcacctgggttctctgctttagagtctctgtgttggttttctaggctgccttaacaaaatatcacaaactgggtggcttaaaacaacagaaatatattattttgcaattctggagtctagaaatccagactcaaggtcttggcaggtacaagcttcctccaaaggctctagggaagaatgttctttgcctctttcagcttttggtagctccaagaatttcttggcttgcagtagcacatctccagtctctgcctccatcttctcatggctgtcttccctctatgtctgtgtctttacatggcattcttcctgtgtttctgtgtctgtgtcaaaatttacctcatctgataaagacaccagtcagagtcatgctggattaaggtccaccctaatgatctcatcttaacttgattaactctacaaagaccctgtctccaaatgatgacacagtcataggtatcaggggttagggtttcaacataaacactgggtgacacagttcaatttttgctggacacaattcaacccataacagtctcccaaggctgaactcaaggtatcataagacctggactcttatgtggaagctgtagtgaagaattcattcccaaactcagtttgttagcagagtttagttctctgtggttctaggaatgaggtctctgcctccttgctggctgtcagctggcggctgctctaagcttctaaaggccatcaacatgcttcatctcatgaccatccatcctcaagccagtgttggtgcatcaaatccttcccattcttggagtctctctttctctcagctaaaggctggagaaaatgctcttctttgaaagggatcctataattagattaggacaactgagataatttcccttttgccatagaacttagcattatcaagggaatgctatcatattaacaggttctactcacacacaaagcagaggggattatttaagggcaagtgtcactgcgggcattcttataattctgcctaccacatcacccttgatctttttcaccttccctcaaatgcctaattacttattaaacattttctttccatgttagattatacactccatgagggtagagaataaatgcatgttattcacagctggtgtcttgagcaccaggcatgaggcagagtaggcacctgaataaatgaatcaatggatggatggatgaatagatgggaaaacggatggatttctcctaaatattctaacagacctattagcttgctcatttgatatagaaacattaagagacaaggtcagccaggcatagtggctcacgcctgtaatcccaacactttgggaggccgagacgggtggatcacttgaggtcaggagttcgagaccagcctggcctacacggtgaaaccccatctctactgaaaatacaaaaattagctgggcgtggtagcgcatgcctgtaatccctgctactgaagaggctgaagtaggagaacggcttgaacctgggaggtggaggttgcagtgagccaagatcgcaccactgcattccagcctgtgcgacagagtgagactccatctcaaaaaaataaaaataaaaattaaaattaaattaaaaaaataaaagagacacgtcttggctgatcggacatttcaggcagggaaatgatggaaagaaattgagtttgcagataaggaacctagatgtcaaggttgagataatgaacccagaaccttgactgacaatagtcagaaaattgcaaatgcttaagttctgccaccacatgagaaatgacctgccatttattctgccactttgtcttggtttctccaagaatatctattatcttttcaaaaattaatagatgcagacaattgtgtgacagctaatgagaaaacagaatgtgtgtgttgtggcagcactaactcaggtggtaagacttaaaccaacaggaatacttgtgctgctaagattaaaaacctatactaggccctcagctaaattgctaaatggataaacagcctccttataagtacaaaatcccaaacctgctggaaaaatatatttttaggcatacagtgctgcaatttctgatgaaacaatcagacttgtatattccaaagttaagcacacttccaaagtttttcctcattgagggcaatacaaatggttactttaattatattttccctttgggtgattcaatgcagtacgatttttaaatgagtttttaaaatattctttttaaaaaaatataagaaaagtggttggggccagagagcctgtagctaacagcagacttcaaagagggggaaagatcaatgcgtatctccaggattaaaatacacagctgtagtttgcaaattcaaatacattttaaggccacctcctttttctacctcccaaaggcctaatcctttgattgacagttacagtcctatcagaaaagcagactacatttattccggtgcactgaatgaggtaagccttaatctctttaatcgtctcatccatgatgtctttgaataaaggaaagcaattactatttcaattcctgctggttgcctttcctgggaataaactgactggggatcagaagtcctgtcagttgcatcttgctggaccttagggggctgcaggtttacaagttgcatgacagcctaagttaacacggcccatgtttttctgccacggctcctgctctgatcctccatctgacttctcctctttgcaggcattacataatgtgcaaggggaaaaacagcctgaaataatctcacatcaagaggatttggacaaaaaaacaaattcaaattgataatccaaggctgagattgccactgtcattcaactactcttctgaaatacttctcagcttgtgttttggtacctgttgctataacttcaaaaaaaaaaaaaaaagaaaaaagaaagaaagaaagaaaaagaatgtcttcatagacacatttcaaagcacagcccagatatttgatagaaaattagagttagtgatgtttgtttgatgtaagaatattcaacagttatcatcagctaaaaaatggagtcaattaaactttgtggcagcaacagatttaatagcaccttgaatctggaagtcatgttttaggctatgggaacaaatgtaagctttatcatcagttgtgagagtattccctccaatgttagaagtcagagaatgtaaggagactgcaggggagcgaactaataaaaagaaatcaagggttgcatgcagtgtcaagaaatttagggcaccagaaattattaaaataatccttcaggtttatacctggggatccacccttacaaaaacaaaacaaacaaacaaaaatccacagtggtaaagaaaatattttgagtaattttctttatattgctcacagcacaagtgaagcatatcaccactttttaaaaaaaaggtaattctataaagtctgcagtttattcttccattacgaactgctgtgtaatttggtgtatttaaaaagaatagcccagggactgaaatattttaatttgcctctctaatgagaggttctttgcagttcttctaagaacgcttgttttcccaagcttccttctcccacattctctcccacatacacatgctacaaaactgtgtattacatttctgcttggttaaaatattacgtgtcagagatgaagtcagctttacataccaacacacacatacacaggcacgtatatccaggacaaagcccctaaccctaaatttgctttattttgtaaaagaaaatcactgtcatactgggaaataagaaaattggctatggacacttgtcatatatgcttgataatttcacagccttttgttctacattgcttgtttagacatggctttctgtcaaccaggaagttccgtcagtttctagaaagtcagagaactcagtttattttatgggtgggaggggcaccttttccttattagcttggaggggaactagcttcccttgggtgaatacccaaagtcagatatgttattaggcacttaatgtccttattttaggggttcccaaagtgtaatcataaacgggatcccaaaggctctcaaagtgtggtatgcaaaccagcagctacaatgcagcacctgggagcttgtcagaaaggcaaatgatcaggccttacatcagacctactaactctgaaactccgggcgtggaggtacagcaagccccccaggtaattccaatgcatgctcaagtttgaaaaccaccgtcttctatcaggtaaacctcagaataccttatggagtaggcactgttatctccatctccaatcccttgttggtgaggaaagtgaggctcaaaaggtaaggccatttgtcacatagatggtaaataatggggctgagatttaaactccaattgttccggcttctagccttaagcccttttccatgcaacctttcatatcatcactgctggccatagaaaataactttaaactttgaaaacagctcttcatagccttgtccgaaagcaaagcagcttcctatgcatggaggtacaatagtccttcctctgactacacctccaagtcaagctttctctcctaccctcagccatcattcattctgagacacggaatcacacacttgagctgggagattttcgcagcacttaaggcatcaggggagaagcgagggtgacaataagatcttcaaattccttgacctcaaagaatgtagactttgccagtctttctatgcacaggccatggacttataaataactgaaaaatgggctgctgtgcctgatcctaaatcctaatgtgaccttgggacatagcttttgccttatcccaagaattctgaggcaggtggtagaagatgcagtggaggcagatgacagtcagtttcttgtggaactattgagaatttctgagacataaggacttttgctttggtcatctattcagttgatcagacttatcaaaaagagaaaggagatcctcctagaagttaggagaggggtttgtttcagtagagatcaggagattatgttttcctgaaaattggtgtcatgctacacataaaactggcacactctgaatcaggttgatggactgtatcaatgtccatttcctggttgtgatattgtatgatagctatgcaacatgttattgttggggaaaaatggggaaaggggatataggatctctgtcttatgtcttacaactgtatgtaaatgtacatttatttcaaaataaaaggttttttagaagttggtgtgatggtaagaagggcagaaagtggtctgggaaaagtaacttgtaaccttgctatttcatatctttaaatatcatccttgatgggtcttcaagtctccatagctcctgagcaactgaaaggaaactcatgacacagggggctttcacatcattcttaacctttcatggaagtcactggaacataacgctcttacagtttaagtgacactctgagggagggtctccttgctctggtaattagtgggcaggtctagcacccatccttaggtttggttgctaggtaacatggtcactctgctatttaggtgcagcatctctaacctattccttccttgaaaggggtggacaggttgtggggaaaagatctttgttggaagaaaatctgctggttgctgcctttttagctttttttccccttctgagctgccagacggaatatttaaaaatacacctaagctgctgctgggagccaagaatttcacatcaactgttaactgcctgttaatggttttgatggaaggcttgatatgaaacaccacatcccagtagataatttgattgcagacaagatcagacaatgtactgcagagggtgtgggggtgctatttcttgattccccccacccaggtgtgtaaagaaatctatcccatagctggaaatacaatataatccctaactagatctttccaagaagtctgaaaatgggatgtttccattggtagtgaagtgtgaaaaacaagtcaggatggccacttttcaagcaaaagttgtaaagatggttggatactgggggacacctaataccttatgggggatgaacaagatgaaagtgtattttcattgagaacactcactatgccaaagactatcatttaacccttataacccccatgaggcacatactttaatacccatttcatagataactgaggatttgaaaagttaattaatttgcccagggtcccaaagccagtaaggaaggggtgaagtcaggtttcaaatgagatgcctttggtctctaaattcatactcctagcagttatgctgtgtatgttctgcagattttccaagcctagatttctaagactctatgaataatcaggaaactgatctttcaaatagctttgatatacaatcacatacactgaggggtttccagagttgggagaaccagaagcccttaatgaatcaaaacaaccatcttgttacagatggtccagattaagccatattttttttaaaagagggagattacagatctgtacagttcacaatttgttgtaaagagctttgtctctctttgccacttagtgtaatcattgtaatacctcccatgcatacagtgttttagggcttacaaagcactttcacatatatcatttgatcttcatcatgatcctataaactcagtagaacattttacaaataaggaaaatgtggttcacagaaggcaaataaattgcctacagcactgtgtctcagaaagagaacttctgtattttggccaggacactgcttcattgtgtgggactgtcctatgccttgtggggtcggtagcaatggtgggttcccaaccattaaatgccaagagctctgcccagtcatggtcattcaacatttttaataattgtgccctctgggagttaaaccctccattccccatggagatctactgacacatggtgcaggtaagagggtttgggtgtcacgcttcttctaagtcgtggagccagggctccagatggcaattccagcactcttcccaccatggcactattttaagctatcaaatgtgcagtagcctaaccagggttggggtggtcttcacaaaactgttcccattgtttcaatcatcagagaaattcttttaaagtaattgggcaaaaacgtggaactactgacaaggaactgggcaaatggccaattagtaactgagataatagcttttgccataacggcttgaaaaagaaaaaaacatgttaccagaatctgcaccaaagggcaaacaaacacagaagagccttgtataacacaagggttatgcctaggtttatcttgcacatcagaacattttaatattctatttaattatatattcacagttgagggccaaatttgatgttatcaaaagcatacttatttaaaaaaagcatacttatttaaatatgcttttaataacatgtaaatatataccagcagatttaaaaaaattatcttcgacttattctgcttaggacttattttaaatttcaattttgcttatgaagttgcaaattgactgcttatggacccaattctaccaataaatgggatgcttactttggcctacctgtgttttctctttaataatttgattttggttttctttagtggacataagcacactccatttcataccacttccaactgtgttacattcagtgtaccttactcttaccttacatgggtagtccctgtactgaatttgatggcctgtggacatgcttagtctagggctaattatccaagaaaagaagtttcaggattaataaaaatggtggcatatcaacatcttagggacctgatgactaatggtttaaaagcatgccagcttttcaccttctgacaccttggtttcccagcataaaaaatgaggctcatggagttgggcctttgtattggtggaatctgcatttgcagattcaaccaaccatggatcaaaaatatttttaaaaataaaacataacaatcaaaaatacaaaatttaaaaatagagtgtaacaactatttatatagcattgacactgtattaggtattataagtaatctagaaataatttaaattatatgagaggctatgtgtaggatacatgcaaatactatgccattttatataagagacttgagcatttatagattttagtatctgcggagggtcctggaagctatatcctccatggataccaagagatgactataatttcatctatgtcacaggttatagtgaatattgtatgaataaaggtaaaaacatcctgataaagctcaacgcacagcatttgtctacctattcatggttcctaccatttactagacactcttccaggtgtagtatcaaagtgcagcattcaccctacccaccaatgatctaccatttactagacactctctgggttctgggccaaaaataataaacaggtcaagcttttgttgggctattattggctctctggctttatattcaatgttaatgaatactcatttctgacagccatcactttgatacagagccaaaaaatagttcctactgagaaggaactactgagaagaatgcaaaatggagacaagagaagtcagaggatatgctgcatttccacctcctacttgactgtaacattcaggacctatccctgaccaacagccaacttgttgtcaataaacaggggcatctcttctgctgagatttcttccctgtcttctgtctaccaccaccatgtgggtaagtgggtgggtagttaggtgggtggctcagtgggtgattggtttccacccccactgcccatgccatcctgtgcttagctctatgaagactcctatcacctcattttgaaattgttccattacaggagaacacaagcatcttcaggtaatatatgtcttagatggaggtctggcgcctagtggatcttcacctttgaaatctgttgaaagatccaactagtgctcatctttgaaaataattctccccctcccctagcccacagcaaagcaagtaatcaaagttgcttttccgggttttgacatttttacaaatcaggatcttcttcaacattaaagagaaaatttacccccatctgagttaaaagctttctcctagtccactttaatagcaatcagctgctgacaatctttttccctcttggatatacttatcagccaaattggtacaccaggtgagaaaaatgctgaaaatacttgtgctgtgtctttgttctccttgtttttctctagaagaataaatacaagaaaagcaagttgaggggataatggctacaggtgctagaagctaaagtaattagaaaccccacaatgccactcagtcataaacaaagtctccctacagaaaattggagctttatagctagctgtacagacctgacttaagaaatctttcaatacacggccttttcaatgatgttaaaactgtcacactgactgatggggtgtgctgggcccagacatttctaagacctgatacgttttgtggagacttgattagattattcttaccttctcatcaaattctgggctacagacactataggatatttctattatccagtcagtctttttacaagtggatatgtaacatcctcacatatcctcatgcaaattgtggactttgccaactgtcagccatggaacaattccaatctgctggggaggatttattccatcatactcacaaatgtcaaaattattccatttcctagacatagagttatagacaaatatgtacatttcaaagattataacccaggaaatttgcttgataataaatcaccaccactttaaggggaggagtgcatggacctctttaaagtcctgggaagtcttaaaacagactactcacttctaaccatagataagtattataatagctaacatctcttgtgtgctgtatgccagttgctgtgcaacactttacatatacttaatctcatgaaaactcttcgaagtaaacattatcttcattttccagatgaggaaactaatagagagaggtgaaataacttttccaaagtcatacagctaataactggcagagacactatcatatctaggcagaccaacttcagaaaccgtgcttttatcccctgcatgaggctgcttctgtaacaacagttccattgtcacagtcactgattagggaatcaggatgatgggtttgtcctctggaatgagcactaaaacctggactgctggcatggttccattaccaaattactgcgaggtcttggctaaatcactcaatctctttttaaccttcaggatctcatttgattcagtataacgaaacacaggtatttgtaaaaattaaatagagtcacagatgtagcattttagaatgtaaattccatcagtatattctctacagtatcctacatacctaaaactatagtaggaagtgctaaaaaatatttgctgaataaatgagtgatccaacaaaggaaaaatcactacataaaaagcagtaaattcagcaaaacttgcacagctgatctgaattgaccacttacacagtgctataagcctaactaaatctttgtattaaaccgtagtaccacaccacgcaatgtatttgaattcttgctcatttggaacaggtgagaaaacagggatacagactagttaagagtcttgaccaagatctcttggctaacaagtatcaaagctaatttttgaacccagcttccctctggtcaagatgctaagcagacaaagataaattatgtatctgtctctttccttaagaagcttacatttcattgttgataggtaagcatgcatggaaataacaaactgagacctattgggttaagagttatacaagaaaaacagaaccaacacaggagggtgagagtaattctgaatgggtttgtcagggctggtgtttctaaatcttggctgcattttagaatcactggggcttggtactactagttttaaaaatactccaggtgatcctattgtacagttaaggttgagagccaccaatccatgcaaatctctttgagaagtgtttatgttaagctttaagggataaagtggcattatgatctcagaggaatagagagcttaaagggcttgccccaaggccacacagaataataatgtcaaagttaaagtagaatccagaaatcttatgcctagatcttagggaacatttgtgagataaagacactaccactgcattagacagcataaaacgtgaccaggaaggtagtttcattccaccagaggaaattgtagagaatacatttgacctgtggagcagagttttcacctagcaccataaatttcagcttgatgcacacttgttaccagtaggactaagaaacggagagcagagaagaatctatttaacgctgcctctcctcacattgctcatcatcagcttctgatgtgaaaacacaaagctttgcttagtccatatctatagatcctaaatgtaagaacacaagctgctgccgctgaggcgttgcctcacgtgatggatgaagccaactattgcaactgctgaaaaatctcccaatctcgcagtcataaaactaaaaggcagagaagaagggggccatctgcttcatgctggctacagatttggctccgcttggatggaatgaagaacccctccactcctttagaaaacaacaacaaccaacaacttcttgttcatttttggaggaattgcctcctctaggtatggaatgttttaaacacagttgtatgtctgaaattaggaaagggtaagaaagccacacggtgccttctttttggccccagttctcttttaatgactggctttagagaaagtccagtccacttttctagactgggagactatatggcacatacttttctactattctttgattgattgatttgagacaagattttgctctattgcccgggctggattacagtggcatgatcatagcttactgcagcctcaacctccccaggatcctccaaccttagcctcttgaatagttgggacaacagcacacagcaccatgcctggctaacttattttttaaaaaaattgtaatagagatgaggtctgactatgttgcccaggctggtcttgaattcctggcctcaagcaatcctcctgcctcagcctcccaaagtgctaggattacaggtggaagccactttgggaggctgaggagggaggaggatgaagctgaggcacggccagcttattcttagatttttaacaaatgatagtttcaactcttatggctactggtaccttttaatactatttttatcctggaggagacattcattatcaatgttctggggtttacactggtataatatagaatgggatcttaactgatattaaagaacaagagttttcaaactgggtttctgcaaaatactgcagtgctttcaaatcctccattagggggcatgagggagacagagaagctggtgctgaacctgggctcactgctctccctccacaccccttgccccaaaacagagtgtctccatctttatctgtttatctgctggggttctgtacaagattgtttttgagaaaactactctggttactaaaaaatactaattgggaaaaatcaaattataaaccatgtgtatagtacaatctcatttttcaaaataggtacacatacatgtgcatttataacacacagaaaaaggggcactagaaacatgtgcaccaaatgatctcttcctgatgtgattataatgattcatatttttgctgttttgcacatttgtattttgtaagttctctgtcatgggtctttgtaagaaaaagaaaatcatgcgtatcagtaaaagtcatgttttcaacaaatgtggacctttgagaactcctcagtgaagtaaaggtggggtgctgttcagaccccatacaacatgaagaggtgctcttctagacatgccagttgaggataataccctacttcaggcctggaagcacctgctttggggcacctccaagcttacatttccataagtgggacaagctggtggctttcaactggccccatctaccatccctagaatgactgaccttcatttccaactagatggggaactcctcactgcttatagaaaattagaactagacccttggtcctctgagttcctgtaaatcaagtgggtactagcacttcatcagtgataaactgaggcaagaacgtagtggtaaggacatcaactttggatttagacgtttgttagacagagccttaccctaaccagctgaaccatgggtaagtcacttactctctccacaccttatccttcctcatcagaaacatcaaggtcatactattactgtagagagttcctgtgaggcttagatacaatattcctacatatgtctgctaacatatgatggacctagtccaggctcaccaagtattcagtagtataagtattattatcattatcaaattttatttgctcctcctttctgtctgctttccctggaggcatcaaaattgtatttaattctaggtccagccaagtgaagaggatgatctaatgctacagtaaaggacttacttggcttttgggaaaactaaggcaagaaactgtaatgttctcccaattacaattcttacacaaatatgcactggtaacattgagtagtatcataatctggcctgttatcagagttcaaatatggaattttacttccattttccatgggtttggaagatgggataatatttaaaggagcagattcattgtttggaatatgaagtataagaaaacagactttaatataatttaaatggaaaattttctaaatctttgcaaaatataaattcactttatgaagaaactgtcccagtaatagcttttgaattggaaaaatgtaaattagatcactttttttagtttcatgcaaataaatgaagatgtataagataaaattaccttttcccattaagtagtatctcaaaataaaaaataaagaactgatattgcaggctaccttgcagcaaattaaaacaatcagggaacaacagggagattggtgggttaaatctagaaaattcttgtaaagtgccacacttcagtcaaattatcaaaaaacctattttcatccaggtattcatataatcttcaaattcaattctctttcacgatgtgtctgcaaaatgatactcaaacacattcttgttatttttcataattgagcctgtgattgggtgtgcttagctcttttatgagaaaacatggggccttgtaaattaaacatcagttccctttatcatcatgtgtatacaccttgtaatcatgaattatgcaggccagtactggctgtcttattatgagagagagagcagctacatgaacctcaaagaggggacgtggcaaatcacagaaggggcaaaaattgagctgcgtagtattgccaggaaaaagtgtcagacattctcctgtatactgtgatgtttcttaagatatactcacaacatttcagggaaacacagcttccctattctgagcccagacttgacaatgcccagcagaattgaaagagaaaacagaaactgaaactgtttacattaaattatttttgaaaaatatttttgttactgggggagtcaaacacattagatgacttcatctaaagctaatgcagctcccttctctttttctcttcaagcttctccttcccttatttatctacaactgcatgtgtttaggcatattgcccaagtgagatgtattgatcaaatgactgaatcactagttttgttgagcaccctctggttaatccagtgtttcctaaccttggatgtgcatgttgaaatcacttgggaaaaatgttaacccttactgatgcctgggcttttagagcccctgagtgaatccgacatgcagctaaggttgagactcactggtctaatatgaactttgaagagaaataaggcatctctcttgttctcagggaactttttaaattatcaaactaatccagacccaaataaacaaaaacctaagctaaaatattcctggaaccatttctgccttccttctattctaagccagaaaaagaggcaaccaagacagtgtccctgtcctccaatagcacttggtctggtgaggaccaggcaataaaaataagacagggagaaaaatacgcactagatgcaaaaggaccacaaaaggaaggctccttggccagccaggatgcaagttaagggaaaagtgcccctaaggaggtaatgtgagatggaaattttcaaggttgagttgaagttaacccgtgtgtgtgtgtctctacaaaagcataaaggtgagaaagcatgtgcatctcttgagccacaggttaatcaatggggctgtagtaaaaggtgtctttggaagctaagctggagaaggtagatacaggttatttttaaagtacactgtaccatgcctgggaggtgaagcttcatcctgaaggctgtggagaagcttctgaagaattttaaaccaataagattgggctttgagaccaatcctggaactttcctttcgcccaccccccgttgtcatcagaaaagtgactggaatcttcttttgataaaagaaagaatcaggaacacattcctctctgccaggatgtctatagtaattaagttttctggaatatagctccctcagcccatctttctaccaatatagatgccttgcttgctcagcctgaatttattcaatatttttgtaggtaactcttcccaatgaagggagaggctttacaccttttcttagtaactgaaagacattaaagctcctcttgcaggtaataatagtaataatacgttaataaatatgttaatattgataacttctatcacattctatgtgccaaggaattaacatacacttaatccttacactaacttttgttaaggtgatgtttgtattcccatcttacataaggaaactgaagctcagtgaagtcaagtaacttccccaaaatcgcacagcttgtatgtgactgagctgtgatgaaagctcctatctgactgcaaagttagggctctttcatcttacactgctcagttccccaacccgcatggagaacaccctttgctcccactgacctcacaggacgggttaagttgagagaactacagcatcagcaatgtgccagggcacttaatagccctacgaaagtcagtccaaaaaagaaagatggagaaagcatagccgtggactgggcacctcttccagaagcaatggtgaatggcccctgattcatggctggggcactcagtgttcctccctcccctctttctacagctgtttcgttttgatacagtgctgccctatgtcatgtttcacaatgaattatctggtgaccctgtgccagtatatgaagatattgccaagcaatagatatcaacattagaaggtcacagcacatcctatcatagagcaaagagtatgaactgtaagtcaatacagatttaaatctctgttgcatcacttactagctgagttgacttggggtaaaagatttacccattctgattgtttcttcttctgtaaaaatgaaggaaaattgtaactataagacataatgcatgcaagtccaagtactgccacacaatgagccctcaacaaatatagaatttccttctctaatgtgattaaagatggattaattaagcattagtgaaacagccctcaaaatgcacatgctgacagagggaactggctttacatgaatgggttagcttttaggaaaacaaatgtcattctctgatacaggcaagaaatccatccatacgctcttcaagtatgccatcaggagtgaattctgagatctctacatgtgtccacactggaaaagatgtggctacttgtggggcacccccaagatcagcccaggggctgatttcattcggcgcatatattactgacctcactaatgaatgggtaatgacatgatgaggcttggagataggtcagaaatgcatgtctcctgatttgacaggtgggctacacaattgaaagtgttatggagagacaacacttgatttatagaaggtaactttagcagtcaaagtcaggaggcaggagggaatgagtataagccatatgatattctcaaggtcaaagaactctaagacagaggtaggaaaatctagcgttgaggtcatttagctggagttctcaaaggattcttacacagtttttagggaatctgtgaaatccctaaaactgtgtgaaacagtatgtgggtatgtgtggttttggggcagaaactctacttctctagattttcaaaagggttaagaacacagattccaaattcaaatcctgactttgctaatttctaactgtgtaattgttagtttgtaacctctctggaaaaaatagtaaaacgtattccatacgactgtaatgataaatgagttaatatttctaaggcacttagaaaagtacctgagatatagtcagtgtttattaataatcattataatcttgaatatagaaggaattgcttaggtcccagattactggatgctggacaaatcttgccctaaaattaatgagcaaatcatttgaggaatctgagcatcagatgtccaatatataaaatgaaatgcctcccagctcaaatacatttgaacactgctttgctccaggctctgggcagtccttctaaagataaaggtgaataagagaatgttctttccctgaaggaactcatggcctgggtcaggcagataagtgtaaaataaacacagataattataattaactggtaagtccaatgacagatttattcagaggattatggggatacacatgaagatgcttattcagttgtggggatgatgaccttcaacatttgtccagaaaagctttgctttaagttgtatttctaggggaggaaatggtcagggactattttgttgttgtttttttgagacagagtcttgctcggtcacccaggttggagtgcagtggcaccatcttagctcactgcaacctctgcctcccgggtttaagcgattatcctgcctcaggagagtagctgggactacagatgcaagccaccacgcctggctattttttgtatttttagtagaaacggggtttcaccatttggccaggctggtcttgaactccatggtcagggactttcaagcagaaagtatatgcaaaggtcaagagacgtgaaacacccctgtaagtgtgaagggccatagtggatccctgtcactggagttcagaatatgggatcaggagtggtgagaagtgagcagtagggtgaggctagaccacgaagggcctgaatgccttggtgaggagctaagactcacctgtagggtttacgtagaggaatgactctggcagagagtgtgaagaatgggttggcgaaggccaggatgggagggaaggaaactaattgagtgagatctgtgaagtcgacaaatagaggatggaaaacggcaagaaccagggccaaagcatcaactggattcatggctcagggttcattccaagaaggaaggcagatgcatcaaacagttaagagataaacatggaatgacttggtgattgattaaacatgagatgagagggagacacattcaaatagaattgctgagatctctagcttggatgaccagatgcatggtgatttcaccatctgggagggagagctgaagtgtgtgtttaggggatgggcagggaatgatgagctcagtcggggacatactgagttgaattaaactgagtaagacatattgaatgaatccagaatatgtctctaacaaagattaaatttgatcatgttcatggactgcttcataaactacaaaaaagctaattatcttcattattattgccattagcttacagtatgggcctcgcaagttcttatttaacctctctcacccttaaattttccatctacttcaatggggataataatcactttccaattctaattcataagtatgcatggatataaaatgaaattgtctatgaaacatcacattctttctgggaaagatatacaaatccgacatcatactattaaacggcattaaattcaaagagatgagacagtttacaacaatgatttacacaatgtttaataatgagaagacagttatagctctgaaatacatggtttaacacaagaaccagatcaccatgatactttcaatcatataaatgaaaacttagttttttgaactgacatatgtctatttttgaggactcttttccagaagacaaaatgttgtgtatatttttgtatgtgtatacttttttatatatgtatatataaaaaagtgtgtgtgtttgggcttaaaattgtgcaaactttcatatgtacagatgggaaataaacaatttagtcaaaagcctgagtccctggagttggttgctataataaagctgaggcagtaatactttttataaaatgttttcagactttaatataaaccattgatatcctggagcagcagaactgtgtcataggaaataatcaaaaatcataattaagcactgacaattattcaaattatttggagaaatccatttgggtcccaaatgatacagattcttgtttgcatatctaattttttgaattactgctaatctcttgtgatataccgattaggaaatcacaatagaaacagttagttggaatcctgtcttgtcgtactaataatcttggtgcctccaaaaatcagacagttcttgtattcattcatctaaaagtccatttttgttagagcaaatgggacctcatttactccattccccatttccaggcagagattcctaaatttctccctgtaacacgttttattctttaacagtcctcatcattggcaaatatgtcctctgagtctcatctaaatccattgttagacaccaaccagagctagaaatgttgagagaaaaattactgactagtaagtaagagaagaaaactctttagtctaaaacaaacaacagaagtccactaggtcagattctcactgtatattcctcacagtgatatgtgcagaggacatgtgcacattcacacagtgcatgggtattttccccttagagagggaaaaattctttactatcaggtacttattttggcacttgagtctgcaaaatacaaagtatttcatattaaagctgggcatgatggctcatgcctgtaatcccagcactttgggaggctaaggtgggtggatcatttgaggccaggagttcaagaccagtctaggcaacatggcaaaaccttgtctctacaaaaaaatacaaaaattagctgggcgtggtggcatgtgcctgtagtcccagccgctcaggagggtgaggcaggaagaggtcgaggctgcagcgagccctgatggcaccactgcacttcagcctgggtgacaaagtgagaacctgtctcaaaaatatgtatttcatatcaagagggaataagatggaaaatcctatggccacatgacatccccttgtaatactggtacctccctaagaaggcaccttggaactatgtctgccaactacaattctgtttgccaaatttgtcaatatattatttccctctggcttatggttctctctcgctaaaaaatgagggttaaaaagaagattttcttcaagtgaaagctattgttcacatactgaaaatgtttccatgacagttctatttgtggatcttagacacgaatgtagatttagccacatacatcctcaaactaaaactaaacattaaaaattattgaaaccacatctaagcagcaaataattctatttgaaataaaccaagatatttgggaagttttatacagaagacaaatctacatggacctcattcattatgggtcaagagggtagagtgctcatgtatccatttggcaagaacaagaactctaacaacagttaccagtgccaacgctttacgtatattatctcatctaattttcagaagaacccagtgaggtaggcgctatcatccctgtttttcagatgaggaaactgaggtaaagggaagttaagtaactcatccaaagtcacatagatgataaatggtagggataggattggaattcaggttgtcaagttccagaatctgtacccctaaccattatggagtgaggattttcttcagtaatctgtccaatatgcagccaatcaagataatcttgttttcaatttcacagcaagactatgtgtttaattttcttcatgattgcctcaattatccatttaatcaccatattaacaataacgataatcaaagtgtttttattgcatgtcagtgatgtgccttgcactataataggcacattgccttgatcatctcatttagctgaatcccttaaaaattccatgaaggcagaaatttgcagagagaagaattgaggcagagaggaagttttattgtctttcctaaagtcaaatacaaggtgatagagagccagaatccgggctttatgacccatgccctctgattagaatgcactgcccctatctcactctctagacatgctgaatgatgcttcaaattatgataaaagttttataatcattttcatgatatatatgattaatggtacttatgcaaacatatctgtactgcgtaaccaaggttttccctgaaggttcacagacctaaccctgaacataattgagagttcattttctttctagtctctggaaagcatggtattttgtaaagcacataacaaatgtgtttaaaataaaaatgatgattcattatcaaatttagtggcactatcaagctctggtataattttttttcatgtatgtttcactggataattaacttccaatttttttcctgacctgtgaaaacattaacaggtgattttatgaagaatgatcttccctatgacagaaatgatgcagtttaaagtcaaaatgaaataatcttccaaatactgtaggcaaatattcaaacatttcagtgaaggttaataatattaaacagaaacaagatttaatgatattttcttattctttgtttataactaaagccacaagtatttctgcattattagtgaagttactaaatattgaagattcgaggctatgaaacagaaatatctgagatttctatgttaaagacaattatcttgtgtgtttttgtaatagaaatataactgaattacaaaatacccccaaataatagtgatatatacaagatggcagttggggtgtgtgtgtgtgtgtgtgtgtgtgtctatgtgtgtacacatgaaaactaaagctggaggaaagcagcataacgttggactcaacctcatctgggtgccaagttacttccattatgttgctccattttcaaaacaaaactcctgccttatagtacaagacagccactgaagctccagccagtcagtcctgctttctagccagctagaaggaggaaggaggcagaggccacttccttaaatgacatttcctggaagtcactcagatacttctgctttatcccattgaccagaacctagtcccaatgcaatatccaactacaagagtaggactgaagttttgccagcttaaaaaaaaaaatcagtaaaaagaagaggaaaatgaatcattagaaagcaattaaaagactaccagggcttaaaaatgtaaaaagatcaatactttaaagtgagacattaccctaaggctctgtaggtatccttaccccaaaatctagtcccttggcaagtatataaaatttgaaaccttaatccaaattgcataatccagaactaaagataggcttttctctagaggagtgattattattgttatgctgtttaaaaatggtcttttgttgagcctctaccaccaatgtctaggaaaggatgggggaaaaagcagagacaaatcacagttgtaaggtaagagctcttctggtgaagtttaccggcatcaacatctcccatcagcacaaactagttcatttagtttacaacatcgagctgacaaacagcagaaatcttagacttgactaaactctaagggaaggggaaatgggaaacagtaaaaccatctggttgagaacaagaattcaggctggaataaacaaccaaaggaaaatctgaggttgacacacctactttttgacataattgcctgttcccatggcttagttcacattttttcatgatcaactcacatgtacattctgctgttctttcttcctttccttttacactttactgaggagcaaaccaccactccccaaccctcatgaatgcctgtgaaagccaaggacacacaacatccaagcttggtgaggaaaaacaaataatctaagcttgaatgcaaatttaagcgtaggtatcggggtctatagttatcatgacctgtgaactatttgaagaccaaaactagagacttaaagatctcagtgcagtaggttattcaacacactaatgcgattgggaaaatcgattcttagtataatgtgtaaactagagaaagcagtcactacttttttaatggtgagacaaagtgacaggcccattttcagagaaagttgtggtcaaactctggctaagctaattagggttcttggttccaaacaagagaaactaattctggttaattaaacaggaaaaggagcttgttgaaaaaatattggctagaccacagggtcttcaagaaggcagaaaggtttggaaagcagccaggaaccaaagctaggctgctaagagccatattataactagaaactgtcacggaaactcgtcatcacagggtggtacttttagctctacctttagctccactggacacaggatgctatcactgtgggtagaataagttctaagtggttcctgctcctttgtttcaactattccacacttttcatctcagaaggacatatctgtcaggttggccaattttaggtcagattttcaggctctgtcagagtctgagagaacaagaacttggcttcttgagcttctgtattggaagaccgagctgcatatcccaaggctcacatcatcacgattttccccagatagaagtgttaaggtgttgaacagccaaaaatggagcccttcacatagaatctaccacttaccagatgtgtgatttgaacaagttactttaactctgtgtctcagttccactacctctaaaaaggggataatacatctctcattaggtcattttgaagatgaaataagattatataaataaagttatgaggcccacagcaagtattcaatatattggcctaaagtgcagttgtgaagaaagagcctttatcataattatagaggggatttggaggatttggattaaattccaaattccatttattctctgttgccctgaaggttttggcatgtgatttgttgatatgtcccttaaatttcttttaatctatcaatttatctttctgttcccctcccacctcccactatcatctatctcttcctgtgatattgttattgttgaagaaacctggtattttattttgaacaatttccgatagccaagattttattgatttcttccccatttgacatgtggcatgcttctctccctgtatttcctgtgctttgatagttatatctagatgagtgatatggtttcactctgtgtccccacctaaatctgatgttgaattgtaatccctaatgttgaaggagggacctagtgggaggtgattggtttaggggggtagatttcccccttcctgttctcatgatagtgagttctcacaagatctggccgtttgaaagtgtatatcatttccccctttgctctctctctctctctctctctctctctcctgccaccatgtgaagacatttttgcttcccattctcccttctaccatgattgtaagtttcctgcagcctccccagccttgcctcctgtacaacccgtggaactgtgagtcacttcagcctcttttaaaaataaattacccagtctcaggtagttatttatagcagtgtgagaacggactaatacagtaagtgatcagattcaggttcaattttctgggaagactactccataagcaacgtgttgtgcttccatgtgtaatgtataaatgtataatgtttagttatttctctttttatgatgtcactgattataatcgttgcctagacctattcgttctttagggcttgcaaatggtaatattccaattctatcattccttcttcatgtgttacttgaagtgctcttacaagaagaaacttctccttatctggttggtctgaagtacagtcatgaggaaatacatgataaacgcttgattctttcccgtgattaatcaatttgcaaaatatgttggttttctgtcattctccaaaagtgaccaaagattgggtctttttttgtttgttttttggtatttttttgttttgctttttgttttttgagacggagtcttgctgtgtcacctaggagtgcagtggcacgatcttggttcattacaacttccacctccagagttcgagcaattcttttgattcagcctccagagtagctggtattacaggtgactgccaccacgcctctactaaaaatttttgtatttttagtagagacagggtttcgccatgttggtcaggctattctcaaactcctgacctcaagtgatccacctgcctcggcctcccaaagtgctgggattacaggcatgagccactcgcccggctggaggtgggtcttttagttagtattaaaaacatttgaatttgaatatatttgatgtgttttaaaccactttagtcattatcctgactaatgctcaaactgtctgtgccttctttgggcagtgagagccttttctagtagcctcctaagtccttttgacaggacgttagtagttttgatgactttgttaattttttgacttttttcttatcaacctgagagaataaactttgctttttgacatgccaaaatgttcttacccgccacctccagttaccaaatcccagcagcattttctttttttttttttttttaacttttttttttttatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcatagtggttttgatttgcatttctctgatggccagtgatgatgagcattttttcatgtgttttttggctgcataaatgtcttctttagagaagtgtctgttcatgtccttcgcccactttttgatggggttgttcgtttttttcttgtaaatttgtttgagttcattgtagattctggatattagccctttgtcagatgagtaagttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttccaagcaccatttattaaatagggaatcctttccccattgcttgtttttctcaggtttgtcaaagatcagatagttgtaggtatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctgtttgtctgttgttggtgtataagaatgcttgtgatttctgtacattgattttgtatcctgagactttgctgaagttgcttatcagcttaaggagattttgggctgagacaatggggttttctagataaacaatcatgtcgtctgcaaacagagacaatttgacttcctcttttcctaattgaatgccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttatcaaaggctttttctgcatctattgagataatcatgtggtttttgtctttggctgtgtttatatgctggattacatttattgatttgcgtatattgaaccagccttgcatcccagggatgaaggccacttgatcatggtggataagctttttgatgtgctgctggattcggtttgccagtattttattgaggatttttgcatcaatgttcatcaaggatattggtctacaattctcttttttggctgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgatggtagtttgtatttctgtgggatcggtggtggtatcccctttatcattttttatcgtgtctatttgattcttctctctttttttattagtcttgctagcggtctatcaattttgttgatcctttcaaaaaaccagctcctggattcattcattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttctatgtagttgagcggctttgagtgagattcttaatcctgagttctagtttgattgcactgtggtctgagagatagtttgttataatttctgttcttttacatttgctgaggagagtttaacttccaactatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttacagtctcccattattaatgtgtgggagtctaagtctctttggaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacattgatgggtcttgactctttatccaacttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtcgttacattttggcatgattttgcagcggctggtactggttgttcctttccatgtttagcgcttccttcaggagctcttttagggcaggccttgtggtgacaaaatctctcagcctttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgttcttctcgaggagtatctttgtggcattctctgtatttcctgaatctgaacgttggcctgccttgctagattggggaagttctcctggataacatcctgcagagtgttttccaacttggttccattctccgcatcactttcaggtacacaaatcagacgtagatttggtcttttcacatagttccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgatttgaatgtcctcccgtagctcagagtaatttgatcgtctgaagccttcttctctcagctcgtcaaaatcattctccatccagctttgttccgttgctggtgaggaactgcgttcctcagatggaaatgcagaaatcacccgtcttctgtgtcgctcacactgggagctgtagaccggagctgttcctattcggccatcttggctcctcccccatcagcattttctttgagattacttttgcatccgtctcttctttcattttcctttgcccggtgtcaagttcaattcataatggccccatcatgagactgttaacagttcctcctttacttggtccccttttaaaatcttttctccttacccacaccagagagacttatcaaaaaaagaaaaaaaaaaaagctggcccaggtggtccccagtttactctgaatttcctgacacctgtctctaccttcatgactttgttgaagatgatccataatttccacttctgaaaattccaggaacattatcaggcctcagttcaaaagccacctccctccaggagttttacaggccatgaaccatccttgtttgcttttttcttctgacatttttccctcaacacttcatatctgagttatctatttacatgtctatgtagcattgaatgaataactagaaacataaaataactcagatcagagatatgttactgttatttccaatattcaattactcctttattttaaaaaatgtttaaaagatacttgactaataacattttctggcactgtttcccaattctccagtgagatgtaaatgagctacagcccctagaaagcccatctaagcagtggctcaaatgctttatcttgcacttgacatattaatattgcacaaagaaaatgagctgaattcctaagtgaacagtaggacaaacaggaaatgtcactgtgatcaataccacttttatcatgtctttctggaagcagaagaaaagaaaaagaaagaacttccagaaaataaaatataattctaccaggtcaagtcagaatgagttctatcatatttaatcacattgttttcagtctttatggcctatggtcaagaatatagtgatattcttgtgagaaaccatctagggccaggtgtggtggctcacacctgtaatcccagcactttgggaggctgaggtggatgggtcacctgaggtcaagagttcaagacaagcctggccaacatggtgaaacccctctctactaaaaatacaaagaattaggtgggcatggtggcaggtgcctgtaatcccagctactcgggaggctgaggcaggggaatcacttgaacctttgaggcggaggttgcagtgagcccgcatcgtgtcattgcactccagcctgagcaaccagagcaaaactccactaaaaaaaaaaaaaaaagaaaagaaaagaaaagaaagcatctaaaacatacatgacagccaggcccagtggctcacgcctataatcccagccctttgggagcctgaggcaggcagatcacttgaacccaggagtttgagaccagcctgggcaacatggcaaaaccctgtctctacaaaaagtacttagccaggtgtggtggtgcgtgcctgtattcccagttacttggggggctgaggtgggaggatcgcttcagcctgggaggttgaggctccagtgacctgtgatctttccacagcactccagcctgggcgacagacagtaagcctgtcacattaaaataaataaataaataaataatacatgacaaagtaagtaaaaagaaagattgaattctctcatgttggtgtcatttcatgctgaacctactgccgctccattccctacatctgagcattttcaaggccattaaaaaatatatatttggaatgaactaaaatgcagaaatgtcacctcagaaggtttttaaagttatttgcttgccatcaactccaactcacaagcttaacacttgctaagttatataaattaagagagaatttgtgtggttggaattgatagactaaaattatgaacctccccgttaaaaaagtaactttctctctatgcattcctttcgtagttttgctttgtgaaggtcatggcaagcaatcaatgtatctggtggcaggaacattcatcttttttggtgcagtcaattttgctctatcgtttcaaatataaagagtgtaattttaagcttcaaatcacttctctgaagaaagacactcctattaaagacaaaacaatgttgggaaatgactataggattgggtattctctgctgtcaaggaatatctccatattacaatgaggaaagtactaatgcctatcttaagggctttatagttgctttcctatgtgatgtgggtgagaactatcactgggtggagaaaaatctaggttgcaaaagattgcatgttatcttctggttggctgggattgtgtagtcgtaagtaacaagaagttctatttttctgatcttcttcccaatgtaaaacatctacattgagcctgaaaaatatttcctgtttgtacttgataaattctttatttaaaaaggcaaagagtaaaattaaaatagagatggagtgctagttttctaaacttttttaaaaagttgactgtcctttatatttcatatatttttatttcaaagactcaaacatggaaatatgtattcaatacaaaatattttagtctgagatgtgttatttatttttggaaacagagtctcactgtcacccaggctggagtacagtggcatgatcttggctcactacaacctccacctcctgggttcaagcaattcccatgcctcagcctccccagtagctgggactacaggcacgtgccatcatgcccggctaattttttttttttttttttgtcttttagtagagatggggtttcaccatttcaccatgttgcccaggctgatctggaactcctgacctcaggcaatctgcccacttcggcctcccaaagtgctgggattacaggcatgaggcactgtgcttggcctaaaatggattatttagaatgagctctattcaaaacaaaatatatatctcagcatggaagttggattcctctctcttaagacatccttgattttcactaaatgtaagttctgattattttttaaaacaccccataataaaattatcctgattttaaattttttaaagtttacgtactatgttatcatgccatgattagtagtaatagacaagtaaatattagccaaaggaattagaagaaaaggtaaaaacatattagaaaccaagcaaagttattaatttcatttaccataaatgattatcaggaagcaccaagagtagcttaaaactatttagaatgccaagcaataaatattttttaaaattatggttaacttaaaaatatttagctgaagtagcaagtcacaaaacgtaagttgtcaaatgtctagttttgcttataatttataattatttgccgattttgggggtataggatttcaactttgcctttatgcatgggttcgctgattgaagtttcatatcctccttaacacacagcatatctggctatgatttccagtttttgtttcttaaaagaagagaaaaaaattaaggtgcttaaggggcaatatgataaaaaactcctttagatttttatactttttccctaaaaattttattgtagttttgcccaactgcaatttaatatatttttagacagaattgaatcttcccaaagtaatcaacttatttaatataaacaaagactattctttgttttcacaataatatgtcattaagttatataatatttaattatggaatttcagtaacaacagaaacagaaactagctggaacacacttggaaagtataattattcttggtgagcatatacctcagctgatagggacagaagtgctcaggtgtattagagagtagtccattagccctgagctcccatgttttgcagagggaatagagagctttggttaatgcaagaagtcagtgaaggaagatcaactagtaaatgttacaatttacttaggaataaatttaacaataaatgtataggccatgtatgttgaaaactacaaaaataaattgaggcacatcaaaaccttttgaatcaatgcagagatattcctagttcctggatggggtttcaatgtcataaagatatcagctttctttatgttaatctacagagaccatggaatttaggtgaaaatccaagcaatcttttattttaaaactgataaaatcattaaaaattatttttccaaagaataaaaaaatgcaagaagagtcatggatattctgaaaagtataataaaaggaactttatcaatgtagccaaactgtcataaacctacaatgattgaatcaccatagttatggtacaggaagagaaaattagatcaatggctttctaccaggagctcaaaaataaattcaaatattaataatattaatacaataaaaatttagtgcatttgacatttgcattatgcatttaacacaactagagagcaaatagatttaatctatgatattgaactggctagtcaactgaaaggtcattcatacgtcattcattacaccaatacaaatttcaaatgagtaaaaaatataaaggtaaaaaaaaaaaacactataagtagtagaagaagataggtatgagcagttttataatctttggatagagaaggtctttcattgcatgaaacccaggaattataaagaggaaaagtagatagattttactgcattcaaaaattctgttcagctagacataaatatgtcgaacaacataacaaacataaaaacggtccatcacaaatgacaaaacttaaatttcacaaatatgacaatgttaataccactaaaatagaaatagctcttaaaaacaaataagcataacaatggatggaaggtaacagaatttgtgaaacaaagaatataaagagacaataaatatgtaaaaaagaaatgcaaatacagaattttaaaaataacgcatcgagttggcaaagcagaaaataatgtctagttttaacatgggaaatgagactcactcatgctccactagtgggagtgtaaatttctacagatgctttggaaattggtaacagcattttaaatttatatattcttaatattaaagacacatatatttgaagaagtgtagaaaggtaagtacacaaagatgcttactgcagaatgtatagagtagtaaaaaaagaaagagaaatcaatacaaccagttaaataatgttacatccataaaatggattgctacaaagtcatttagaagaatgacatggtttttcatatttactgacatggaaacatttcctatatataatgttgtgcaaaaaagtaggttgcaaagcaatatatgtagaaatattacttttatataaaagcatatataatattaacctctatatatccatgcagatgtataaatatatattatgtgcataatggatgtctttgggtggtaaaattaggtgactttttaaaatttttattttatgtatttccatatacttttctataaaaatgtttatttttgtttatagaaactgtaaaatttaatattttaatgaattcattttgcttatctcttcagttataataaaagttactttatgctaaaacatgatttacatctacaatgaagtttttgctttttggttttaactaaattatatctagggagttaggaagaaataagaagctgcttcctacaaatatgatttccacttttgtctaaacatattcaaaataaagagttaagattaataaatcccagaattcctgttctaaagagaaatacagcaggaggtcaacaaatttttactgtaaataagaaaaactacagctcaaattgacttacacaacaagaaaatttactattttattggaagtccagatgaaaggtgggctccagatctggcttaatggtgtatgtggcccattattgtcatcaggaactcaaattatttccatagttcagcaacttcactatattcagccttggcttcagcctaaattgagtctcctcatggttctaagatggctgccagtaccaattatgatacatgcttccttccatagtccatcaggagaggagccccaaaacttctcccctaagcatggaatacaagtcctccactttggtctgattggatcaacttggatcacctgggcacctgtgagccagctgtattccagtatagtgctgtgtgttgatgggtctgaactcagctgtatctacttctaaagctgggaatggggtataatttttcatacctgaaaaaattacaagtctgtttggaattggggaatgaataacaattaggtaaccaattgtgtctactaaaaatgggatatgtagatattatatttaaaatgtacaatcaaaagcttcatttgaacttcaattggctgttcatgctgattaaacacactgcgtaaatttgtagtttatccacattactttaatgatatgtgttgcttgagttcaaggttatgaaacaagtgtaaattctcatccaacgtaaatgtctcatatcactattttccttaaaaatctgctttatgataggcaggttaatttgcaaataaaaaaattactgtattctagatacctttgttgctatcatatttatagaaaatgtttggatttttaaaaaaacttaggagtgaatttttattgttctgaaaccatagctcaatgacaaagatagtattgagtagtagattgtgctggaaacaaaagactatgccaaaggatagtaattagagaaagctttatataaaagcatttggatgagtacacaagacagaaatgcacagagttcttgctgcgattagggaaagggtaaatgttctgcatcacaaatctccctaaatttgggcatatacaatatatataatgttgaatttggtttgtcctttccagtgattcttacactataatttatttattgccaggtcataaggaagtaaacacatattattaatttggtctaatatttaacttatgctgcagcagacttgtatttctttagtgataagtaatggattgttttccacacacaagcaaatggaggcgggaacaagtgacacattacgcccctctttaagagctcagcatggccttccgactcaaatactaattgaatattgactgaaagatagctttgggctctccacatagaaagaaaactgaaaagctctttggactaaatggcaaatctacaattgtctagaactgctgcttcggggggagacgtgcttctgattaattgaaacaagtgcacatcttaaccagtgtctgtttactttgaaggtctatactgctgaatcataataacagcagtacataggctgcctgtggaaagaagacagtagaaagaaatccttttcttttctccactgccaggcaaacaggaaggctgacaaattatgtggggcttttgtcaaaactcatagggagttgtttctaatctggccatggaaaaatgctggagcaaatcatgtcctttgcaaatgagatattggtttgtgttgacaatattcttcagaaaataaagcctcaaagtgccttataggaaaacacatcacttcaagacaaggtcaaggccaatcactctctatttgccaatcacccagaagtctacattatctttgatgggccctctgccttggtttagtgttatttccactggagctactcagaggtacagatcattttcaaaggctccccactgcctaccaaataaaggacaactgacagtctagtaacattcagtgtttaccgctacctgatcctaagctacctttccgatcatgtggcttttatatgctttttactgtagttttgcttggcttctgtctttgctcatgctgtccctagcatatctgttttccttcctacccaggttcaaatcctatttgttcctcagctgcaaatgcagcctcctccaggaagcaggctgtaagcctttggtaaacagtgtagtgttctgaagcctttcagatgatgtaatgacctggtgacccaggaatatctgaatcttaccgtaaaccaaaatctcctattctcttaagagagctataatgacagatgatgatgacaaatggaaaataccatcatccctcagtatctgcaggagattggttctaggaccatcccgttctggcatacactaaaatctccaaatctgcatatgctcaagtctcaccgttggccctgtggaacctgcataggaagtcagccctccctatgtgtgggtttcacatcctgctaatattatattttcaatccttggacttgcacagttcaaacccacgttggtcaagggccagctgtaaaatcactatattaaaactttcaaagactgggctggagcctttctctactcctatgcccagatccaaatcttaccacctctattaacacataaaagatagaaaagatggtaccaaagaatgtgcaagaagagacagaggatcaggaatcttatgcttcctatttatgcaaataactctaaccactacatgtggtccatacaataacttttctgtaatcttaccactaagataagactctttccacttggggaggagtgagaaagggcagggagcttgaacgttccttattctctgggtgcctatgcaaatttaggttggtttgggggatgaaatcatgttggagaaaggacaaatccaagattctattttagtgtgcttgggcacactgaaagttttctccccagattccaaaccaacaccagaagtcatgcctcctcctctctccttctatgggcttgacataaacctgggtttattgtggggtttatgctttcttggggctaaattaaactccatctgcatcctttaggtcagctggaagccagatggaatcacatgtacattttctgaaattatgctaggttcaaccatatgagctttgtccaagtgtcattatgtggttcacaatgttatgcagaagagtttttgcacctgcaggggcatatcagaatatcggtcactgaaattaaatataacttaaagggcaggcaccttgctttacatttttagaatttgtaaaaaaaaatgaacattcatagcccacacattgtgacaagtacataaagttactctaataaaatgaagacaaagatcaacaattgctgtagggaaatgcctttgaactattgattcaagatacttctacatataggcattgattttctaagatttttgtacaaatctccccacaaaattataaaactgatctgtgctggataaaacattcaagcctaattcatgaccttttctcacagtgtgaagacatttatattcttcttttctctcctttccccatagcttccacacatttcacttaatcttcttaaaatgctacaatggtcatgtcgttgtcctgctcagaattcttcagcagttctccattgcctacagtgtgaagtctcccactccttaatccccttaccttggtgaagggcatctaccatcatgaaccaacctttgttcttattttctatccaatactggaatcttatacaattatatttgtctgttcatatgtcctcaaacttgctttgcattatctcatctctaaagagagttgaaagtatccttccctcctctcaaaatgtatcacactgctatcacttgatctcagtcagcttgaggcttagttcaaataccacttcttccacccagcctggccaaaggctatttcattcattaggcaggagagacatagggactggagccttggaactctccaaggcgctaaaaaaaaaaatccaagatcctaaatatagtcttcaaaatgtaggaataaacatgaaaaatctaaatattcaattaagtgacttccaaacacatattgactccattaattgttaaatttagtcctcataaaaatattgatagcattgaaaacagtggtttttttttttttttttttagacagagtcttgctctgtcgccagtctggggtgctgtgatgctatctcggctcactgcaacctccgcctcccgggttcaagtgattcttctgcctcaacttcccgagtagctggggttacaggcacgcaccaccatgtccagctaatttttatatttttagtagagacagggtttcaccacgttggccaggatggtctcaatctcttgtgatctactcacctcggcctcccaaagacctgggattacaggtgtgagccactgtgccctgccaaggtttaagttttcagggattcctctgaatgcaccatgattcctgagaaatcatagtcatttattatatagacaaatagcttcaaaagcaagattgaaaaacatacattccagttttttcaataaccaagtagatgtgaaatgtgacatacatttaaatgttttatgaggtggggtggaccctctaaaagcgtgaatcactatgactttcacaattctgcaataaaataaagattacataaaatgaagcaattttttaaaaagtctaaaatggcccaggccattcttactgtaaattcaagtctgacagtgcaatgggaggaagccctagttgcagttaagtggcccaggttggtgctctgtagcccattccaaccagtgggacttctctggacctaacttttacttgttacaaaacaggaatttataactcgtctcacatatactcaaagggctgttttaatgaagcaatgagataatctcagtggataggctacaaattgtagagaatatatattactattctgaatagttatgaaccaacaatcatgaactcatgtatcacctatttattgaacacctattatatatacatacaatctgtcagacacctggggagactaaatgatctctgcagtcaggagaaagaaaaagaacagttatacattgaagtaaggtgtgatgaatgcctcaatgtagttaacatagcacatggttaagtgtgaaggctggagtcagactgccttggccccaacccatgtgctatatctgtgacctaagacaaatttcttatctgcttttcctcttggtttcctcttctgtaggattgggatgattagcacctatcttataaggttgttataaagattaaatgagataaggcttgtaaatatatagaacagtgactacacagggtaaagggccaatgaatgctaactatttattcctatactttataactgagtgttaccttctacctaggaaagtaatgaaaggcaagggagggcttttcaagcaggagtgcaatgacactgaggctcacaaagagcaatggacagcacagggatgttaagtggcttaatgggctgaagtgaagggtgtgtgcaggaaaactgaagtagttaagcatggatggggagcaaagatctacttacgccatggaagtaagtttcgattttatcctgtgcaggcaacagaaagctacagaagaattctcagccattgtttgaaacaatggtatcaaacaacttgcaaacacatgcattctttggtggtgaggatgaacaataaaagattttaagatgagttgcacatttgtgccttggccagctcagttatatggtagcgccactgggtggccattcacagagttagaaaataaggggaaagaatctggatgagaagaaaaattgtatcattgaatggtgtgaggacattgaaaggagatgccatggaggtcaatgctcctccaagtgtgctctgtagacctgtgtcatctgtgaactacttcttattggccctcactgagataaagtgcttataccagaaattacatcaatttagtcactatgcatactactcaatacagctgacaacttttataggaagactttcctagcagaagaaggtaatgagttgatttacattctagtccaagctctttacaaagcattcactgacctgcacctgtctgtggccacacctttagcagcactgatgcaaatggctaaatgtatgggtctggcagtctggcaagaggcctatgctggagacaaaagatttgcaaattttaagtgtagagatgttagtagctaaagtcatgattagggatgaagttgctgagacagatggtatggacagaagaagagggctgtctttgttaggactgcaataaccaagaatcaccaactgggtagcttgagcaacagatattgtcagaggctaggtgatgatcaaggtgtcatcagagtaggctccttctgaggcgtaagaatctgttccatgcctctcccctagtttctggtaatttgctgacaatctttggtgttccttgcttgtagaagcatcaccccaatctgtcttccttttcacgtggccttctccgtgtgtgcatatctctgggtccagatttccccattttataaggacatcagtcataatggattatagcccaccctaatgacctcatcttaatcttccaaataaagtcatattctgaggcagtgggggttaggaatttgacatataaatttggggggaacataataaacccataacaagagccaagaatggaaatctagaaaacaccaatatttacaattcagacactcacactatcctgacttagtctacgtcagtgtatctcaacttctcaaccagattgctaggttcctagagatcaggaaggccatctaaaatgactttacatactttttctacaggatctagtgagtttctcatacatagaagtggctcaaacaacattgtctgatgatgtataacaaacaaaacttgaatatggaagaacccccaagaaatgttttgaacacagtatgttatgacacactgccttatagacaacagttgctatacttgtcagaaaaatcgccaatgtagatgttcaggatatacttcaactcatttgcttaaacaactctatgcctaccatcctcaccaaaaagctgtttttctacatgggcaacagaaggcataattatttgcaggaattttcagtattttccctttgctttcttaagaggcatagtagattctctggaccacttggcatgtttgccaaaatcccattgtctttttaaaagcatcaccacttccttagggtttgtaacttagcatgtgctcctggaacacttaaggattaaaaaaaaaaaaaaaaaaaaaaaagttaacttctaattatcccagaacttttttactgcacagaagtaattctgagaagcacgtgatgaattaatattttcctcccatgggctgttgaaaagacatcaatatattatcaatttatttcatatctctcaattttagaatggcagacagcagatgggaacacttgagggcttgataattcaatttattttcaaacctttttcccacttgttaaaataaaaggaataacacagcaaaaataattttctttgactagtgaaatgtatcagaaaagtccatatctaagaagcagttttactttttattgatgttttctacatagcatattcttattaccatatccaatatgcagtagctctgtagttattatttatttataccttaactacacccagaaaggactttaggcagcttacaataaaataacagaaaataatgccaaaatcctgtaagagaataaaagtagagaaaatgagcacatttatttatgcctaaaatatgtagaacttacaggttctgtgatacaactttggcaacattgtggctgatggtaaattaaacagcctaattttcactaacccaaatgaaatgcactaaaaaatgcacacccaatatgaaaacttatttctttggcttctgctgattttaatgtttgatcacttaaacacacactatggtgattcaagttcaactaggattcacccattgcaagggattcataaagaaggcttttctctacaatggatctagaaatttgtcactttttggtattaacaaacaaagtcaaaggtaatagatagcatgtttctgtaacataacttattttgaagccatttggtaattggttcactctgagaagcttttataaaagtaaaaattatagagacaacgtctctgtaataaaggtgactgtattttagactatttcctctctttagaagctctctaggaaataaagcatcagtgtgaagtctcaacagtagaacacttactgaacacctactacatgtcaggtactgttttgggagatgggaatcttacagtctagtgagtgataggcatgtgtaaaaagggtaatttaaatataaactacaggaggtaaaagaaaagattgactaaggacttatggcaatacttagcccactacaaagctttgagtaaggtttcctaaaggagataacacttgagttataataattaaaggatgaacaagagtgaatcgcatgaagaaaggtgaggacgacattttgcaataagaaacagtatgagcaaagatattgtagtctgaaatactgtggaggagtttggtgaactaaaatgcaagaatactatttttactgttactgataatatttgtccatgtaccccatattaaagattttaagcaactaacatgttttttctcttacaatgcttaataatttttccccattttacagatcaggaaactaagaagtaaagacatggataatgtccccagggtcacaaagtcaacatgtcacagagctgaccaggaatttgaaccagggactgatagtccacagagttagaggtcttagtctctgtacgctattgcatattacctacttatgcgagtcttactctatctagatatataaagttttgaacatatatatatatgcttagaatttactctctacacaaacataaaagcattttatgagttcatttttaatggtaacaatcaatatggtaatagtcaatatcatagtcagtatcattagtgtaaaccaacatttttaaaagagctatttggattgaggacaaaaatattaggacttgaaaaaggcaggtgacctattcaatgataacgagcatagtgcctttcctcatagtggctatgaagaaaataaggaactctgaggatcccatcatttaccaattgagtgacccaagacccctttatctgagtcttctgataagcttgtggcaaatcttcccatgtacatgtgcttggcattagccatttaaaatatctcctatgaattctatccatgttacttttgttcaaagtgagcttttgaagccagacaaatgggtccctgttttttgttcaaagaaatacaagtgaaatgtctcaacaaaagtgaaagaacagagatgtattgtagcctggacccccatctggtttataggtaacactctaatgataactacctgccttctggtattcttgcattttagttcaccaaactcctccatactgtttcatgatgataatagcaataatgaatataaggcttgtgatggctagtacttcatatatattaacttgcccagtcctttcagataaaaacactgcacatatcaacttagcaataacaagagctgacacttgtattgcacttacacattccagatattattttaacagctttactatattatctcaattaattttcacaaaaacccaatgatcaaggtaccactacaattcccatttcattcatgagtaaactgagcctcagagaggttaattgtctaagatcacagagcgagataagggtacagcaagaaagcaaacccaggcattctaatttcacagtgtatacccttaaccactgtccttcactgtccatcaatatatcaatagcaagggctagactcaatgcattggctgaattcatccccctttcctcatctgttaaaaacagaaatcatatcacatgcctagactgacaaatgaaaaagtaataattttgatcatcggccctccaatttggcaaaaactataaaacaagaaaagtactgcagttgccaaagacagggaacacacagttctaaatttcaggtccttctcttggatgctttacaggggccagggtcagatcagtgatacttgttaagcaattgtaaaaggagatggtgttggcaagaaccagacagcttatatcctaccatccagatttatatggtggatgggtatcttggaccaatttagttaaaagtgattaacattctattatttaaatgatggttgggtagtcttatttccatccctttttgcaaatccataaaaactcaggcccagtgttgtcatatcttccacttgtaagagaagccagaaatccagattttttatgtgaaatattttgatagttttaaatgttgagaactaattcacaatttgaaaagcgctttgtggacaaaatgcattcgtagatcagtttcagcccacaggccacagtttgcaatctctcatgtagtctgctgtcttataaccttttgaaatttcaccttatgtgaagatttagagagctggactaatgaaatctaacttcatctctaaccatcttggattctttaagacactgtcttattttgtaatgtaaaaacataccaaatacaactttgaatgaatttgtaagtcttggtaaaaagtaatctcattgtccagaaagaactatcaactcctatatctggagaggacattagaaattatccaaagcttgtccatccccatctccacatgagagatttagaaattatcccagagtcttgcctacaatcagttgttcattagtggcagggtttgagctaaaacacaggtttcaaaatataggttgagtattccttatcctcagtgcttgagagcagaagtgttttgaatttttaaaggattttagaatatttatgtcatactggttgagcatccctaatccaaaaatctgaaatccaaagtgcttcaatgagcatttctattgagcatcatgtcatgatcaaaaagattttagagcatttcagatattatgtttttggattatggaagctaaatctgtatatcctttcccttcatcatctagcttttttcattctgatatggaagtcatttagcctcctagatccagccattcctgcagtcacttctgtaccagtctcttcacttacatgaaccagtaagtcactcaacctcttttttgatttagccacttgtgctgggtttctgtcacttagaaccaacagaatctgactgacattgcctaacagtgactcttttccacatttctgctacctagtgttcttctccagactgcaatacctgtttttcctatgcttactcaaatgaaattaacttttaaagacctaaccctagtctactttctctatgaagatttttttctactactgtatccaatcctgtgtgtgcatgcactcttctttcttccttccccactttagtacttctaatcagcgtcttacaactaaaactttcttattcagcttatttgacatatatgttatcttccaaactagaagctcccccagttcaggaaccacatctcacaagtaccaatttcttctgccatcaagcctgggtgagcgcttggtgcaatgagtaactggtcagttatttagaacttatttctaggttagaactctcatcattccagcttaagttttatagacacctgtccccaaatcacagatgctggttatatttcaacatgatagcttacgattgtttattaaatttgcttttgcagtgggaagatccctaagtcatttgacttttatcattttactcagtgcaattcttcaggaatgaaacatttaatttcctttgttcttcggtccagttttagggaatcataagcctatgctaggggtgtaatgaggcaagaacctttcatggtattccgcatcttcagaaagtctctgctatcagtgcataacagcggcttcccaatgtaccaaggaaaatggggaggggagaatgccaacaagcccatttaaataattcagttcttcccctgatgaagagaaacaattctgtttaaagaaaaattggtttaatcgtcactttgttctctcaaaaggtagaatttttttttagactgcaagtcatatattgcactaacaaagcaaaccttaagaattttgagtagaccaaagtgcctcaaaatatatctgagtagacaactttattattgattcaaaacacacacatacttgcgctctctctcacacacatatatagttagctagcactaggtctttttatgtaaggtatggctttttagtcttgcccaaataagcccaagtaaatgaataaggaaagaatttctatggctatgactcaacattagccatcatttcatgggcagatacaagctgaatcatacagaaatgagtagcttgaacttacaagacatttgtcctcttgaatgaaataggaattgctgtgtaatagacagttttaaggattacccttttcccccatcatgcacagacacacatgtacactatacctatgtatgtagacacaatgctcattttaaactattagaataattcctacatcatttaaaaaatggtcatgtcaatctaaatattacatgaattgctaacagtgcctgcttttacattccctcactataagtagctagttcacacaaggtagccacccatcaccgttactacatagtttagaaacatatggtatagctttgccatgccaacttctaggtattcactttaccattctgacaaaagaagaagaaaaagcaaagaactgctttccaaactgtcatttctgagctactgaaacatacattgttacattctggtggggagatttttgttttggtcataaattatttcgccatgttatatttcaattcacagtaatgtaacataatatatcggtaaataataaaatgttttttcagatagtctgtttaaagtcccctctttaattaggaagattgttggaatgctctttttctcagtaaaagtgaaaccaaagtaattaccaaaattatccaaatgatggtactgtctccttctgttccttcggaagtgttcttccgagctaaaatctttttcctttcagtttaaacgacatagtaaagttgatacagtctagtgttaaatttacccactaaaagcccatccctctccttcatattctttaagaagttatacttaagcatccactttgcccatagtgactatatttgatgggtgtacaggggaagaaaggaggacctctctcaattcagagagaaataactctgggtaaagaagtacacctgacatgttgttaggattctagggctctttttatcctagactatttctagccagtatctcatattaaaaagataggatttggaatcagaatgtttcacacttcaattgccatcttttacccatctacgtggtgctttaggcaaataacaaaatttccaagtctcagttttttaaaaacgaggatggcaatttgtacattgttagagttaggagatttaaaaaatgatttaagaacagaaaaaaataactttggctaaaaactaaggaaatctgaataaactacagactttagttaataataatgtatcaatattagttcattgtaacccatgtcccatactactgtaagatattaagaagggaaattagatatggagtatataggaactctctgtaccgtatatcaatttttcagtgaattgaaagctgttcagaaagataaaatctattcttcaaaaaatgatctatgtgccgtgcacatagtagatacttgaaaaagtggtgtgagtattgtgatatagattatttggtttcatatggtgcattatactctgtacaatatggtcttttctccacaattcagcaattccttttcatagatctcgttctctctctctctgacctccatatcatcctatccctttctctacatttttcctctttttctagttcatccttttctattctactgcaaactcatgtttagtttacaactagtttatctttctccaagactaactttagctcatcaactatttgttggctttaaactttaccacagtgattatgcaaaccttttaattactctcaatcattgcttatttttaaaaaatcagagttctaagctttctacttgaaggagcaaaacacacctctagaaaggcattaaaaacttacagatatagcagtgaaaaagcttctttttgtaataaggagatatatatatatattttgttgttgtttaaatttagcttcccagtatagccaaaagctctgggatagcttcactgggatatgtatttagcaacagtttgctgtgataactaagaatagtttgaccaaatgtcagtgttatcaatctgtcctggagtctctctgaggttaagctcccgtgtaaaaatgcaaacagcatgcccctcaaaaccacagctttgagtggattcaggtaaagcatacaatcagatcagaaaaatctggccttataataatctctaaagtaactgaagtttctgtttagaagaactgtgtctctgtgggatttctttctccatgctagctctggacttaagcaactatttaaaggacagacctctagagactttgataaatgtctctagacatctcccccacccctttcgacctaacacttaaagtcacagttttcattgtcaaaggaatggaatatttttggctggtgctgttattactgggatagattttggaggttgaagttcctatgctgtaaaggcacaattacaataggaattccaaactgaaatgtgaactattaggccccgtggactcaacatccagccttaaaataatatcccaaaaacttttacttctctgaggatacttttgctctactgcagtcaaaaatacgaattgaaaaaacaaggggccacagataaagatggagagtcttgtgtgtaacccacctcctgtctctcaccctggaaatcagttttatcttttaatgaaactgatatccaagctcgtgatggctgaaataaatcatcagtgctgggtggtgtgtgtacacatgtaagcaaaacaaacagagaaatctgtgctaactcaaggtaagggtggataaatacggaaaacctaatgctactacagcaacatgtaatttgttcttaaatggcagcaactgaaagattcactattttcagacactagtctcacagtcttgatggggttaggactggcctcacactgcctctgtgtggggcttgactggcttttttgatagctcaagtgctgcaaatttatttaaaagagaacagaacgctgactttcttcactaactcactccagctgggttcctgcctgcttttcttctgtccccaccccccgccactgcccctcatcttgcagtacccctcatccctttctccagctaaagaacagctgatagaaataggcgcctttttttttttttttttaacatcaaaggcagcccagagctatgtcagccttgccccagcctcagacagaaaaagcttttgatgcctcagattgcgaagctttttgcagctgtactttatcaaggcagcagtggcagggcttggaggacccaggcgagccagaaggtggcggcgaagtcaccttgggaagaggagaatagggtcaaagacaggacggcggaggggctgacccggacggaaggaccagagggcgtgcccctgctctggggtcagtgaggaagggtcagggggactggtgagaactccagccataaggaagcagtgcccgaggacactttggcgacgctagtcggtgatcagctgacccgggcagggagaggagggtgcccttcgcagagtcacgggaagcttcgccttctgggcttgctttctcccgcctgcccctgcggttgctctctgccccagcgagcggagcgctgctccaagacgctcttctccctccacctcggcgcccccacctgccgttgcccccgcccgccgaacgcacgcccaggagggcgggcccggagttgagcgcagccgcccgccgctggagagcgctgggagccctgcaagcgagcaaggcctctctgggcgccgcgggcagcaaatcactccccgagcctctcggtccacaaagcgggacctgcctgcctcgctcaccaacgctcccgggctgggggggctcgagcaagcggcgctgcgctccgcggccctcgccggtcccagtcagctccaggagcgctccaggctgggttgggctgggcctgggcgagcccggccgctgggagggggcctcgtagccctttccccagggcgcggtctccacctctcctgctcctcctcgccagctgcgccgccagctcccattgttcaccccgcccgcctggcgacgtccgggtgctgctccctgggcctcccaggcgcacctaccttctgctgccggcgagccatgtcggtgggctgcttggcattaaaggggtaggcgatgcagcgcatcacgaacacatacagctgcagcctcttcttcctctcctcctcctctttctgcagccgctccaactcttccttctccttctcgctcaccaccgacgggctggggctggagggccggccgccgccagcgcggctgctgggttgcagccccccggccccgccgccgctgctcgcgccgctgcccccgccgccgcctgcacccaccccggctccggcgccggcgccgccgccccccagcccggcgctgccggccgagccctcgctggtacggctgggagacaggcgcgcgccggacggggccgagccgagcacctccttgccgctctcctcctccacgatctcatccgattcttcttcgctggacgaagggtccagcatagtggcgcctggggagcggggtctctggagcccccggcttggagtgcaaaaggtggggggcgctggaggcagccggggatcagctctcccgggtgggcgcttctccccaggtcagggagcgagagcgctgctgctcagcctcggccgccgcgactgatcctctgcccggcggtcgcgagctgggctcagacccagaagcgcgaagggaggaggggaagggagaggtgcgtccgtggactcgaggtgggcaagggggagaatcaattgcgagccccgagcccgcagccggatgccatctgcggctgctgaaggaggcgcctccagaaaagatgccgagtgttgcaagctgtcgatgcagccaagagccgaagaggcatcttgccgattggggagggagcggcgcttacgtgtttattggcttaactctcccgtgtccgcggcgtaaagggctgctgcagagggctggaggggggagagcgcggagcgtcctcagagcctcagtacttctgaccccaataccttgccaccctcctcccctgccggcttcgtggataatttttttgttgatatctggctctcattgcctcaaccccttttcccctcccgcggacaaaaagttcttgggggagggagaaatccagaaaccagccgagcgggctgtttggagacgctaaatcgagaggtcttacttaggaggaggaagtccgtgagatcttatacgggaaagaaagggtccatctcctttccccaggcttctttacacctggggcgtggggggcgtgggggctgggcagcgtgtttgtcccacctgtgtaaactctgattccagcaacttattccgcatgcgcccagtctaattaaaataaaagtgaatcaaattttgaatggattggtgtttcgaccaggcaactcaaccatttatgtagcgcccccgaccttgcctacccccacccccaaaatctatgatgaatcttcttcagttcccaagacctgggaatgctttctgctgaggtgagcctaccagaaaaatagaagggtttctggttgcttaaccctccctccattctggctcggtggaggcttggggaccccgcgatcagacaaagacaccctaagaactcagcggcgtcaacatctaatgcgtcgactgtcgcactctgttcacccctgcctctcgggtaaactattaatacaaagcagcagatggtgcctgccttccccgtgctcctttcacttaggccagtaaacctggtaaacgagggagctggccaacgtgctgaatgtaacctgcgacccgcacgcagatggatgaaaacaaaccaccagccagccaccttcagaacttaggctatctagagacctctccacttcatcgcctatatttatgtattttctagttctctaattatctgtagatactcgtgggagtgattttaatagtgtagcatgagtttaaagtttaaatcacttttgtctttacgtattttataatttaccatgagttttactagctttgatagtaaagtgacctgtttgagacctgcagatgaactcagaacaactggtttcacattaacctcaacaattctgtttgatcttttgagttaagtacttggatggcttatatttgacttcaccaccatacctcaaggacacaacttttgtggccatcacacatttggtaacaacacaaaatttaaaaaaaattgagcagtgcggggattgtgacagttttgcagcctcactttttaattcttctcaagaagtaaaggatgttcaaatcatgtggtattggttttcctggaacagaaaatatagtaagccaatcaattgatcaacaacctttatccagcaccttttaatgaagtaacacattgttctaggtgcttgggatagatagaatttttagaaggcattctcttaaagagtctataatctcctttgggagctacaacataaacatgtgaaaaagattgacagcacttattctgaggcaacatatcaacaaatccaggtcagtaaactgcaaaaagcttgcgtgaatgaagcaacttgaagtgaagggaatcatatatttctcaaagaagagaataaaatcttaagggaacataccatatacatgggtggtgaaaagagaaggtattgcaagtggaataagtggtttgcaatgccagagtaatagggcaagggatcaagtaaggttaaagagtgttatggaaacagggtatgggtaggtgacaggaggaggaaagagctgaaattataatccatttggcgaaataaagggaccatgtttaggacacaaattaaggagtatgtgatgatttggggaggagatgctgttgaaggccagaaacaggtcattcacagattaaatatttcttctaaggtctctttaggcatttaaatactgtcacatcagacattggtggcaaagtggccatgaattccatctacaaaaacacttggaatttcacaattgctgtaataaagttttgtttcatatttttacaaactcctttgggattatgtgggttttttccaggtatagtcattaatatagaaacttaatatccaccttttgtaaattacataaacctatgatttgggtgttaaacataacattgcttacataaatctaacaatcttctcaatcccccccaagagtattcaatcaaagaggcttacatagattttaccaaaaatatttccatatttttttcaaatggtgaacattgctgtctttcaaaatatacaccctttcgaagacatctcttaccttagccgaaagtcaacttggagatattctaaatatttgttagtattgaagataagatatgccaaccagaacttatgaggcatctgaagtagggattgtgacttccctaaatgtacattttgataaacaggggaaaagatgaccacagaacacatgcaaagtctcttaacttttgtctacctcttgtaaatatttgtgttcttatttttaaaagtagaattccaccatagattcttatacacctaagaatttatgtccttaagctattttatgtgcttgcatgtttgccccacatccagttctgctctgtagaaaacttggataacctcaagatgatggaatacattttaatcaactatctggagaccatatcatgaaagtagaagctataccgttgaattttgtaatcctacccccaaaagcaaagtctgcagaaaatggaaatgactgagacactaagccaggatttcctaatctaaacctagatgatctccatccttctatgaagtgtttgcctcgatgtgtcaaaggccacaagtatgaggaaatatctgactcgctggcaattgatagtttagtaaaaacaaacctcttctttatgtcacacataaaacacatttccatcaaatataactaagtttaatgcccactttgatgcttttgtgggtttgttactaaaaaataatttagctaagttaaatatttaaaaaatctcaataaacttcatattatctagatgtgatcatctcatctaatcaatatttaattttgtttaaattataagactagcttgcaagctccaaaaatgggttaatttgatcttacagtgtgccttaggtcaagttaaatgcttggcctctcaacccagacagttctgcctctaccacttaatagtagagctatcctgaacgaactaatgattcacattcagtatcctcatctgtaaaatgggggataatagtactcacttcccctggaatgacaacaaaaatagatgatatataaaaagcaattttcaaccaattttagctttacattttttttccagtgatctgagagggatgtgccataaatgagatgacaagaaattggacacaaataattagaaggaaacgaacataaaagaaatcaaataattcagaactagatcctgaaaaatagaagagttgcttatttgtttacttgatgcctgtctggttttagatagtattgtcagggattagaaatggtctattttgtttgagaaacctacttttcatcattactctttatatcatatgatgattcttactaaagtaaaatgaagcaggttaggatgaaattaaaggatcatcataaggctaaaaataataaaaatcgagccacaccaaagtatctttcactctaggcaacaaaacatgttttggaatgataaataatattacttgcaagaattggtcttggaaaatcactctcattacttaagaagatgaaaaagaaaagtgggacaacacattttacaataaatatttaagtcaaattctgaaagccaactattcacaagagtaatcatgtttcttgtgtacacaatttcttttaatagaagtgagaactagatgtggtatggattgaaatgcagtttatactggtatttacatggacaagatggagggttttgtcattttgcattgactctgaaatacagtgacataccatcaaataaaagggaaaaaaagtacccaagtggctgtttccacatcataaaatattacgtagataatctgcctaagtagcctaactcaccaattaggtttgccttgataaatgctaacattacatcttcaccttctgaaaagaattttctgagctgattgtctgggttatagttattttcacagactacaatggctttagtctggaggctttcttcagattgtaaataggaataactgaaattagggtattttcataataatcagtttgttttcagttttaaatatctgaaatggagagttcctttttttaggctgccctaaaacacaggggtcttacccaattttttggagaaagaaaataaataagaaaaggagattgagagaggcttcatgagtaaagggaaagtaagaaaaatgtaaggatgagtcctgatcaaagagtagatactgtcatctgggttaggggacattaagggcaaatatactgggggaaattctctaaaccagccctggtcacctaggtgccaaactaaactaacaaaagggaacttcattgattaaggcctgagccctgctcataggagtgtacttcttcttctccttcttctttttagagtgacactgaccttccattttagagtccactattccagcccattttcataagaactccatcagtcttctcttgtttctttcatctgtaagagctttctgtcccagtcttttccaaaataacatttgtggagatgctgacatgctgttatttttcactcagaagttgtacctaatgatttaccatgagaatcaagggacttctaaaagaacttggagtcgcattatgataaagtttcatatattccaaccaggcacttatgagtgtaccaatcctattcttttattgtctgttatcccatgtgggtcttgagagagatatacaaagaacaattgcatataaaaatcataatggaattatgataactgggatggggctcaaaactcccccaacacagaactctgataatttgaaagtgagtcatgtatttttggctttatatctaagcagaatctctaccttcattggccagaattcatatcttcatgttttattatcctctgttcagtgacaaggtacaggaagtggaaataacagttcagtaaggcaatgcctgcaaaaagagagaaattgaagggtctgccccaagattgcaggtcttgaatccactcaccccagtcacatggggtgacaaacatggatgacatacctccttaatgaacagagtcctacccactagcagacatgcctcaactggcacatgtcacctaataaatctaatttatattccctcttcttgaggaggagatagaagaggatagaaaaacaggctgacagagaatcaagagtttgcttttgaacgggaggaaaatatttcttttttcctcacctattactaggctcatggctgaggcccctctaataaaggacagattaacaagagaaaagcatacaagtttatttaatacacattttacatgacacaggagccttcagaaatgaggactcaggccgggtgcagtggctcatgactgtaattccagcactttgggaagccaagggaggtggatcacctgaggccaggagttggagaccagcctggccaacatggcaaaaccctgtctctaccaaaaatacaaaaattagccaggcatggtggtacatgcctgtaatcccagctacttcagagtctgaggcagcagaatcacttgaacctgggaggtagaggttgcagtgagctgagatcacacaactgcactccagcctgggcaacagagcaagactgtctcaaataaataaataaataaataaataaataaataaataaataaggaaaagaaatgagggcccaaaaaacagggaaacctgtacatttttatgcttagttttgattaagagtggatagtcatagagaagtataactggacaaagggagtattattgaatggtagtaaaccgagaaggacttagaaaacctgttggttcatattcttctctatttcactgcattttcaaagataaggacatccatttcctatgaatatacgatgggtcctttcacatgaggatcttatcacctgctttaaaggaagttcaaaggattctttccaagttttatggcttgctttagggaaaaagggtgtgggaaggtgaaattgaccttcctgcttctgcctctgctgtttctcaaaagccaaggtgccatattctggggtaacgtgttctgaactctattttgggaaatggtggtatgcgcctgtagtcctagctacttgggaggctaaggtaggaggatcacttgagcccaggaggtggaggctgcagtgaacctccagcctgggtgacagagtgagactcaatctcaaaaaaaaaaaaatcataaccaaagctgctacttttcactaagtgggttagtctcttggacttctgattattctgcaaacaagaaagaatgggtttctcattagctgtatttatttggaattttggccctatgcttgacaatatctttgaaggagataataagctaatgcatgcatttgcttagaacaatgtatagcacatagtaaatttctgataaatgccagtggagatggtgatactgttgaatactatcttttatttcagataacaaggctgactcttattttttggaaaggagaggggctgaatttactaaggtcagtgagaaaccttttgccccgtaaaagggaggccacctaggacttacaacatgcagtaggctatgagggtcaacaccagggctgcaacacagatcttagagggagtgggtgatgtgttctttcaggacagatttaatatcttcttctttatccattctgatatcctagactacttttacatttttagaagggaccagcataaggaagagatttaagtgaatgaaagtgacaactagttaggctggaagacttgaacaggactctaaggggaagccattggagtgtgtctgaggaggtacatcaactgccatggagatacttttctgccttttgcttgcagggcattatttcatgccatgtaaagaccagtatgcagactttccttggactggtgaaaatcaatctccatttaaatcaacttatcataggaaaggcaataaatgtttaaagaatatcctgtacccaaagtcaactcagcgaagaggctgcagaaagttagttctaaaccatatggccttatctttccttgccttattatttatactgcccaacaaaatgagagccctctgagtcaccaggtcacttgtattgccaagtatttaagcagcacatttaccacgcagtatccttaatccatttgattacttcagaaaatgtgtggaaagggaaaactttatgtgtgtgttgatgccttcagacagtagattgagtaatcacataaaatgaagtaatcactttctttcccacccatgcatatgcataacctctggtgacttcataggcagtggaaatgacctcatcatggagtaacttcatcctacggttcaattacgtattcagggctattgcaggtaactgtcttcagttccttgctgacattttactggttgggtgataaaaactgatgaatgttcaaactgtacccaaattcatgacacaaagtatgtgactttaaaagtaatttcccttaggggtaactagatcaaaaatacacaggtattgtaacctgataagggtttttccccctaaatttttccaggttgggtgtcatctagataataaagacaaacttttgacatccccatgatcacctttatattccataatgatcactacagtcccaacatcgactatctggtctctttgtccccataattacccttgttattaccatgctttgtttcttgatttttaattcttgtagacaaagctccctggataaaacctgtccaggtacctcctgttttattcacttaattgtctctagaaaggaaaaggtcacttgacccaagactctaaaacactcaatattgcaaaatagtacaaattgtgccactgtaatcaggccggcctgagttcaaatcctgactttattagctgtgtgaccttggaaaagagagctgattctttgattctcagttcttcaatcttgaaattggcaataaaatatcaacgatgcataggggttttgtgaagatgaatcaagttaatgcatctaaaatgcttggcacattgaagctctttgcacactagaacagagaaaaaaaaacaaataaaatgctaaacacaatgtctggtgcatattcaggaaatagaggccattatcaatattatgcttgaacttgtgtcccactgactaggataactacaagaagagatatgtccagcatttgccttctgcagagaagtcaagtcctgttggaaaggcctctgcaaaaattctactttgttatcaagaacttaaccttctatccctgaacaaagagctgcatttgatagcttataaaaatacatgaagttatcattatgtattttatcaaaattcatctcaggaagaacttatttgccacatggccatgaaataagatgttacaaacagacttgtaatgaggttgacattcctgaaagaaaaaagaaagaaaaggccattcaaacattgctttttgagggctcagctaaatagctttcagaaagagcttccactagcttgtatttgcataacaaaaagattcctccaccttcctatagtcttatttgcagatccccagtagaatatttactaaagtctagatgcaattaaaccttttgtgaaatttgtgtttgatcatgaataggggtgagtcagaaagtttgaacgagactgaaagataaagggaagtatacaagaaagcactctcatcttatatttagcaatgacattcaaatgacaaaaaaagagagacaattttggagtaagatgaagttttccaatgagtgtgttcattgctaatcttggtttctttgtttattgctctcattaattcaactaacatatgctggatgttggaagatttgtttataaagtggtgatgggaaaggtagtcttggtctaaactaatctgtctggatttcgaaagtgctttattataaaaggaaaatatagtgagtcctcaaatagtagtgtgtgtttcattaacataacaaaaaatgggcttcagattgcctcagaaatatgccataaaacctaagctttttaaatttcactccagaaacttgaaagaaagtctgctctcacctctattattgttctgaattagaaattctttttgaacggttgatattttactatgaatatttcaaagacatggttactaaagagttttcctaacctggagaggtatttggagggtcaaacagggtgattatttttaacagaaaggaaggcctgaattagtcaaataattttttttataatttcaagaagaccagaggagagctgtgcatttgagtggtttgcttcagtaaaagagaacagattttcttttgctatgattttgtaggtttaaatttctcagtgtaattttcctgccacctgaccttattttcttttgcaaaggcaaaacaaataaacttgaaaggaagagggaaggaaaacaataatctatgttttcatgttctgggattatttgattttctggtaggcttgtcttgcttacttataatcataccaaaatattcataattttaaaattggcaggaaatgaagctgcaatccttctgtccctgttggaacatataggggaatcaggattttctcctaccccagagattcctttcagcatgcgccaattttcatgcctgaggatgctaagtgacaagaat
